US012552743B2

(12) United States Patent
Zhang et al.

(10) Patent No.: US 12,552,743 B2
(45) Date of Patent: Feb. 17, 2026

(54) OLIGONUCLEOTIDE COMPOSITIONS AND METHODS OF USE THEREOF

(71) Applicant: WAVE LIFE SCIENCES LTD., Singapore (SG)

(72) Inventors: Jason Jingxin Zhang, Walpole, MA (US); Chandra Vargeese, Schwenksville, PA (US); Naoki Iwamoto, Boston, MA (US); Chikdu Shakti Shivalila, Woburn, MA (US); Nayantara Kothari, Newton, MA (US); Ann Fiegen Durbin, Arlington, MA (US); Selvi Ramasamy, Wayland, MA (US); Pachamuthu Kandasamy, Belmont, MA (US); Jayakanthan Kumarasamy, Belmont, MA (US); Gopal Reddy Bommineni, Belmont, MA (US); Subramanian Marappan, Acton, MA (US); Sethumadhavan Divakaramenon, Lexington, MA (US); David Charles Donnell Butler, Medford, MA (US); Genliang Lu, Winchester, MA (US); Hailin Yang, Brighton, MA (US); Mamoru Shimizu, Arlington, MA (US); Prashant Monian, Arlington, MA (US)

(73) Assignee: WAVE LIFE SCIENCES LTD., Singapore (SG)

( * ) Notice: Subject to any disclaimer, the term of this patent is extended or adjusted under 35 U.S.C. 154(b) by 1220 days.

(21) Appl. No.: 17/046,752

(22) PCT Filed: Apr. 11, 2019

(86) PCT No.: PCT/US2019/027109
§ 371 (c)(1),
(2) Date: Oct. 9, 2020

(87) PCT Pub. No.: WO2019/200185
PCT Pub. Date: Oct. 17, 2019

(65) Prior Publication Data

US 2022/0306573 A1 Sep. 29, 2022

Related U.S. Application Data

(60) Provisional application No. 62/776,432, filed on Dec. 6, 2018, provisional application No. 62/723,375, filed on Aug. 27, 2018, provisional application No. 62/715,684, filed on Aug. 7, 2018, provisional application No. 62/670,709, filed on May 11, 2018, provisional application No. 62/656,949, filed on Apr. 12, 2018.

(51) Int. Cl.

| | |
|---|---|
| ***C07H 21/02*** | (2006.01) |
| ***A61K 31/7125*** | (2006.01) |
| ***C07C 317/28*** | (2006.01) |
| ***C07H 1/02*** | (2006.01) |
| ***C07H 19/09*** | (2006.01) |
| ***C07H 21/04*** | (2006.01) |
| ***C12N 15/113*** | (2010.01) |

(52) U.S. Cl.
CPC ........ *C07C 317/28* (2013.01); *A61K 31/7125* (2013.01); *C07H 1/02* (2013.01); *C07H 19/09* (2013.01); *C07H 21/02* (2013.01); *C07H 21/04* (2013.01); *C12N 15/113* (2013.01); *C12N 2310/11* (2013.01); *C12N 2310/315* (2013.01); *C12N 2320/33* (2013.01)

(58) Field of Classification Search
CPC .......... C07H 1/02; C07H 19/09; C07H 21/02; C07H 21/04; A61K 31/7125
See application file for complete search history.

(56) References Cited

U.S. PATENT DOCUMENTS

| | | | |
|---|---|---|---|
| 5,270,468 | A | 12/1993 | Khanna et al. |
| 5,512,668 | A | 4/1996 | Stec et al. |
| 5,750,669 | A | 5/1998 | Rosch et al. |
| 5,852,188 | A | 12/1998 | Cook |
| 8,470,987 | B2 | 6/2013 | Wada et al. |
| 8,729,036 | B2 | 5/2014 | Zamore et al. |
| 8,822,671 | B2 | 9/2014 | Shimizu et al. |

(Continued)

FOREIGN PATENT DOCUMENTS

| | | | |
|---|---|---|---|
| EP | 3118311 | A1 | 1/2017 |
| JP | 2003-238586 | A | 8/2003 |

(Continued)

OTHER PUBLICATIONS

U.S. Appl. No. 18/178,470, filed Mar. 3, 2023, Vargeese et al.

(Continued)

*Primary Examiner* — Jonathan S Lau
(74) *Attorney, Agent, or Firm* — Choate, Hall & Stewart LLP; Xiaodong Li; Dustin K. Goncharoff

(57) ABSTRACT

Among other things, the present disclosure provides designed oligonucleotides, compositions, and methods of use thereof. In some embodiments, the present disclosure provides technologies useful for reducing levels of transcripts. In some embodiments, the present disclosure provides technologies useful for modulating transcript splicing. In some embodiments, provided technologies can alter splicing of a dystrophin (DMD) transcript. In some embodiments, the present disclosure provides methods for treating diseases, such as Duchenne muscular dystrophy, Becker's muscular dystrophy, etc.

11 Claims, 3 Drawing Sheets

Specification includes a Sequence Listing.

(56) References Cited

U.S. PATENT DOCUMENTS

| | | | |
|---|---|---|---|
| 8,859,755 B2 | 10/2014 | Wada et al. | |
| 8,883,752 B2 | 11/2014 | Swayze et al. | |
| 8,927,513 B2 | 1/2015 | Manoharan et al. | |
| 9,394,333 B2 | 7/2016 | Wada et al. | |
| 9,476,044 B2 | 10/2016 | Tuschl et al. | |
| 9,598,458 B2 | 3/2017 | Shimizu et al. | |
| 9,605,019 B2 | 3/2017 | Verdine et al. | |
| 9,617,547 B2 | 4/2017 | Gemba | |
| 9,695,211 B2 | 7/2017 | Wada et al. | |
| 9,708,361 B2 | 7/2017 | Watanabe et al. | |
| 9,744,183 B2 | 8/2017 | Verdine et al. | |
| 9,982,257 B2 | 5/2018 | Butler et al. | |
| 10,144,933 B2 | 12/2018 | Gemba et al. | |
| 10,149,905 B2 | 12/2018 | Gemba et al. | |
| 10,160,969 B2 | 12/2018 | Meena et al. | |
| 10,167,309 B2 | 1/2019 | Shimizu et al. | |
| 10,280,192 B2 | 5/2019 | Verdine et al. | |
| 10,307,434 B2 | 6/2019 | Verdine et al. | |
| 10,322,173 B2 | 6/2019 | Gemba et al. | |
| 10,329,318 B2 | 6/2019 | Wada et al. | |
| 10,428,019 B2 | 10/2019 | Wada et al. | |
| 10,450,568 B2 | 10/2019 | Butler et al. | |
| 10,479,995 B2 | 11/2019 | Vargeese et al. | |
| 10,590,413 B2 | 3/2020 | Butler et al. | |
| 10,696,711 B2 | 6/2020 | Shimizu et al. | |
| 10,724,035 B2 | 7/2020 | Vargeese et al. | |
| 10,815,482 B2 | 10/2020 | Meena et al. | |
| 11,013,757 B2 | 5/2021 | Zhang et al. | |
| 11,034,958 B2 | 6/2021 | Fitzgerald et al. | |
| 11,136,346 B2 | 10/2021 | Shimizu et al. | |
| 11,208,430 B2 | 12/2021 | Stetsenko et al. | |
| 11,407,775 B2 | 8/2022 | Butler et al. | |
| 11,596,646 B2 | 3/2023 | Zhang et al. | |
| 11,597,927 B2 | 3/2023 | Vargeese et al. | |
| 11,603,532 B2 | 3/2023 | Vargeese et al. | |
| 11,608,355 B2 | 3/2023 | Bowman et al. | |
| 11,634,710 B2 | 4/2023 | Frank-Kamenetsky et al. | |
| 11,643,657 B2 | 5/2023 | Butler et al. | |
| 11,718,638 B2 | 8/2023 | Butler et al. | |
| 11,739,325 B2 | 8/2023 | Vargeese et al. | |
| 11,873,316 B2 | 1/2024 | Butler et al. | |
| 12,391,942 B2 | 8/2025 | Zhang et al. | |
| 2005/0059619 A1 | 3/2005 | Krieg et al. | |
| 2008/0200409 A1 | 8/2008 | Wilson et al. | |
| 2009/0005550 A1* | 1/2009 | Heindl | C07H 21/00 536/25.34 |
| 2009/0023675 A1 | 1/2009 | McSwiggen et al. | |
| 2009/0286851 A1 | 11/2009 | Akinc et al. | |
| 2011/0130441 A1 | 6/2011 | Seth et al. | |
| 2011/0263682 A1 | 10/2011 | De Kimpe et al. | |
| 2012/0184595 A1 | 7/2012 | MacDonald et al. | |
| 2013/0156845 A1 | 6/2013 | Manoharan et al. | |
| 2013/0211062 A1 | 8/2013 | Watanabe et al. | |
| 2014/0113957 A1 | 4/2014 | Bettencourt et al. | |
| 2014/0323709 A1 | 10/2014 | Obika et al. | |
| 2015/0211006 A1* | 7/2015 | Butler | C12N 15/113 544/161 |
| 2016/0355808 A1 | 12/2016 | Khvorova et al. | |
| 2017/0312367 A1 | 11/2017 | Khvorova et al. | |
| 2017/0320903 A1 | 11/2017 | Watanabe et al. | |
| 2017/0340661 A1 | 11/2017 | Fitzgerald et al. | |
| 2018/0028554 A1 | 2/2018 | Van Deutekom et al. | |
| 2018/0216107 A1 | 8/2018 | Frank-Kamenetsky et al. | |
| 2019/0077817 A1 | 3/2019 | Butler et al. | |
| 2019/0127733 A1 | 5/2019 | Butler et al. | |
| 2019/0249173 A1 | 8/2019 | Vargeese et al. | |
| 2019/0264267 A1 | 8/2019 | Yang et al. | |
| 2019/0375774 A1 | 12/2019 | Butler et al. | |
| 2019/0390197 A1 | 12/2019 | Butler et al. | |
| 2020/0080083 A1 | 3/2020 | Vargeese et al. | |
| 2020/0157545 A1 | 5/2020 | Vargeese et al. | |
| 2020/0190515 A1 | 6/2020 | Vargeese et al. | |
| 2020/0231620 A1 | 7/2020 | Bowman et al. | |
| 2020/0299692 A1 | 9/2020 | Frank-Kamenetsky et al. | |
| 2020/0362337 A1 | 11/2020 | Dodart et al. | |
| 2021/0032620 A1 | 2/2021 | Vargeese et al. | |
| 2021/0115444 A1 | 4/2021 | Meena et al. | |
| 2021/0130821 A1 | 5/2021 | Butler et al. | |
| 2021/0198305 A1 | 7/2021 | Vargeese et al. | |
| 2021/0228615 A1 | 7/2021 | Zhang et al. | |
| 2021/0254062 A1 | 8/2021 | Zhang et al. | |
| 2022/0098585 A1 | 3/2022 | Brown et al. | |
| 2022/0127301 A1 | 4/2022 | Shimizu et al. | |
| 2022/0145300 A1 | 5/2022 | Liu et al. | |
| 2022/0162598 A1 | 5/2022 | Vargeese et al. | |
| 2022/0186217 A1 | 6/2022 | Zhang et al. | |
| 2022/0195429 A1 | 6/2022 | Vargeese et al. | |
| 2022/0307019 A1 | 9/2022 | Yokota et al. | |
| 2022/0401467 A1 | 12/2022 | Zhang et al. | |
| 2023/0089442 A1 | 3/2023 | Kandasamy et al. | |
| 2023/0136645 A1 | 5/2023 | Butler et al. | |
| 2023/0145795 A1 | 5/2023 | Byrne et al. | |
| 2023/0203087 A1 | 6/2023 | Kandasamy et al. | |
| 2023/0220384 A1 | 7/2023 | Monian et al. | |
| 2023/0295617 A1 | 9/2023 | Vargeese et al. | |
| 2023/0295619 A1 | 9/2023 | Maguire et al. | |
| 2023/0329201 A1 | 10/2023 | Yang et al. | |
| 2023/0348524 A1 | 11/2023 | Bowman et al. | |
| 2023/0392137 A1 | 12/2023 | Monian et al. | |
| 2024/0026358 A1 | 1/2024 | Monian et al. | |
| 2024/0109931 A1 | 4/2024 | Vargeese et al. | |
| 2024/0117347 A1 | 4/2024 | Butler et al. | |
| 2024/0132894 A1 | 4/2024 | Vargeese et al. | |
| 2024/0150756 A1 | 5/2024 | Frank-Kamenetsky et al. | |
| 2024/0174710 A1 | 5/2024 | Butler et al. | |
| 2024/0175016 A1 | 5/2024 | Liu et al. | |
| 2024/0175018 A1 | 5/2024 | Vargeese et al. | |
| 2024/0229026 A1 | 7/2024 | Butler et al. | |
| 2024/0368207 A1 | 11/2024 | Butler et al. | |
| 2025/0154190 A1 | 5/2025 | Kandasamy et al. | |
| 2025/0197857 A1 | 6/2025 | Hu et al. | |
| 2025/0262235 A1 | 8/2025 | Lu et al. | |

FOREIGN PATENT DOCUMENTS

| | | |
|---|---|---|
| JP | 2011-184318 A | 9/2011 |
| JP | 2017-506911 A | 3/2017 |
| WO | WO-2000/004034 A2 | 1/2000 |
| WO | WO-2003/002587 A2 | 1/2003 |
| WO | WO-2004/007718 A2 | 1/2004 |
| WO | WO-2005/014609 A2 | 2/2005 |
| WO | WO-2005/023828 A1 | 3/2005 |
| WO | WO-2005/028494 A1 | 3/2005 |
| WO | WO-2005/070859 A1 | 8/2005 |
| WO | WO-2005/085272 A1 | 9/2005 |
| WO | WO-2005/092909 A1 | 10/2005 |
| WO | WO-2006/023880 A2 | 3/2006 |
| WO | WO-2007/059816 A1 | 5/2007 |
| WO | WO-2008/128686 A1 | 10/2008 |
| WO | WO-2009/054725 A2 | 4/2009 |
| WO | WO-2009/127060 A1 | 10/2009 |
| WO | WO-2010/050802 A2 | 5/2010 |
| WO | WO-2010/064146 A2 | 6/2010 |
| WO | WO-2011/005761 A1 | 1/2011 |
| WO | WO-2011/034072 A1 | 3/2011 |
| WO | WO-2011/108682 A1 | 9/2011 |
| WO | WO-2012/029986 A1 | 3/2012 |
| WO | WO-2012/037254 A1 | 3/2012 |
| WO | WO-2012/039448 A1 | 3/2012 |
| WO | WO-2012/073857 A1 | 6/2012 |
| WO | WO-2013/009735 A1 | 1/2013 |
| WO | WO-2013/012758 A1 | 1/2013 |
| WO | WO-2013/112053 A1 | 8/2013 |
| WO | WO-2014/007620 A2 | 1/2014 |
| WO | WO-2014/010250 A1 | 1/2014 |
| WO | WO-2014/010718 A1 | 1/2014 |
| WO | WO-2014/012081 A2 | 1/2014 |
| WO | WO-2014/179626 A2 | 11/2014 |
| WO | WO-2015/107425 A2 | 7/2015 |
| WO | WO-2015/108046 A1 | 7/2015 |
| WO | WO-2015/108047 A1 | 7/2015 |
| WO | WO-2015/108048 A1 | 7/2015 |
| WO | WO-2015/123264 A1 | 8/2015 |
| WO | WO-2016/028187 A1 | 2/2016 |

(56) References Cited

FOREIGN PATENT DOCUMENTS

WO WO-2017/015555 A1 1/2017
WO WO-2017/015575 A1 1/2017
WO WO-2017/062835 A2 4/2017
WO WO-2017/062862 A2 4/2017
WO WO-2017/160741 A1 9/2017
WO WO-2017/192664 A1 11/2017
WO WO-2017/192679 A1 11/2017
WO WO-2017/205880 A1 11/2017
WO WO-2017/210647 A1 12/2017
WO WO-2018/014042 A1 1/2018
WO WO-2018/022473 A1 2/2018
WO WO-2018/067973 A1 4/2018
WO WO-2018/098264 A1 5/2018
WO WO-2018/223056 A1 12/2018
WO WO-2018/223073 A1 12/2018
WO WO-2018/223081 A1 12/2018
WO WO-2018/237194 A1 12/2018
WO WO-2019/002237 A1 1/2019
WO WO-2019/032607 A1 2/2019
WO WO-2019/032612 A1 2/2019
WO WO-2019/055951 A1 3/2019
WO WO-2019/071028 A1 4/2019
WO WO-2019/075357 A1 4/2019
WO WO-2019/118638 A2 6/2019
WO WO-2019/200185 A1 10/2019
WO WO-2019/217784 A1 11/2019
WO WO-2020/061200 A1 3/2020
WO WO-2020/118246 A1 6/2020
WO WO-2020/160336 A1 8/2020
WO WO-2020/191252 A1 9/2020
WO WO-2020/196662 A1 10/2020
WO WO-2020/219981 A2 10/2020
WO WO-2020/219983 A2 10/2020
WO WO-2020/227691 A2 11/2020
WO WO-2021/071788 A2 4/2021
WO WO-2021/071858 A1 4/2021
WO WO-2021/126734 A1 6/2021
WO WO-2021/178237 A2 9/2021
WO WO-2021/195467 A2 9/2021
WO WO-2021/234459 A2 11/2021
WO WO-2021/237223 A1 11/2021
WO WO-2022/046667 A1 3/2022
WO WO-2022/046723 A1 3/2022
WO WO-2022/072244 A1 4/2022
WO WO-2022/099159 A1 5/2022
WO WO-2023/049475 A1 3/2023
WO WO-2023/049477 A2 3/2023
WO WO-2023/075766 A1 5/2023
WO WO-2023/076352 A2 5/2023
WO WO-2023/154528 A1 8/2023
WO WO-2023/168014 A2 9/2023
WO WO-2023/201095 A2 10/2023
WO WO-2023/220440 A1 11/2023
WO WO-2024/035946 A1 2/2024
WO WO-2015/160090 A1 7/2025
WO WO-2025/151895 A1 7/2025

OTHER PUBLICATIONS

U.S. Appl. No. 18/204,895, filed Jun. 1, 2023, Vargeese et al.
U.S. Appl. No. 18/316,932, filed May 12, 2023, Butler et al.
U.S. Appl. No. 18/522,146, filed Nov. 28, 2023, Butler et al.
Kandasamy, P. et al., Control of backbone chemistry and chirality boost oligonucleotide splice switching activity, Nucleic Acids Research, 50(10):5443-5466 (2022).
Kandasamy, P. et al., Impact of guanidine-containing backbone linkages on stereopure antisense oligonucleotides in the CNS, Nucleic Acids Res., 50(10):5401-5423 (2022).
Kupryushkin, M.S. et al., Antisense oligonucleotide gapmers containing phosphoryl guanidinegroups reverseMDR1-mediated multiple drug resistance of tumor cells, Mol. Ther. Nucleic Acids, 27:211-226, (2021).
Oka, N. et al., Solid-phase synthesis of stereoregular oligodeoxyribonucleoside phosphorothioates using bicyclic oxazaphospholidine derivatives as monomer units, J. Am. Chem. Soc., 130(47):16031-16037 (2008).
Scharner, J. and Aznarez, I., Clinical Applications of Single-Stranded Oligonucleotides: Current Landscape of Approved and In-Development Therapeutics, Mol. Ther., 29(2):540-554 (2021).
Vargeese, C., Exploring new oligonucleotide backbone chemistries and their deployment to improve the properties of stereopure oligonucleotides, Wave Life Sciences, presented at Tides USA on Sep. 22, 2021.
Wave Life Sciences, R&D Day Presentation, 81 pages (Sep. 28, 2023).
WAVE Life Sciences, Second Quarter 2022 Earnings Presentation, 27 pages, (Aug. 11, 2022).
WAVE Life Sciences, Third Quarter 2022 Earnings Presentation, 24 pages, (Nov. 10, 2022).
WAVE Life Sciences, WAVE Life Sciences Corporate Presentation, 32 pages, Aug. 3, 2023.
WAVE Life Sciences, WAVE Life Sciences Corporate Presentation, 63 pages, May 12, 2022.
Zhang, L. et al., The Combination of Mesyl-Phosphoramidate Inter-Nucleotide Linkages and 2'-O-Methyl in Selected Positions in the Antisense Oligonucleotide Enhances the Performance of RNaseH1 Active PS-ASOs, Nucleic Acid Ther., 32(5):401-411 (2022).
U.S. Appl. No. 16/624,896, filed Dec. 19, 2019, Butler et al.
U.S. Appl. No. 17/177,111, filed Feb. 16, 2021, Zhang et al.
U.S. Appl. No. 17/439,755, filed Sep. 15, 2021, Kandasamy et al.
U.S. Appl. No. 17/375,658, filed Jul. 14, 2021, Vargeese et al.
U.S. Appl. No. 17/442,663, filed Sep. 24, 2021, Yokota et al.
U.S. Appl. No. 17/605,997, filed Oct. 22, 2021, Byrne et al.
U.S. Appl. No. 17/605,998, filed Oct. 22, 2021, Byrne et al.
U.S. Appl. No. 17/766,677, filed Apr. 5, 2022, Monlan et al.
U.S. Appl. No. 17/766,680, filed Apr. 5, 2022, Liu et al.
Anderson, B. A. et al., Towards next generation antisense oligonucleotides: mesylphosphoramidate modification improves therapeutic index and duration of effect of gapmer antisense oligonucleotides, Nucl. Acids. Res., 49(16):9026-9041 (2021).
Belikova, A. M., et al., Synthesis of Ribonucleosides and Diribonucleoside phosphates containing 2-chloro-ethylamine and Nitrogen Mustard Residues, Terahedron Letters, 37:3557-3562 (1967).
Fokina, A. et al., Analysis of new charge-neutral DNA/RNA analogues phosphoryl guanidine oligonucleotides (PGO) by gel electrophoresis, Analytical Biochemistry, 555: 9-11 (2018).
International Search Report for PCT/US2019/027109, 7 pages (mailed Sep. 24, 2019).
Jäger, A. et al., Oligonucleotide N-alkylphosphoramidates: synthesis and binding to polynucleotides, Biochemistry, 27(19):7237-46 (1988).
Koch, T., LNA Therapeutics—update, Navigate the phosphorothioate diastereoisomer space, Roche pRED RNA Therapeutics Research, EuroTIDES, PostillionConventionCenter, Amsterdam, Netherlands (Nov. 6-9, 2018).
Kozarski, M. et al., 7-Methylguanosine monophosphate analogues with 5'-(1,2,3-triazoyl) moiety: Synthesis and evaluation as the inhibitors of cNIIIB nucleotidase, Bioorg. Med. Chem., 26(1):191-199 (2018).
Kupryushkin, M. S. Phosphoryl Guanidines: A New Type of Nucleic Acid Analogues, Acta Naturae, 6(4): 116-118 (2014).
Kurata, C. et al., Characterization of high molecular weight impurities in synthetic phosphorothioate oligonucleotides, Bioorg. Med. Chem. Lett., 16:607-614 (2006).
Lebedeva, N. et al., Design of a New Fluorescent Oligonucleotide-Based Assay for a Highly Specific Real-Time Detection of Apurinic/Apyrimidinic Site Cleavage by Tyrosyl-DNA Phosphodiesterase 1, Bioconjugate Chem., 26(10):2046-2053 (2015).
Lee, M. Y. et al., Synthesis and SAR of sulfonyl- and phosphoryl amidine compounds as anti-resorptive agents, Bioorg. Med. Chem. Lett., 20:541-545 (2010).
Levina, A.S. et al., Impact of delivery method on antiviral activity of phosphodiester, phosphorothioate, and phosphoryl guanidine oligonucleotides in MDCK cells infected with H5N1 bird flu virus, Molecular Biology, 51(4): 633-638 (2017).

(56) References Cited

OTHER PUBLICATIONS

Ohkubo, A. et al., A new strategy for the synthesis of oligodeoxynucleotides directed towards perfect O-selective internucleotidic bond formation without base protection, Tetrahedron Letters, 45:363-366 (2004).
Ohkubo, A. et al., O-Selectivity and Utility of Phosphorylation Mediated by Phosphite Triester Intermediates in the N-Unprotected Phosphoramidite Method, J. Am. Chem., 126:10884-10896 (2004).
Pavlova, A. S. et al., SDS-PAGE procedure: Application for characterization of new entirely uncharged nucleic acids analogs, Electrophor., 39:670-674 (2018).
Prakash, T. P. et al., Identification of metabolically stable 5'-phosphate analogs that support single-stranded siRNA activity, Nucleic Acids Research, 43(6):2993-3011 (2015).
PubChem SID: 226629328, 9 pages, date available: Feb. 2, 2015.
PubChem SID: 316086382, 8 pages, date available: Aug. 2, 2016, date modified: Jun. 20, 2019.
PubChem SID: 355354479, 7 pages, date available: Apr. 8, 2018.
PubChem SID: 368967557, 7 pages, date available: May 25, 2018.
Rigo, F. et al., Synthetic oligonucleotides recruit ILF2/3 to RNA transcripts to modulate splicing, Nat. Chem. Bio., 8:555-562 (2012).
Sekine, M. et al., Proton-Block Strategy for the Synthesis of Oligodeoxynucleotides without Base Protection, Capping Reaction, and P—N Bond Cleavage Reaction, J. Org. Chem., 68:5478-5492 (2003).
Shen, W et al., Acute hepatotoxicity of 2' fluoro-modified 5-10-5 gapmer phosphorothioate oligonucleotides in mice correlates with intracellular protein binding and the loss of DBHS proteins, Nucl. Acids Res., 46(5):2204-2217 (2018).
Skaric, V. and Raza, Z., The Homologation of 1-(2,3-Dihydroxypropyl)- into 1-(2,4-Dihydroxybutyl)-thymine, Croatica Chemica Acta, 52(1):51-59 (1979).
Skaric, V. et al., Aliphatic Thymidine and Deoxyuridine Analogs, Croatica Chemica Acta, 52(3):281-292 (1979).
Skvortsova, Y. V., et al., A new Antisense Phosphoryl Guanidine Oligo-2'-O-Methylribonucleotide Penetrates Into Intracellular Mycobacteria and Suppresses Target Gene Expression, 10:1-9 (2019).
Stetsenko, D. A., Phosphoryl Guanidines: New Chemical Analogues of Nucleic Acids, 4 pages (Aug. 2015), <https://scfh.ru/en/papers/phosphoryl-guanidines-new-chemical-analogues-of-nucleic-acids-/>. Retrieved Sep. 15, 2020.
Stetsenko, D.A. and Pyshnyi, D.V., Ex Siberia Semper Novi: Siberia Always Brings US Something New, Phosphoryl Guanidines: New Chemical Analogues of Nucleic Acids, Science First Hand, N2(41): 2 pages (Aug. 30, 2015). URL: https://scfh.ru/en/papers/phosphoryl-guanidines-new-chemical-analogues-of-nucleic-acids-/.
WAVE Life Sciences Press Release, WAVE Life Sciences Announces Discontinuation of Suvodirsen Development for Duchenne Muscular Dystrophy, 2 pages (Dec. 16, 2019).
WAVE Life Sciences, Analyst & Investor Research Webcast (Aug. 2020), 64 pages.
Written Opinion for PCT/US2019/027109, 10 pages (mailed Sep. 24, 2019).
U.S. Appl. No. 18/613,034, filed Mar. 21, 2024, Vargeese et al.
U.S. Appl. No. 18/695,346, filed Mar. 25, 2024, Monian et al.
U.S. Appl. No. 18/695,348, filed Mar. 25, 2024, Acker et al.
U.S. Appl. No. 18/704,629, filed Apr. 25, 2024, Byrne et al.
U.S. Appl. No. 18/836,993, filed Aug. 8, 2024, Kandasamy et al.
U.S. Appl. No. 18/843,171, filed Aug. 30, 2024, Hu et al.
U.S. Appl. No. 18/856,553, filed Oct. 11, 2024, Lu et al.
U.S. Appl. No. 18/864,860, filed Nov. 11, 2024, Shivalila et al.
U.S. Appl. No. 18/864,863, filed Nov. 11, 2024, Liu et al.
U.S. Appl. No. 18/942,334, filed Nov. 8, 2024, Yang et al.
U.S. Appl. No. 18/953,020, filed Nov. 19, 2024, Meena et al.
U.S. Appl. No. 19/008,522, filed Jan. 2, 2025, Vargeese et al.
Chen, S. et al., Systematic evaluation of 2'-Fluoro modified chimeric antisense oligonucleotide-mediated exon skipping in vitro, Sci. Repo., 9(6078):1-10 (2019).
Del Fresno, M. et al., Substituted Guanidines: Introducing Diversity in Combinatorial Chemistry, Org. Lett., 2(23):3539-3542 (2000).
Flanigan, K. M. et al., Rapid Direct Sequence Analysis of the Dystrophin Gene, Am. J. Hum. Genet., 72:931-939 (2003).
Harding, P. L. et al., The Influence of Antisense Oligonucleotide Length on Dystrophin Exon Skipping, Mole. Ther., 15(1):157-166 (2007).
Inagawa, T. et al., Inhibition of human immunodeficiency virus type 1 replication by P-stereodefined oligo(nucleoside phosphorothioate)s in a long-term infection model, FEBS Letters, 528:48-52 (2002).
Jirka, S.M.G et al., Evaluation of 2'-Deoxy-2'-fluoro Antisense Oligonucleotides for Exon Skipping in Duchenne Muscular Dystrophy, Citation: Molecular Therapy—Nucleic Acids 4, e265 1-8 (2015).
Kawasaki, A. M. et al., Uniformly Modified 2'-Deoxy-2-2'-fluoro Phosphorothioate Oligonucleotides as Nuclease-Resistant Antisense Compounds with High Affinity and Specificity for RNA Targets, J. Med. Chem., 36:831-841 (1993).
Pannecouque, C. et al., Synthesis, enzymatic stability and physicochemical properties of oligonucleotides containing a N-cyanoguanidine linkage, Tetrahedron, 50(24):7231-7246 (1994).
Vandendriessche, F. et al., Synthesis, enzymatic stability and base-pairing properties of oligothymidylates containing thymidine dimers with different N-substituted guanidine linkages, J. Chem. Soc. Perk. Trans. 1, 14:1567-1575 (1993).
Wu, B. et al., Targeted Skipping of Human Dystrophin Exons in Transgenic Mouse Model Systemically for Antisense Drug Development, PLoS ONE, 6(e19906):1-11 (2011).
U.S. Appl. No. 19/217,825, Vargeese et al.
U.S. Appl. No. 19/271,472, Zhang et al.
U.S. Appl. No. 19/276,854, Zhang et al.
U.S. Appl. No. 19/281,441, Butler et al.
U.S. Appl. No. 19/281,453, Liu et al.
U.S. Appl. No. 19/284,561, Butler et al.
Bazhenov, M. A. et al., Study of the Staudinger Reaction and Reveal of Key Factors Affecting the Efficacy of Automatic Synthesis of Phosphoryl Guanidinic Oligonucleotide Analogs, Russian J. Bioorganic Chem., 45(6):699-708 (2019).
Chubarov, A. S. et al., Allele-Specific PCR for KRAS Mutation Detection Using Phosphoryl Guanidine Modified Primers, Diagnostics, 10(872):1-14 (2020).
Dmitrienko, E. et al., Surface modification of SOI-FET sensors for label-free and specific detection of short RNA analyte, Nanomedicine (Lond), 11(16):2073-2082 (2016).
Dovydenko, I. S. et al., A convenient solid phase approach to obtain lipophilic 5'—phosphoramidate derivatives of DNA and RNA oligonucleotides, Nucleosides Nucleotides Nucleic Acids, 37(2):102-111 (2018).
Dyudeeva, E. S. et al., Physicochemical Properties of the Phosphoryl Guanidine Oligodeoxyribonucleotide Analogs, Russian J. Bioorganic Chem., 45(6):709-718 (2019).
Epanchintseva, A. et al., Non-covalent binding of nucleic acids with gold nanoparticles provides their stability and effective desorption in environment mimicking biological media, Nanotech., 29(355601):1-15 (2018).
Fokina, A., et al., Analysis of new charge-neutral DNA/RNA analogues phosphoryl guanidine oligonucleotides (PGO) by gel electrophoresis, Anal. Biochem., 55:9-11 (2018).
Garafutdinov, R. R et al., Data on multimerization efficiency for short linear DNA templates and phosphoryl guanidine primers during isothermal amplification with Bst exo-DNA polymerase, Data Brief, 2020 29(105188):1-12 (2020).
Garafutdinov, R. R. et al., Prevention of DNA multimerization using phosphoryl guanidine primers during isothermal amplification with Bst exo-DNA polymerase, Biochimie, 168:259-267 (2020).
Kuznetsov, N. A. et al., New oligonucleotide derivatives as unreactive substrate analogues and potential inhibitors of human apurinic/apyrimidinic endonuclease APE1, Mol. Biosyst., 12(1):67-75 (2016).
Kuznetsov, N. A. et al., Pre-steady state kinetics of DNA binding and abasic site hydrolysis by tyrosyl-DNA phosphodiesterase 1, J. Biomol. Struct. Dyn., 35(11):2314-2327 (2017).
Lomzov, A. A. et al., Comparative physico chemical and biological studies of phosphorylguanidine oligonucleotide diasteriomers, Book of Abstracts, Albany 2019: The 20th Conversation, 76 (2019).

(56) References Cited

OTHER PUBLICATIONS

Lomzov, A. A. et al., Data for isolation and properties analysis of diastereomers of a mono-substituted phosphoryl guanidine trideoxyribonucleotide, Data Brief, 25(104148):1-25 (2019).
Lomzov, A. A. et al., Diastereomers of a mono-substituted phosphoryl guanidine trideoxyribonucleotide: Isolation and properties, Biochem. Biophys. Res. Commun., 513(4):807-811 (2019).
Lomzov, A. A. et al., Structure and hybridization properties of phosphorylguanidine oligonucleotides, Jrnl. Biomol. Struct. Dynamics, 37:83 (2019).
Markov, A. V. et al., Antiviral Activity of a New Class of Chemically Modified Antisense Oligonucleotides against Influenza A Virus, Russian J. Bioorganic Chem., 45(6):774-782 (2019).
Markov, O. V. et al., Transport Oligonucleotides—A Novel System for Intracellular Delivery of Antisense Therapeutics, Molecules, 25(3663):1-27 (2020).
Novopashina, D et al., Novel Peptide Conjugates of Modified Oligonucleotides for Inhibition of Bacterial RNase P, Front. Pharmacol., 10(813):1-21 (2019).
Pavlova A. S. et al., Amphiphilic “Like-a-Brush” Oligonucleotide Conjugates with Three Dodecyl Chains: Self-Assembly Features of Novel Scaffold Compounds for Nucleic Acids Delivery, Nanomaterials, 10(1948):1-19 (2020).
Su, Y. et al., Neutral and Negatively Charged Phosphate Modifications Altering Thermal Stability, Kinetics of Formation and Monovalent Ion Dependence of DNA G-Quadruplexes, Chem. Asian J., 14(8):1212-1220 (2019).
Su, Y. et al., The Importance of Phosphates for DNA G-Quadruplex Formation: Evaluation of Zwitterionic G-Rich Oligodeoxynucleotides, ChemBioChem, 21(17):1-13 (2020).

* cited by examiner

OLIGONUCLEOTIDE COMPOSITIONS AND METHODS OF USE THEREOF

CROSS-REFERENCE TO RELATED APPLICATIONS

This application is a National Stage Application of PCT International Application PCT/US2019/027109, filed Apr. 11, 2019, which claims priority to U.S. Provisional Application Nos. 62/656,949, filed Apr. 12, 2018, 62/670,709, filed May 11, 2018, 62/715,684, filed Aug. 7, 2018, 62/723,375, filed Aug. 27, 2018, and 62/776,432, filed Dec. 6, 2018, the entirety of each of which is incorporated herein by reference.

SEQUENCE LISTING

The instant application contains a Sequence Listing which has been submitted electronically in ASCII format and is hereby incorporated by reference in its entirety. Said ASCII copy, created on Dec. 23, 2020, is named SL.txt and is 836,470 bytes in size.

BACKGROUND

Oligonucleotides are useful in therapeutic, diagnostic, research and nanomaterials applications. The use of naturally occurring nucleic acids (e.g., unmodified DNA or RNA) for therapeutics can be limited, for example, because of their instability against extra- and intracellular nucleases and/or their poor cell penetration and distribution. There is a need for new and improved oligonucleotides and oligonucleotide compositions, such as, e.g., new oligonucleotides and oligonucleotide compositions capable of modulating exon skipping of Dystrophin for treatment of muscular dystrophy.

SUMMARY

Among other things, the present disclosure encompasses the recognition that structural elements of oligonucleotides, such as base sequence, chemical modifications (e.g., modifications of sugar, base, and/or internucleotidic linkages, and patterns thereof), and/or stereochemistry (e.g., stereochemistry of backbone chiral centers (chiral internucleotidic linkages), and/or patterns thereof), can have significant impact on oligonucleotide properties, e.g., activities, toxicities, e.g., as may be mediated by protein binding characteristics, stability, splicing-altering capabilities, etc. In some embodiments, the present disclosure demonstrates that oligonucleotide compositions comprising oligonucleotides with controlled structural elements, e.g., controlled chemical modification and/or controlled backbone stereochemistry patterns, provide unexpected properties, including but not limited to certain activities, toxicities, etc. In some embodiments, the present disclosure demonstrates that oligonucleotide properties, e.g., activities, toxicities, etc., can be modulated by chemical modifications (e.g., modifications of sugars, bases, internucleotidic linkages, etc.), chiral structures (e.g., stereochemistry of chiral internucleotidic linkages and patterns thereof, etc.), and/or combinations thereof.

In some embodiments, the present disclosure provides an oligonucleotide or an oligonucleotide composition. In some embodiments, an oligonucleotide or an oligonucleotide composition is a DMD oligonucleotide or a DMD oligonucleotide composition. In some embodiments, a DMD oligonucleotide or a DMD oligonucleotide composition is an oligonucleotide or an oligonucleotide composition capable of modulating skipping of one or more exons of the target gene Dystrophin (DMD). In some embodiments, a DMD oligonucleotide or a DMD oligonucleotide composition is useful for treatment of muscular dystrophy. In some embodiments, an oligonucleotide or oligonucleotide composition is an oligonucleotide or oligonucleotide composition which comprises a non-negatively charged internucleotidic linkage. In some embodiments, an oligonucleotide or oligonucleotide composition which comprises a non-negatively charged internucleotidic linkage is capable of modulating the expression, level and/or activity of a gene target or a gene product thereof, including but not limited to, increasing or decreasing the expression, level and/or activity of a gene target or gene product thereof via any mechanism, including but not limited to: an RNase H-dependent mechanism, steric hindrance, RNA interference, modulation of skipping of one or more exon, etc. In some embodiments, the present disclosure pertains to an oligonucleotide or oligonucleotide composition which comprises a non-negatively charged internucleotidic linkage, in combination with any other structure or chemical moiety described herein. In some embodiments, the present disclosure pertains to a DMD oligonucleotide or DMD oligonucleotide composition which comprises a non-negatively charged internucleotidic linkage.

In some embodiments, the present disclosure provides technologies related to an oligonucleotide or an oligonucleotide composition for reducing levels of a transcript and/or a protein encoded thereby. In some embodiments, as demonstrated by example data described herein, provided technologies are particularly useful for reducing levels of mRNA and/or proteins encoded thereby.

In some embodiments, the present disclosure provides technologies, e.g., oligonucleotides, compositions and methods, etc., for altering gene expression, levels and/or splicing of transcripts. In some embodiments, a transcript is Dystrophin (DMD). Splicing of a transcript, such as pre-mRNA, is an essential step for the transcript to perform its biological functions in many higher eukaryotes. In some embodiments, the present disclosure recognizes that targeting splicing, especially through compositions comprising oligonucleotides having base sequences and/or chemical modifications and/or stereochemistry patterns (and/or patterns thereof) described in this disclosure, can effectively correct disease-associated mutations and/or aberrant splicing, and/or introduce and/or enhance beneficial splicing that lead to desired products, e.g., mRNA, proteins, etc. which can repair, restore, or add new desired biological functions. e.g., one or more functions of Dystrophin.

In some embodiments, the present disclosure provides compositions and methods for altering splicing of DMD transcripts, wherein altered splicing deletes or compensates for an exon(s) comprising a disease-associated mutation.

For example, in some embodiments, a Dystrophin gene can comprise an exon comprising one or more mutations associated with a disease, e.g., muscular dystrophy (including but not limited to Duchenne (Duchenne's) muscular dystrophy (DMD) and Becker (Becker's) muscular dystrophy (BMD)). In some embodiments, a disease-associated exon comprises a mutation (e.g., a missense mutation, a frameshift mutation, a nonsense mutation, a premature stop codon, etc.) in an exon. In some embodiments, the present disclosure provides compositions and methods for effectively skipping a disease-associated Dystrophin exon(s) and/or a different or an adjacent exon(s), while maintaining or restoring the reading frame so that a shorter (e.g., internally truncated) but partially functional dystrophin can be produced. A person having ordinary skill in the art appreciates that provided technologies (oligonucleotides, compositions, methods, etc.) can also be utilized for skipping of other exons, for example, those described in WO 2017/062862 and incorporated herein by reference, in accordance with the present disclosure to treat a disease and/or condition.

Among other things, the present disclosure demonstrates that chemical modifications and/or stereochemistry can be used to modulate transcript splicing by oligonucleotide compositions. In some embodiments, the present disclosure provides combinations of chemical modifications and stereochemistry to improve properties of oligonucleotides, e.g., their capabilities to alter splicing of transcripts. In some embodiments, the present disclosure provides chirally controlled oligonucleotide compositions that, when compared to a reference condition (e.g., absence of the composition, presence of a reference composition (e.g., a stereorandom composition of oligonucleotides having the same constitution (as understood by those skilled in the art, unless otherwise indicated constitution generally refers to the description of the identity and connectivity (and corresponding bond multiplicities) of the atoms in a molecular entity but omitting any distinction arising from their spatial arrangement), a different chirally controlled oligonucleotide composition, etc.), combinations thereof, etc.), provide altered splicing that can deliver one or more desired biological effects, for example, increase production of desired proteins, knockdown of a gene by producing mRNA with frameshift mutations and/or premature termination codons, knockdown of a gene expressing a mRNA with a frameshift mutation and/or premature termination codon, etc. In some embodiments, compared to a reference condition, provided chirally controlled oligonucleotide compositions are surprisingly effective. In some embodiments, desired biological effects (e.g., as measured by increased levels of desired mRNA, proteins, etc., decreased levels of undesired mRNA, proteins, etc.) can be enhanced by more than 5, 10, 15, 20, 25, 30, 40, 50, or 100 fold.

The present disclosure recognizes challenges of providing low toxicity oligonucleotide compositions and methods of use thereof. In some embodiments, the present disclosure provides oligonucleotide compositions and methods with reduced toxicity. In some embodiments, the present disclosure provides oligonucleotide compositions and methods with reduced immune responses. In some embodiments, the present disclosure recognizes that various toxicities induced by oligonucleotides are related to cytokine and/or complement activation. In some embodiments, the present disclosure provides oligonucleotide compositions and methods with reduced cytokine and/or complement activation. In some embodiments, the present disclosure provides oligonucleotide compositions and methods with reduced complement activation via the alternative pathway. In some embodiments, the present disclosure provides oligonucleotide compositions and methods with reduced complement activation via the classical pathway. In some embodiments, the present disclosure provides oligonucleotide compositions and methods with reduced drug-induced vascular injury. In some embodiments, the present disclosure provides oligonucleotide compositions and methods with reduced injection site inflammation. In some embodiments, reduced toxicity can be evaluated through one or more assays widely known to and practiced by a person having ordinary skill in the art, e.g., evaluation of levels of complete activation product, protein binding, etc.

In some embodiments, the present disclosure provides oligonucleotides with enhanced antagonism of hTLR9 activity. In some embodiments, certain diseases, e.g., DMD, are associated with inflammation in, e.g., muscle tissues. In some embodiments, provided technologies (e.g., oligonucleotides, compositions, methods, etc.) provides both enhanced activities (e.g., exon-skipping activities) and hTLR9 antagonist activities which can be beneficial to one or more conditions and/or diseases associated with inflammation. In some embodiments, provided oligonucleotides and/or compositions thereof provides both exon-skipping capabilities and decreased levels of toxicity and/or inflammation. In some embodiments, the present disclosure provides an oligonucleotide which comprises one or more non-negatively charged internucleotidic linkages, wherein the oligonucleotide agonizes TLR9 activity less than another oligonucleotide which does not comprise a non-negatively charged internucleotidic linkage or which comprises fewer non-negatively charged internucleotidic linkages and which is otherwise identical. In some embodiments, the present disclosure provides an oligonucleotide which comprises one or more non-negatively charged internucleotidic linkages, wherein the oligonucleotide agonizes TLR9 activity less than an otherwise identical oligonucleotide which does not comprise a non-negatively charged internucleotidic linkage or which comprises fewer non-negatively charged internucleotidic linkages. In some embodiments, the present disclosure pertains to an oligonucleotide comprising at least one non-negatively charged internucleotidic linkage. In some embodiments, the non-negatively charged internucleotidic is selected from: n001, n002, n003, n004, n005, n006, n007, n008, n009, or n010, or a chirally controlled stereoisomer of n001, n002, n003, n004, n005, n006, n007, n008, n009, or n010. In some embodiments, the present disclosure pertains to an oligonucleotide which comprises at least two non-negatively charged internucleotidic linkages, wherein the linkages are different from each other. In some embodiments, the present disclosure pertains to an oligonucleotide comprising a CpG motif, wherein at least one internucleotidic linkage in the CpG (e.g., the p in CpG) or immediately upstream of the CpG (toward the 5' end of the oligonucleotide) or immediately downstream of the CpG (toward the 3' end of the oligonucleotide) is a non-negatively charged internucleotidic linkage. In some embodiments, TLR9 is a human TLR9. In some embodiments, TLR9 is a mouse TLR9.

In some embodiments, the present disclosure demonstrates that oligonucleotide properties, e.g., activities, toxicities, etc., can be modulated through chemical modifications. In some embodiments, the present disclosure provides an oligonucleotide composition comprising a plurality of oligonucleotides which have a common base sequence, and comprise one or more modified internucleotidic linkages (or "non-natural internucleotidic linkages", linkages that are not but can be utilized in place of a natural phosphate internucleotidic linkage (—OP(O)(OH)O—, which may exist as a salt form (—OP(O)($O^-$)O—) at a physiological pH) found in natural DNA and RNA), one or more modified sugar moieties, and/or one or more natural phosphate linkages. In some embodiments, provided oligonucleotides may comprise two or more types of modified internucleotidic linkages. In some embodiments, a provided oligonucleotide comprises a non-negatively charged internucleotidic linkage. In some embodiments, a non-negatively charged internucleotidic linkage is a neutral internucleotidic linkage. In some embodiments, a neutral internucleotidic linkage comprises a triazole, alkyne, or guanidine (e.g., cyclic guanidine)

moiety. Such moieties are optionally substituted. In some embodiments, a provided oligonucleotide comprises a neutral internucleotidic linkage and another internucleotidic linkage which is not a neutral backbone. In some embodiments, a provided oligonucleotide comprises a neutral internucleotidic linkage and a phosphorothioate internucleotidic linkage. In some embodiments, provided oligonucleotide compositions comprising a plurality of oligonucleotides are chirally controlled and level of the plurality of oligonucleotides in the composition is controlled or pre-determined, and oligonucleotides of the plurality share a common stereochemistry configuration at one or more chiral internucleotidic linkages. For example, in some embodiments, oligonucleotides of a plurality share a common stereochemistry configuration at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more chiral internucleotidic linkages, each of which is independently Rp or Sp; in some embodiments, oligonucleotides of a plurality share a common stereochemistry configuration at each chiral internucleotidic linkages. In some embodiments, a chiral internucleotidic linkage where a controlled level of oligonucleotides of a composition share a common stereochemistry configuration (independently in the Rp or Sp configuration) is referred to as a chirally controlled internucleotidic linkage.

In some embodiments, a modified internucleotidic linkage is a non-negatively charged (neutral or cationic) internucleotidic linkage in that at a pH, (e.g., human physiological pH (~7.4), pH of a delivery site (e.g., an organelle, cell, tissue, organ, organism, etc.), etc.), it largely (e.g., at least 5%, 10%, 20%, 30%, 40%, 50%, 60%, 70%, 80%, 90%, etc.; in some embodiments, at least 30%; in some embodiments, at least 40%; in some embodiments, at least 50%; in some embodiments, at least 60%; in some embodiments, at least 70%; in some embodiments, at least 80%; in some embodiments, at least 90%; in some embodiments, at least 99%; etc.;) exists as a neutral or cationic form (as compared to an anionic form (e.g., —O—P(O)($O^-$)—O—(the anionic form of natural phosphate linkage), —O—P(O)($S^-$)—O— (the anionic form of phosphorothioate linkage), etc.)), respectively. In some embodiments, a modified internucleotidic linkage is a neutral internucleotidic linkage in that at a pH, it largely exists as a neutral form. In some embodiments, a modified internucleotidic linkage is a cationic internucleotidic linkage in that at a pH, it largely exists as a cationic form. In some embodiments, a pH is human physiological pH (~7.4). In some embodiments, a modified internucleotidic linkage is a neutral internucleotidic linkage in that at pH 7.4 in a water solution, at least 90% of the internucleotidic linkage exists as its neutral form. In some embodiments, a modified internucleotidic linkage is a neutral internucleotidic linkage in that in a water solution of the oligonucleotide, at least 50%, 60%, 70%, 80%, 90%, 95%, or 99% of the internucleotidic linkage exists in its neutral form. In some embodiments, the percentage is at least 90%. In some embodiments, the percentage is at least 95%. In some embodiments, the percentage is at least 99%. In some embodiments, a non-negatively charged internucleotidic linkage, e.g., a neutral internucleotidic linkage, when in its neutral form has no moiety with a pKa that is less than 8, 9, 10, 11, 12, 13, or 14. In some embodiments, pKa of an internucleotidic linkage in the present disclosure can be represented by pKa of $CH_3$—the internucleotidic linkage—$CH_3$ (i.e., replacing the two nucleoside units connected by the internucleotidic linkage with two —$CH_3$ groups). Without wishing to be bound by any particular theory, in at least some cases, a neutral internucleotidic linkage in an oligonucleotide can provide improved properties and/or activities, e.g., improved delivery, improved resistance to exonucleases and endonucleases, improved cellular uptake, improved endosomal escape and/or improved nuclear uptake, etc., compared to a comparable nucleic acid which does not comprises a neutral internucleotidic linkage.

In some embodiments, a non-negatively charged internucleotidic linkage has the structure of e.g., of formula I-n-1, I-n-2, I-n-3, I-n-4, II, II-a-1, II-a-2, II-b-1, II-b-2, II-c-1, II-c-2, II-d-1, II-d-2, etc. In some embodiments, a non-negatively charged internucleotidic linkage comprises a triazole or alkyne moiety. In some embodiments, a non-negatively charged internucleotidic linkage comprises a guanidine moiety. In some embodiments, a non-negatively charged internucleotidic linkage comprises a cyclic guanidine moiety. In some embodiments, a modified internucleotidic linkage comprising a cyclic guanidine moiety has the structure of:

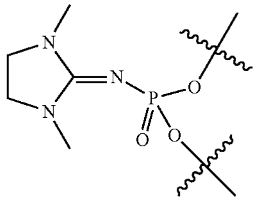
.

In some embodiments, a neutral internucleotidic linkage comprising a cyclic guanidine moiety is chirally controlled. In some embodiments, the present disclosure pertains to a composition comprising an oligonucleotide comprising at least one neutral internucleotidic linkage and at least one phosphorothioate internucleotidic linkage.

In some embodiments, a non-negatively charged internucleotidic linkage is n001, n002, n003, n004, n005, n006, n007, or n008. In some embodiments, a non-negatively charged internucleotidic linkage is chirally controlled, e.g., n001R, n002R, n003R, n004R, n005R, n006R, n007R, n008R, n009R, n001S, n002S, n003S, n004S, n005S, n006S, n007S, n008S, n009S, etc.

In some embodiments, the present disclosure pertains to a composition comprising an oligonucleotide comprising at least one neutral internucleotidic linkage and at least one phosphorothioate internucleotidic linkage, wherein the phosphorothioate internucleotidic linkage is a chirally controlled internucleotidic linkage in the Sp configuration.

In some embodiments, the present disclosure pertains to a composition comprising an oligonucleotide comprising at least one neutral internucleotidic linkage and at least one phosphorothioate internucleotidic linkage, wherein the phosphorothioate internucleotidic linkage is a chirally controlled internucleotidic linkage in the Rp configuration.

In some embodiments, the present disclosure pertains to a composition comprising an oligonucleotide comprising at least one neutral internucleotidic linkage selected from a neutral internucleotidic linkage comprising an optionally substituted triazolyl group, a neutral internucleotidic linkage comprising an optionally substituted alkynyl group, and a neutral internucleotidic linkage comprising a moiety

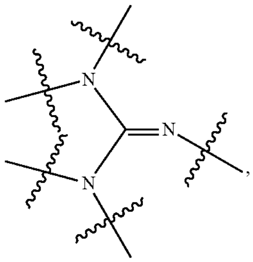 [SMILES: *N=C(N(*)*)N(*)*]
, and at least one phosphorothioate internucleotidic linkage. In some embodiments, the present disclosure pertains to a composition comprising an oligonucleotide comprising at least one neutral internucleotidic linkage selected from a neutral internucleotidic linkage comprising an optionally substituted triazolyl group, a neutral internucleotidic linkage comprising an optionally substituted alkynyl group, and a neutral internucleotidic linkage comprising a Tmg group (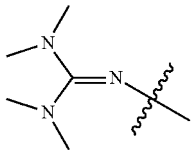), and at least one phosphorothioate internucleotidic linkage. In some embodiments, an oligonucleotide comprises at least one non-negatively charged internucleotidic linkage and at least one phosphorothioate internucleotidic linkage. In some embodiments, the non-negatively charged internucleotidic linkage is n001. In some embodiments, the non-negatively charged internucleotidic linkage and the phosphorothioate internucleotidic linkage are independently chirally controlled. In some embodiments, each of the non-negatively charged internucleotidic linkage and the phosphorothioate internucleotidic linkages are independently chirally controlled.

In some embodiments, the present disclosure pertains to a composition comprising an oligonucleotide comprising at least one neutral internucleotidic linkage selected from a neutral internucleotidic linkage comprising an optionally substituted triazolyl group, a neutral internucleotidic linkage comprising an optionally substituted alkynyl group, and a neutral internucleotidic linkage comprising a Tmg group, and at least one phosphorothioate, wherein the phosphorothioate is a chirally controlled internucleotidic linkage in the Sp configuration.

In some embodiments, the present disclosure pertains to a composition comprising an oligonucleotide comprising at least one neutral internucleotidic linkage selected from a neutral internucleotidic linkage comprising an optionally substituted triazolyl group, a neutral internucleotidic linkage comprising an optionally substituted alkynyl group, and a neutral internucleotidic linkage comprising a Tmg group, and at least one phosphorothioate, wherein the phosphorothioate is a chirally controlled internucleotidic linkage in the Rp configuration.

Various types of internucleotidic linkages differ in properties. Without wishing to be bound by any theory, the present disclosure notes that a natural phosphate linkage (phosphodiester internucleotidic linkage) is anionic and may be unstable when used by itself without other chemical modifications in vivo; a phosphorothioate internucleotidic linkage is anionic, generally more stable in vivo than a natural phosphate linkage, and generally more hydrophobic; a neutral internucleotidic linkage such as one exemplified in the present disclosure comprising a cyclic guanidine moiety is neutral at physiological pH, can be more stable in vivo than a natural phosphate linkage, and more hydrophobic.

In some embodiments, an internucleotidic linkage (e.g., a non-negatively charged internucleotidic linkage, a chirally controlled non-negatively charged internucleotidic linkage, etc.) is neutral at physiological pH, chirally controlled, stable in vivo, hydrophobic, and may increase endosomal escape.

In some embodiments, an oligonucleotide or oligonucleotide composition is: a DMD oligonucleotide or oligonucleotide composition; an oligonucleotide or oligonucleotide composition comprising a non-negatively charged internucleotidic linkage; or a DMD oligonucleotide comprising a non-negatively charged internucleotidic linkage.

In some embodiments, an oligonucleotide has, as non-limiting examples, a wing-core-wing, wing-core, core-wing, wing-wing-core-wing-wing, wing-wing-core-wing, or wing-core-wing-wing structure (in some embodiments, a wing-wing comprises or consists of a first wing and a second wing, wherein the first wing is different than the second wing, and the first and second wings are different than the core). A wing or core can be defined by any structural elements and/or patterns and/or combinations thereof. In some embodiments, a wing and core is defined by nucleoside modifications, sugar modifications, and/or internucleotidic linkages, wherein a wing comprises a nucleoside modification, sugar modification and/or internucleotidic linkage and/or pattern and/or combination thereof, that the core region does not have, or vice versa. In some embodiments, oligonucleotides of the present disclosure comprise or consist of a 5'-end region, a middle region, and a 3'-end region. In some embodiments, a 5'-end region is a 5'-wing region. In some embodiments, a 5'-wing region is a 5'-end region. In some embodiments, a 3'-end region is a 3'-wing region. In some embodiments, a 3'-wing region is a 3'-end region. In some embodiments, a core region is a middle region.

In some embodiments, each wing region (or each of the 5'-end and 3'-end regions) independently comprises one or more modified phosphate linkages and no natural phosphate linkages, and the core region (the middle region) comprises one or more modified internucleotidic linkages and one or more natural phosphate linkages. In some embodiments, each wing region (or each of the 5'-end and 3'-end regions) independently comprises one or more natural phosphate linkages and optionally one or more modified internucleotidic linkages, and the core (or the middle region) comprises one or more modified internucleotidic linkages and optionally one or more natural phosphate linkages. In some embodiments, a wing (or a 5'-end or 3'-end region) comprises modified sugar moieties. In some embodiments, a modified internucleotidic linkage is a phosphorothioate internucleotidic linkage.

Among other things, the present disclosure encompasses the recognition that stereorandom oligonucleotide preparations contain a plurality of distinct chemical entities that differ from one another, e.g., in the stereochemical structure of individual backbone chiral centers within the oligonucleotide chain. Without control of stereochemistry of backbone chiral centers, stereorandom oligonucleotide preparations provide uncontrolled (or stereorandom) compositions comprising undetermined levels of oligonucleotide stereoisomers. Even though these stereoisomers may have the same base sequence and/or chemical modifications, they are different chemical entities at least due to their different backbone stereochemistry, and they can have, as demonstrated herein, different properties, e.g., activities, toxicities, distribution etc. Among other things, the present disclosure provides chirally controlled compositions that are or contain particular stereoisomers of oligonucleotides of interest; in contrast to chirally uncontrolled compositions, chirally controlled compositions comprise controlled levels of particular stereoisomers of oligonucleotides. In some embodiments, a particular stereoisomer may be defined, for example, by its base sequence, its pattern of backbone linkages, its pattern of backbone chiral centers, and pattern of backbone phosphorus modifications, etc. As is understood in the art, in some embodiments, base sequence may refer solely to the sequence of bases and/or to the identity and/or modification status of nucleoside residues (e.g., of sugar and/or base components, relative to standard naturally occurring nucleotides such as adenine, cytosine, guanosine, thymine, and uracil) in an oligonucleotide and/or to the hybridization character (i.e., the ability to hybridize with particular complementary residues) of such residues. In some embodiments, the present disclosure demonstrates that property improvements (e.g., improved activities, lower toxicities, etc.) achieved through inclusion and/or location of particular chiral structures within an oligonucleotide can be comparable to, or even better than those achieved through use of chemical modifications, e.g., particular backbone linkages, residue modifications, etc. (e.g., through use of certain types of modified phosphates [e.g., phosphorothioate, substituted phosphorothioate, etc.], sugar modifications [e.g., 2'-modifications, etc.], and/or base modifications [e.g., methylation, etc.]). In some embodiments, the present disclosure demonstrates that chirally controlled oligonucleotide compositions of oligonucleotides comprising certain chemical modifications (e.g., 2'-F, 2'-OMe, phosphorothioate internucleotidic linkages, lipid conjugation, etc.) demonstrate unexpectedly high exon-skipping efficiency.

In some embodiments, provided oligonucleotides are blockmers. In some embodiments, a blockmer is an oligonucleotide comprising one or more blocks.

In some embodiments, a block is a portion of an oligonucleotide. In some embodiments, a block is a wing or a core. In some embodiments, a blockmer comprises one or more blocks. In some embodiments, a 5'-block is a 5'-end region or 5'-wing. In some embodiments, a 3'-block is a 3'-end region or 3'-wing.

In some embodiments, provided oligonucleotide are altmers. In some embodiments, provided oligonucleotides are altmers comprising alternating blocks. In some embodiments, a blockmer or an altmer can be defined by chemical modifications (including presence or absence), e.g., base modifications, sugar modification, internucleotidic linkage modifications, stereochemistry, etc.

In some embodiments, provided oligonucleotides comprise blocks comprising different internucleotidic linkages. In some embodiments, provided oligonucleotides comprise blocks comprising modified internucleotidic linkages and/or natural phosphate linkages.

In some embodiments, provided oligonucleotides comprise blocks comprising sugar modifications. In some embodiments, provided oligonucleotides comprise one or more blocks comprising one or more 2'-F modifications (2'-F blocks). In some embodiments, provided oligonucleotides comprise blocks comprising consecutive 2'-F modifications. In some embodiments, a block comprises 2, 3, 4, 5, 6, 7, 8, 9, 10, 11, 12, 13, 14, 15, 16, 17, 18, 19, 20 or more consecutive 2'-F modifications.

In some embodiments, provided oligonucleotides comprises one or more blocks comprising one or more 2'-OR$^1$ modifications (2'-OR$^1$ blocks), wherein R$^1$ is independently as defined and described herein and below. In some embodiments, provided oligonucleotides comprise both 2'-F and 2'-OR$^1$ blocks. In some embodiments, provided oligonucleotides comprise alternating 2'-F and 2'-OR$^1$ blocks. In some embodiments, provided oligonucleotides comprise a first 2'-F block at the 5'-end, and a second 2'-F block at the 3'-end, each of which independently comprises 2, 3, 4, 5, 6, 7, 8, 9, 10, 11, 12, 13, 14, 15, 16, 17, 18, 19, 20 or more consecutive 2'-F modifications.

In some embodiments, provided oligonucleotides comprise a 5'-block wherein each sugar moiety of the 5'-block comprises a 2'-F modification. In some embodiments, provided oligonucleotides comprise a 3'-block wherein each sugar moiety of the 3'-block comprises a 2'-F modification. In some embodiments, such provided oligonucleotides comprise one or more 2'-OR$^1$ blocks, and optionally one or more 2'-F blocks, between the 5' and 3' 2'-F blocks. In some embodiments, such provided oligonucleotides comprise one or more 2'-OR$^1$ blocks, and one or more 2'-F blocks, between the 5' and 3' 2'-F blocks (e.g., WV-3047, WV-3048, etc.).

In some embodiments, a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks.

In some embodiments, provided oligonucleotides comprise one or more PO blocks wherein each internucleotidic linkage in a natural phosphate linkage.

In some embodiments, a 5'-block is an Sp block wherein each sugar moiety comprises a 2'-F modification. In some embodiments, a 5'-block is an Sp block wherein each internucleotidic linkage is a modified internucleotidic linkage and each sugar moiety comprises a 2'-F modification. In some embodiments, a 5'-block is an Sp block wherein each internucleotidic linkage is a phosphorothioate linkage and each sugar moiety comprises a 2'-F modification. In some embodiments, a 5'-block comprises 4 or more nucleoside units.

In some embodiments, a 3'-block is an Sp block wherein each sugar moiety comprises a 2'-F modification. In some embodiments, a 3'-block is an Sp block wherein each internucleotidic linkage is a modified internucleotidic linkage and each sugar moiety comprises a 2'-F modification. In some embodiments, a 3'-block is an Sp block wherein each internucleotidic linkage is a phosphorothioate linkage and each sugar moiety comprises a 2'-F modification. In some embodiments, a 3'-block comprises 4 or more nucleoside units.

In some embodiments, provided oligonucleotides comprise alternating blocks comprising different modified sugar moieties and/or unmodified sugar moieties. In some embodiments, provided oligonucleotides comprise alternating blocks comprising different modified sugar moieties and unmodified sugar moieties. In some embodiments, provided oligonucleotides comprise alternating blocks comprising different modified sugar moieties. In some embodiments, provided oligonucleotides comprise alternating blocks comprising different modified sugar moieties, wherein the modified sugar moieties comprise different 2'-modifications. For example, in some embodiments, provided oligonucleotide comprises alternating blocks comprising 2'-OMe and 2'-F, respectively.

In some embodiments, the present disclosure provides an oligonucleotide composition comprising a plurality of oligonucleotides which:

1) have a common base sequence complementary to a target sequence in a transcript; and
2) comprise one or more modified sugar moieties and modified internucleotidic linkages.

In some embodiments, a provided oligonucleotide composition is characterized in that, when it is contacted with the transcript in a transcript splicing system, splicing of the transcript is altered relative to that observed under a reference condition selected from the group consisting of absence of the composition, presence of a reference composition, and combinations thereof.

In some embodiments, a reference condition is absence of the composition. In some embodiments, a reference condition is presence of a reference composition. Example reference compositions comprising a reference plurality of oligonucleotides are extensively described in this disclosure. In some embodiments, oligonucleotides of the reference plurality have a different structural elements (chemical modifications, stereochemistry, etc.) compared with oligonucleotides of the plurality in a provided composition. In some embodiments, a reference composition is a stereorandom preparation of oligonucleotides having the same chemical modifications. In some embodiments, a reference composition is a mixture of stereoisomers while a provided composition is a chirally controlled oligonucleotide composition of one stereoisomer. In some embodiments, oligonucleotides of the reference plurality have the same base sequence, same sugar modifications, same base modifications, same internucleotidic linkage modifications, and/or same stereochemistry as oligonucleotide of the plurality in a provided composition but different chemical modifications, e.g., base modification, sugar modification, internucleotidic linkage modifications, etc.

Example splicing systems are widely known in the art. In some embodiments, a splicing system is an in vivo or in vitro system including components sufficient to achieve splicing of a relevant target transcript. In some embodiments, a splicing system is or comprises a spliceosome (e.g., protein and/or RNA components thereof). In some embodiments, a splicing system is or comprises an organellar membrane (e.g., a nuclear membrane) and/or an organelle (e.g., a nucleus). In some embodiments, a splicing system is or comprises a cell or population thereof. In some embodiments, a splicing system is or comprises a tissue. In some embodiments, a splicing system is or comprises an organism, e.g., an animal, e.g., a mammal such as a mouse, rat, monkey, dog, human, etc.

In some embodiments, the present disclosure provides an oligonucleotide composition comprising a plurality of oligonucleotides which:

1) have a common base sequence complementary to a target sequence in a transcript; and
2) comprise one or more modified sugar moieties and modified internucleotidic linkages, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides an oligonucleotide composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications.

In some embodiments, the present disclosure provides an oligonucleotide composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled and it is enriched, relative to a substantially racemic preparation of oligonucleotides having the same base sequence, for oligonucleotides of the particular oligonucleotide type, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides a chirally controlled oligonucleotide composition comprising oligonucleotides of a particular oligonucleotide type characterized by:

1) base sequence;
2) pattern of backbone linkages;
3) pattern of backbone chiral centers; and
4) pattern of backbone phosphorus modifications, which composition is a substantially pure preparation of a single oligonucleotide in that at least about 10% of the oligonucleotides in the composition have the common base sequence and length, the common pattern of backbone linkages, and the common pattern of backbone chiral centers.

In some embodiments, each region (e.g., a block, wing, core, 5'-end, 3'-end, or middle region, etc.) of an oligonucleotide independently comprises 3, 4, 5, 6, 7, 8, 9, 10 or more bases. In some embodiments, each region independently comprises 3 or more bases. In some embodiments, each region independently comprises 4 or more bases. In some embodiments, each region independently comprises 5 or more bases. In some embodiments, each region independently comprises 6 or more bases. In some embodiments, each sugar moiety in a region is modified. In some embodiments, a modification is a 2'-modification. In some embodiments, each modification is a 2'-modification. In some embodiments, a modification is 2'-F. In some embodiments, each modification is 2'-F. In some embodiments, a modification is 2'-OR$^1$. In some embodiments, each modification is 2'-OR$^1$. In some embodiments, a modification is 2'-OR$^1$. In some embodiments, each modification is 2'-OMe. In some embodiments, each modification is 2'-OMe. In some embodiments, each modification is 2'-MOE. In some embodiments, each modification is 2'-MOE. In some embodiments, a modification is an LNA sugar modification. In some embodiments, each modification is an LNA sugar modification. In some embodiments, each internucleotidic linkage in a region is a chiral internucleotidic linkage. In some embodiments, each internucleotidic linkage in a wing, or 5'-end or 3'-end region, is an Sp chiral internucleotidic linkage. In some embodiments, a chiral internucleotidic linkage is a phosphorothioate linkage. In some embodiments, a core or middle region comprises one or more natural phosphate linkages and one or more modified internucleotidic linkages. In some embodiments, a core or middle region comprises one or more natural phosphate linkages and one or more chiral internucleotidic linkages. In some embodiments, a core region comprises one or more natural phosphate linkages and one or more Sp chiral internucleotidic linkages. In some embodiments, a core or middle region comprises one or more natural phosphate linkages and one or more Sp phosphorothioate linkages.

In some embodiments, a region (e.g., a block, wing, core, 5'-end, 3'-end, middle region, etc.) of an oligonucleotide comprises a non-negatively charged internucleotidic linkage, e.g., of formula I-n-1, I-n-2, I-n-3, I-n-4, II, II-a-1, II-a-2, II-b-1, II-b-2, II-c-1, II-c-2, II-d-1, II-d-2, etc. In some embodiments, a region comprises a neutral internucleotidic linkage. In some embodiments, a region comprises an internucleotidic linkage which comprises a triazole or alkyne moiety. In some embodiments, a region comprises an internucleotidic linkage which comprises a cyclic guanidine guanidine. In some embodiments, a region comprises an internucleotidic linkage which comprises a cyclic guanidine moiety. In some embodiments, a region comprises an internucleotidic linkage having the structure of

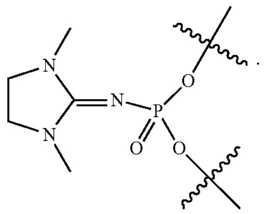

In some embodiments, such internucleotidic linkages are chirally controlled.

In some embodiments, the base sequence of an oligonucleotide, e.g., the base sequence of a plurality of oligonucleotides of a particular oligonucleotide type, is or comprises a base sequence disclosed herein (e.g., a base sequence of an example oligonucleotide (e.g., those listed in the tables, examples, etc.), a target sequence, etc.) (or a portion thereof which is at least 10, 11, 12, 13, 14, 15, 16, 17, 18, 19, 20, 21, 22, 23, 24, 25, 26, 27, 28, 29 or 30 bases long). In some embodiments, a provided oligonucleotide has a base sequence comprising the base sequence of any example oligonucleotides or another base sequence disclosed herein, and a length of up to 30 bases. In some embodiments, a provided oligonucleotide has a base sequence comprising the base sequence of any example oligonucleotides or another base sequence disclosed herein, and a length of up to 40 bases. In some embodiments, a provided oligonucleotide has a base sequence comprising the base sequence of any example oligonucleotides or another base sequence disclosed herein, and a length of up to 50 bases. In some embodiments, a provided oligonucleotide has a base sequence comprising at least 15 contiguous bases of the base sequence of an oligonucleotide example or another sequence disclosed herein, and a length of up to 30 bases. In some embodiments, a provided oligonucleotide has a base sequence comprising at least 15 contiguous bases of the base sequence of an oligonucleotide example or another sequence disclosed herein, and a length of up to 40 bases. In some embodiments, a provided oligonucleotide has a base sequence comprising at least 15 contiguous bases of the base sequence of an oligonucleotide example or another sequence disclosed herein, and a length of up to 50 bases. In some embodiments, a provided oligonucleotide has a base sequence comprising a sequence having no more than 5 mismatches from the base sequence of an example oligonucleotide or another sequence disclosed herein, and a length of up to 30 bases. In some embodiments, a provided oligonucleotide has a base sequence comprising a sequence having no more than 5 mismatches from the base sequence of an example oligonucleotide or another sequence disclosed herein, and a length of up to 40 bases. In some embodiments, a provided oligonucleotide has a base sequence comprising a sequence having no more than 5 mismatches from the base sequence of an example oligonucleotide or another sequence disclosed herein, and a length of up to 50 bases.

In some embodiments, the base sequence of a provided oligonucleotide is the base sequence of an example oligonucleotide or another sequence disclosed herein, and a pattern of backbone chiral centers comprises at least one chirally controlled center which is a Sp linkage phosphorus of a phosphorothioate linkage. In some embodiments, the base sequence of a provided oligonucleotide is the base sequence of an example oligonucleotide or another sequence disclosed herein, the oligonucleotide has a length of up to 30 bases, and a pattern of backbone chiral centers comprises at least one chirally controlled center which is a Sp linkage phosphorus of a phosphorothioate linkage. In some embodiments, the base sequence of a provided oligonucleotide is the base sequence of an example oligonucleotide or another sequence disclosed herein, the oligonucleotide has a length of up to 40 bases, and a pattern of backbone chiral centers comprises at least one chirally controlled center which is a Sp linkage phosphorus of a phosphorothioate linkage. In some embodiments, the base sequence of a provided oligonucleotide comprises at least 15 contiguous bases of any example oligonucleotides or another sequence disclosed herein, the oligonucleotide has a length of up to 30, 40, or 50 bases, and a pattern of backbone chiral centers comprises at least one chirally controlled center which is a Sp linkage phosphorus of a phosphorothioate linkage.

In some embodiments, a mismatch is a difference between the base sequence or length when two sequences are maximally aligned and compared. As a non-limiting example, a mismatch is counted if a difference exists between the base at a particular location in one sequence and the base at the corresponding position in another sequence. Thus, a mismatch is counted, for example, if a position in one sequence has a particular base (e.g., A), and the corresponding position on the other sequence has a different base (e.g., G, C or U). A mismatch is also counted, e.g., if a position in one sequence has a base (e.g., A), and the corresponding position on the other sequence has no base (e.g., that position is an abasic nucleotide which comprises a phosphate-sugar backbone but no base) or that position is skipped. A single-stranded nick in either sequence (or in the sense or antisense strand) may not be counted as mismatch, for example, no mismatch would be counted if one sequence comprises the sequence 5'-AG-3', but the other sequence comprises the sequence 5'-AG-3' with a single-stranded nick between the A and the G. A base modification is generally not considered a mismatch, for example, if one sequence comprises a C, and the other sequence comprises a modified C (e.g., with a 2'-modification) at the same position, no mismatch may be counted.

In some embodiments, oligonucleotides of a particular type are chemically identical in that they have the same base sequence (including length), the same pattern of chemical modifications to sugar and base moieties, the same pattern of backbone linkages (e.g., pattern of natural phosphate linkages, phosphorothioate linkages, phosphorothioate triester linkages, non-negatively charged linkages, and combinations thereof), the same pattern of backbone chiral centers (e.g., pattern of stereochemistry (Rp/Sp) of chiral internucleotidic linkages), and the same pattern of backbone phosphorus modifications (e.g., pattern of modifications on the internucleotidic phosphorus atom, such as —$S^-$, and -L-$R^1$ of formula I).

In some embodiments, the present disclosure provides chirally controlled oligonucleotide compositions of oligonucleotides comprising multiple (e.g., more than 5, 6, 7, 8, 9, or 10) internucleotidic linkages, and particularly for oligonucleotides comprising multiple (e.g., more than 5, 6, 7, 8, 9, or 10) chiral internucleotidic linkages, wherein the oligonucleotides comprise at least one, and in some embodiments, more than 5, 6, 7, 8, 9, or 10 chirally controlled internucleotidic linkages. In some embodiments, in a chirally controlled composition of oligonucleotides each chiral internucleotidic linkage of the oligonucleotides is independently a chirally controlled internucleotidic linkage. In some embodiments, in a stereorandom or racemic composition of oligonucleotides, each chiral internucleotidic linkage is formed with less than 90:10, 95:5, 96:4, 97:3, or 98:2 diastereoselectivity. In some embodiments, in a stereoselective or chirally controlled composition of oligonucleotides, each chirally controlled internucleotidic linkage of the oligonucleotides independently has a diastereopurity of at least 90%, 91%, 92%, 93%, 94%, 95%, 96%, 97%, 98%, or 99% at its chiral linkage phosphorus (either Rp or Sp). Among other things, the present disclosure provides technologies to prepare oligonucleotides of high diastereopurity. In some embodiments, diastereopurity of a chiral internucleotidic linkage in an oligonucleotide may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage.

As described herein, provided compositions and methods are capable of altering splicing of transcripts. In some embodiments, provided compositions and methods provide improved splicing patterns of transcripts compared to reference conditions selected from the group consisting of absence of the composition, presence of a reference composition, and combinations thereof. An improvement can be an improvement of any desired biological functions. In some embodiments, for example, in DMD, an improvement is production of an mRNA from which a dystrophin protein with improved biological activities is produced.

In some embodiments, the present disclosure provides a method for altering splicing of a target transcript, comprising administering a provided composition, wherein the splicing of the target transcript is altered relative to reference conditions selected from the group consisting of absence of the composition, presence of a reference composition, and combinations thereof.

In some embodiments, the present disclosure provides a method of generating a set of spliced products from a target transcript, the method comprising steps of:

contacting a splicing system containing the target transcript with an oligonucleotide composition comprising a plurality of oligonucleotides (e.g., a provided chirally controlled oligonucleotide composition), in an amount, for a time, and under conditions sufficient for a set of spliced products to be generated that is different from a set generated under reference conditions selected from the group consisting of absence of the composition, presence of a reference composition, and combinations thereof.

In some embodiments, the present disclosure provides a method for treating or preventing a disease, comprising administering to a subject an oligonucleotide composition described herein.

In some embodiments, the present disclosure provides a method for treating or preventing a disease, comprising administering to a subject an oligonucleotide composition comprising a plurality of oligonucleotides, which:

1) have a common base sequence complementary to a target sequence in a transcript; and
2) comprise one or more modified sugar moieties and modified internucleotidic linkages, the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, the present disclosure provides a method for treating or preventing a disease, comprising administering to a subject a chirally controlled oligonucleotide composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled and it is enriched, relative to a substantially racemic preparation of oligonucleotides having the same base sequence, for oligonucleotides of the particular oligonucleotide type, wherein:

the oligonucleotide composition being characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, a disease is one in which, after administering a provided composition, one or more spliced transcripts repair, restore or introduce a new beneficial function. For example, in DMD, after skipping one or more exons, functions of dystrophin can be restored, or partially restored, through a truncated but (at least partially) active version. In some embodiments, a disease is one in which, after administering a provided composition, one or more spliced transcripts repair, a gene is effectively knockdown by altering splicing of the gene transcript.

In some embodiments, a disease is muscular dystrophy, including but not limited to Duchenne (Duchenne's) muscular dystrophy (DMD) and Becker (Becker's) muscular dystrophy (BMD).

In some embodiments, a transcript is of Dystrophin gene or a variant thereof.

In some embodiments, the present disclosure provides a method of treating a disease by administering a composition comprising a plurality of oligonucleotides sharing a common base sequence comprising a nucleotide sequence, which nucleotide sequence is complementary to a target sequence in the target transcript, the improvement that comprises using as the oligonucleotide composition a chirally controlled oligonucleotide composition characterized in that, when it is contacted with the transcript in a transcript splicing system, splicing of the transcript is altered relative to that observed under reference conditions selected from the group consisting of absence of the composition, presence of a reference composition, and combinations thereof.

In some embodiments, a common sequence comprises a sequence (or at least 15 base long portion thereof) of any oligonucleotide in Table A1.

In some embodiments, the present disclosure provides a method of administering an oligonucleotide composition comprising a plurality of oligonucleotides having a common nucleotide sequence, the improvement that comprises:

administering an oligonucleotide composition comprising the plurality of oligonucleotides each of which independently comprises one or more negatively charged internucleotidic linkages and one or more non-negatively charged internucleotidic linkages, wherein the oligonucleotide composition is optionally chirally controlled.

In some embodiments, the present disclosure provides a method of administering an oligonucleotide composition comprising a plurality of oligonucleotides having a common nucleotide sequence, the improvement that comprises:

administering an oligonucleotide composition comprising the plurality of oligonucleotides that is chirally controlled and that is characterized by reduced toxicity relative to a reference oligonucleotide composition of the same common nucleotide sequence.

In some embodiments, the present disclosure provides a method of administering an oligonucleotide composition comprising a plurality of oligonucleotides having a common nucleotide sequence, the improvement that comprises:

administering an oligonucleotide composition in which each oligonucleotide in the plurality includes one or more natural phosphate linkages and one or more modified phosphate linkages;

wherein the oligonucleotide composition is characterized by reduced toxicity when tested in at least one assay that is observed with an otherwise comparable reference composition whose oligonucleotides do not comprise natural phosphate linkages.

In some embodiments, oligonucleotides can elicit proinflammatory responses. In some embodiments, the present disclosure provides compositions and methods for reducing inflammation. In some embodiments, the present disclosure provides compositions and methods for reducing proinflammatory responses. In some embodiments, the present disclosure provides methods for reducing injection site inflammation using provided compositions. In some embodiments, the present disclosure provides methods for reducing drug-induced vascular injury using provided compositions.

In some embodiments, the present disclosure provides a method, comprising administering a composition comprising a plurality of oligonucleotides of a common base sequence, which composition displays reduced injection site inflammation as compared with a reference composition comprising a plurality of oligonucleotides, each of which also has the common base sequence, but which differs structurally from the oligonucleotides of the plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method, comprising administering a composition comprising a plurality of oligonucleotides of a common base sequence, which composition displays altered protein binding as compared with a reference composition comprising a plurality of oligonucleotides, each of which also has the common base sequence but which differs structurally from the oligonucleotides of the plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method of administering an oligonucleotide composition comprising a plurality of oligonucleotides having a common nucleotide sequence, the improvement that comprises:

administering an oligonucleotide composition comprising a plurality of oligonucleotides that is characterized by altered protein binding relative to a reference oligonucleotide composition of the same common nucleotide sequence.

In some embodiments, the present disclosure provides a method comprising administering a composition comprising a plurality of oligonucleotides of a common base sequence, which composition displays improved delivery as compared with a reference composition comprising a reference plurality of oligonucleotides, each of which also has the common base sequence but which differs structurally from the oligonucleotides of the plurality in that:

individual oligonucleotides within the reference plurality differ from one another in stereochemical structure; and/or at least some oligonucleotides within the reference plurality have a structure different from a structure represented by the plurality of oligonucleotides of the composition; and/or at least some oligonucleotides within the reference plurality do not comprise a wing region and a core region.

In some embodiments, the present disclosure provides a method of administering an oligonucleotide composition comprising a plurality of oligonucleotides having a common nucleotide sequence, the improvement that comprises:

administering an oligonucleotide comprising a plurality of oligonucleotides that is characterized by improved delivery relative to a reference oligonucleotide composition of the same common nucleotide sequence.

In some embodiments, the present disclosure provides a composition comprising any oligonucleotide disclosed herein. In some embodiments, the present disclosure provides a composition comprising any chirally controlled oligonucleotide disclosed herein.

In some embodiments, the present disclosure provides a composition comprising an oligonucleotide disclosed herein which is capable of mediating skipping of Dystrophin exon 45. In some embodiments, the present disclosure provides a composition comprising an oligonucleotide disclosed herein which is capable of mediating skipping of Dystrophin exon 51. In some embodiments, the present disclosure provides a composition comprising an oligonucleotide disclosed herein which is capable of mediating skipping of Dystrophin exon 53. In some embodiments, the present disclosure provides a composition comprising an oligonucleotide(s) disclosed herein which is capable of mediating skipping of multiple Dystrophin exons. In some embodiments, such a composition is a chirally controlled oligonucleotide composition.

In some embodiments, the present disclosure pertains to an oligonucleotide or an oligonucleotide composition capable of mediating skipping of a DMD exon or multiple DMD exons. In some embodiments, a DMD exon is exon 51. In some embodiments, a DMD exon is exon 53. In some embodiments, a DMD exon is exon 45. In some embodiments, the present disclosure pertains to an oligonucleotide composition capable of mediating skipping of a DMD exon 53, wherein the oligonucleotide composition comprises at least one chirally controlled internucleotidic linkage.

In some embodiments, the present disclosure pertains to a chirally controlled oligonucleotide composition, wherein the oligonucleotide is capable of mediating skipping of DMD exon 45. In some embodiments, the present disclosure pertains to an oligonucleotide composition capable of mediating skipping of DMD exon 45, wherein the oligonucleotide composition comprises at least one chirally controlled internucleotidic linkage and comprises at least one non-negatively charged internucleotidic linkage. In some embodiments, the present disclosure pertains to a chirally controlled oligonucleotide composition, wherein the oligonucleotide is capable of mediating skipping of DMD exon 45 and comprises at least one non-negatively charged internucleotidic linkage.

In some embodiments, the present disclosure pertains to an oligonucleotide composition capable of mediating skipping of DMD exon 45, wherein the oligonucleotide composition comprises at least one non-negatively charged internucleotidic linkage. In some embodiments, the present disclosure pertains to a chirally controlled oligonucleotide composition, wherein the oligonucleotide is capable of mediating skipping of DMD exon 45 and comprises at least one non-negatively charged internucleotidic linkage.

In some embodiments, the present disclosure pertains to a chirally controlled oligonucleotide composition, wherein the oligonucleotide is capable of mediating skipping of DMD exon 51. In some embodiments, the present disclosure pertains to an oligonucleotide composition capable of mediating skipping of DMD exon 51, wherein the oligonucleotide composition comprises at least one chirally controlled internucleotidic linkage and comprises at least one non-negatively charged internucleotidic linkage. In some embodiments, the present disclosure pertains to a chirally controlled oligonucleotide composition, wherein the oligonucleotide is capable of mediating skipping of DMD exon 51 and comprises at least one non-negatively charged internucleotidic linkage.

In some embodiments, the present disclosure pertains to an oligonucleotide composition capable of mediating skipping of DMD exon 51, wherein the oligonucleotide composition comprises at least one non-negatively charged internucleotidic linkage. In some embodiments, the present disclosure pertains to a chirally controlled oligonucleotide composition, wherein the oligonucleotide is capable of mediating skipping of DMD exon 51 and comprises at least one non-negatively charged internucleotidic linkage.

In some embodiments, the present disclosure pertains to a chirally controlled oligonucleotide composition, wherein the oligonucleotide is capable of mediating skipping of DMD exon 53. In some embodiments, the present disclosure pertains to an oligonucleotide composition capable of mediating skipping of DMD exon 53, wherein the oligonucleotide composition comprises at least one chirally controlled internucleotidic linkage and comprises at least one non-negatively charged internucleotidic linkage. In some embodiments, the present disclosure pertains to a chirally controlled oligonucleotide composition, wherein the oligonucleotide is capable of mediating skipping of DMD exon 53 and comprises at least one non-negatively charged internucleotidic linkage.

In some embodiments, the present disclosure pertains to an oligonucleotide composition capable of mediating skipping of DMD exon 53, wherein the oligonucleotide composition comprises at least one non-negatively charged internucleotidic linkage. In some embodiments, the present disclosure pertains to a chirally controlled oligonucleotide composition, wherein the oligonucleotide is capable of mediating skipping of DMD exon 53 and comprises at least one non-negatively charged internucleotidic linkage.

In some embodiments, the present disclosure pertains to a chirally controlled oligonucleotide composition, wherein the oligonucleotide is capable of mediating skipping of multiple DMD exons. In some embodiments, the present disclosure pertains to an oligonucleotide composition capable of mediating skipping of multiple DMD exons, wherein the oligonucleotide composition comprises at least one chirally controlled internucleotidic linkage and comprises at least one non-negatively charged internucleotidic linkage. In some embodiments, the present disclosure pertains to a chirally controlled oligonucleotide composition, wherein the oligonucleotide is capable of mediating skipping of multiple DMD exons and comprises at least one non-negatively charged internucleotidic linkage.

In some embodiments, the present disclosure pertains to an oligonucleotide composition capable of mediating skipping of a DMD exon, wherein the oligonucleotide composition comprises at least one non-negatively charged internucleotidic linkage. In some embodiments, the present disclosure pertains to a chirally controlled oligonucleotide composition, wherein the oligonucleotide is capable of mediating skipping of a DMD exon and comprises at least one non-negatively charged internucleotidic linkage. In some embodiments, the present disclosure pertains to a chirally controlled oligonucleotide composition, wherein the oligonucleotide is capable of mediating skipping of multiple DMD exons. In some embodiments, the present disclosure pertains to an oligonucleotide composition capable of mediating skipping of multiple DMD exons, wherein the oligonucleotide composition comprises at least one chirally controlled internucleotidic linkage and comprises at least one non-negatively charged internucleotidic linkage. In some embodiments, the present disclosure pertains to a chirally controlled oligonucleotide composition, wherein the oligonucleotide is capable of mediating skipping of multiple DMD exons and comprises at least one non-negatively charged internucleotidic linkage. In some embodiments, a DMD exon is any DMD exon disclosed herein, including but not limited to exon 45, exon 51, exon 52, exon 53, exon 55, exon 56, and exon 57.

In some embodiments, the present disclosure pertains to an oligonucleotide composition capable of mediating skipping of multiple DMD exons, wherein the oligonucleotide composition comprises at least one non-negatively charged internucleotidic linkage. In some embodiments, the present disclosure pertains to a chirally controlled oligonucleotide composition, wherein the oligonucleotide is capable of mediating skipping of multiple DMD exons and comprises at least one non-negatively charged internucleotidic linkage.

In some embodiments, the present disclosure provides a chirally controlled composition of an oligonucleotide capable of mediating skipping of Dystrophin exon 51. In some embodiments, the present disclosure provides a chirally controlled composition of an oligonucleotide capable of mediating skipping of Dystrophin exon 51 and disclosed herein.

In some embodiments, the present disclosure provides a composition of an oligonucleotide having a base sequence which is, comprises, or comprises a 15-base portion of the base sequence of UCAAGGAAGAUGGCAUUUCU (SEQ ID NO: 1), wherein each U can be optionally and independently replaced by T, and wherein the composition is optionally chirally controlled. In some embodiments, the present disclosure provides a composition of an oligonucleotide having a base sequence which is UCAAGGAAGAUGGCAUUUCU (SEQ ID NO: 1), wherein each U can be optionally and independently replaced by T, and wherein the composition is optionally chirally controlled. In some embodiments, the present disclosure provides a composition of an oligonucleotide having a base sequence which comprises UCAAGGAAGAUGGCAUUUCU (SEQ ID NO: 1), wherein each U can be optionally and independently replaced by T, and wherein the composition is optionally chirally controlled. In some embodiments, the present disclosure provides a composition of an oligonucleotide having a base sequence which comprises a 15-base portion of the base sequence of UCAAGGAAGAUGGCAUUUCU (SEQ ID NO: 1), wherein each U can be optionally and independently replaced by T, and wherein the composition is optionally chirally controlled. In some embodiments, the present disclosure provides a composition of an oligonucleotide having a base sequence which is, comprises, or comprises a 15-base portion of any of: UCAAGGAAGAUGGCAUUUCU (SEQ ID NO: 1), UCAAGGAAGAUGGCAUUUC(SEQ ID NO: 2), UCAAGGAAGAUGGCAUUU (SEQ ID NO: 3), UCAAGGAAGAUGGCAUU (SEQ ID NO: 4), UCAAGGAAGAUGGCAU (SEQ ID NO: 5), UCAAGGAAGAUGGCA (SEQ ID NO: 6), CAAGGAAGAUGGCAUUUCU (SEQ ID NO: 7), AAGGAAGAUGGCAUUUCU (SEQ ID NO: 8), AGGAAGAUGGCAUUUCU (SEQ ID NO: 9), GGAAGAUGGCAUUUCU (SEQ ID NO: 10), GAAGAUGGCAUUUCU (SEQ ID NO: 11), CAAGGAAGAUGGCAUUUC(SEQ ID NO: 12), CAAGGAAGAUGGCAUUU (SEQ ID NO: 13), AAGGAAGAUGGCAUUUC(SEQ ID NO: 14), AAGGAAGAUGGCAUUU (SEQ ID NO: 15), AGGAAGAUGGCAUUU (SEQ ID NO: 16), or AAGGAAGAUGGCAUU (SEQ ID NO: 17), wherein each U can be optionally and independently replaced by T, and wherein the composition is optionally chirally controlled.

In some embodiments, the present disclosure provides a chirally controlled composition of an oligonucleotide capable of mediating skipping of Dystrophin exon 53. In some embodiments, the present disclosure provides a chirally controlled composition of an oligonucleotide capable of mediating skipping of Dystrophin exon 53 and disclosed herein.

In some embodiments, the present disclosure provides a chirally controlled composition of oligonucleotide WV-9517. In some embodiments, the present disclosure provides a chirally controlled composition of oligonucleotide WV-9519. In some embodiments, the present disclosure provides a chirally controlled composition of oligonucleotide WV-9521. In some embodiments, the present disclosure provides a chirally controlled composition of oligonucleotide WV-9524. In some embodiments, the present disclosure provides a chirally controlled composition of oligonucleotide WV-9714. In some embodiments, the present disclosure provides a chirally controlled composition of oligonucleotide WV-9715. In some embodiments, the present disclosure provides a chirally controlled composition of oligonucleotide WV-9747. In some embodiments, the present disclosure provides a chirally controlled composition of oligonucleotide WV-9748. In some embodiments, the present disclosure provides a chirally controlled composition of oligonucleotide WV-9749. In some embodiments, the present disclosure provides a chirally controlled composition of oligonucleotide WV-9897. In some embodiments, the present disclosure provides a chirally controlled composition of oligonucleotide WV-9898. In some embodiments, the present disclosure provides a chirally controlled composition of oligonucleotide WV-9899. In some embodiments, the present disclosure provides a chirally controlled composition of oligonucleotide WV-9900. In some embodiments, the present disclosure provides a chirally controlled composition of oligonucleotide WV-9906. In some embodiments, the present disclosure provides a chirally controlled composition of oligonucleotide WV-9912. In some embodiments, the present disclosure provides a chirally controlled composition of oligonucleotide WV-10670. In some embodiments, the present disclosure provides a chirally controlled composition of oligonucleotide WV-10671. In some embodiments, the present disclosure provides a chirally controlled composition of oligonucleotide WV-10672.

In some embodiments, the present disclosure provides a composition of an oligonucleotide having a base sequence which is, comprises, or comprises a 15-base portion of the base sequence of CUCCGGUUCUGAAGGUGUUC(SEQ ID NO: 18), wherein each U can be optionally and independently replaced by T, and wherein the composition is optionally chirally controlled. In some embodiments, the present disclosure provides a composition of an oligonucleotide having a base sequence which is CUCCGGUUCUGAAGGUGUUC(SEQ ID NO: 18), wherein each U can be optionally and independently replaced by T, and wherein the composition is optionally chirally controlled. In some embodiments, the present disclosure provides a composition of an oligonucleotide having a base sequence which comprises CUCCGGUUCUGAAGGUGUUC(SEQ ID NO: 18), wherein each U can be optionally and independently replaced by T, and wherein the composition is optionally chirally controlled. In some embodiments, the present disclosure provides a composition of an oligonucleotide having a base sequence which is, comprises, or comprises a 15-base portion of CUCCGGUUCUGAAGGUGUUC(SEQ ID NO:

18), wherein each U can be optionally and independently replaced by T, and wherein the composition is optionally chirally controlled. In some embodiments, the present disclosure provides a composition of an oligonucleotide having a base sequence which is or comprises CUCCGGUUCUGAAGGUGUUCC(SEQ ID NO: 19), UCCGGUUCUGAAGGUGUUC(SEQ ID NO: 20), UCCGGUUCUGAAGGUGUUC(SEQ ID NO: 20), CCGGUUCUGAAGGUGUUC(SEQ ID NO: 21), CGGUUCUGAAGGUGUUC(SEQ ID NO: 22), GGUUCUGAAGGUGUUC(SEQ ID NO: 23), GUUCUGAAGGUGUUC(SEQ ID NO: 24), CUCCGGUUCUGAAGGUGUU (SEQ ID NO: 25), CUCCGGUUCUGAAGGUGU (SEQ ID NO: 26), CUCCGGUUCUGAAGGUG (SEQ ID NO: 27), CUCCGGUUCUGAAGGU (SEQ ID NO: 28), CUCCGGUUCUGAAGG (SEQ ID NO: 29), UCCGGUUCUGAAGGUGUU (SEQ ID NO: 30), CCGGUUCUGAAGGUGUU (SEQ ID NO: 31), UCCGGUUCUGAAGGUGU (SEQ ID NO: 32), CCGGUUCUGAAGGUGU (SEQ ID NO: 33), UCCGGUUCUGAAGGUG (SEQ ID NO: 34), CGGUUCUGAAGGUGU (SEQ ID NO: 35), UCCGGUUCUGAAGGU (SEQ ID NO: 36), CCGGUUCUGAAGGUG (SEQ ID NO: 37), CGGUUCUGAAGGUGUU (SEQ ID NO: 38), UCCGGUUCUGAAGGUGUUC(SEQ ID NO: 20), UCCGGUUCUGAAGGUG (SEQ ID NO: 34), UCCGGUUCUGAAGGU (SEQ ID NO: 36), CGGUUCUGAAGGUGUU (SEQ ID NO: 38), GGUUCUGAAGGUGUU (SEQ ID NO: 39), or GGUUCUGAAGGUGUU (SEQ ID NO: 39), wherein each U can be optionally and independently replaced by T, and wherein the composition is optionally chirally controlled. In some embodiments, the present disclosure provides a composition of an oligonucleotide having a base sequence which is, comprises, or comprises a 15-base portion of the base sequence of UUCUGAAGGUGUUCUUGUAC(SEQ ID NO: 40), wherein each U can be optionally and independently replaced by T, and wherein the composition is optionally chirally controlled. In some embodiments, the present disclosure provides a composition of an oligonucleotide having a base sequence which is UUCUGAAGGUGUUCUUGUAC(SEQ ID NO: 40), wherein each U can be optionally and independently replaced by T, and wherein the composition is optionally chirally controlled. In some embodiments, the present disclosure provides a composition of an oligonucleotide having a base sequence which comprises UUCUGAAGGUGUUCUUGUAC(SEQ ID NO: 40), wherein each U can be optionally and independently replaced by T, and wherein the composition is optionally chirally controlled. In some embodiments, the present disclosure provides a composition of an oligonucleotide having a base sequence which comprises a 15-base portion of the base sequence of UUCUGAAGGUGUUCUUGUAC(SEQ ID NO: 40), wherein each U can be optionally and independently replaced by T, and wherein the composition is optionally chirally controlled. In some embodiments, the present disclosure provides a composition of an oligonucleotide having a base sequence which is or comprises UUCUGAAGGUGUUCUUGUAC(SEQ ID NO: 40), UCUGAAGGUGUUCUUGUAC(SEQ ID NO: 41), CUGAAGGUGUUCUUGUAC(SEQ ID NO: 42), UGAAGGUGUUCUUGUAC(SEQ ID NO: 43), GAAGGUGUUCUUGUAC(SEQ ID NO: 44), AAGGUGUUCUUGUAC(SEQ ID NO: 45), UUCUGAAGGUGUUCUUGUA (SEQ ID NO: 46), UUCUGAAGGUGUUCUUGU (SEQ ID NO: 47), UUCUGAAGGUGUUCUUG (SEQ ID NO: 48), UUCUGAAGGUGUUCUU (SEQ ID NO: 49), UUCUGAAGGUGUUCU (SEQ ID NO: 50), UCUGAAGGUGUUCUUGUA (SEQ ID NO: 51), UCUGAAGGUGUUCUUGU (SEQ ID NO: 52), UCUGAAGGUGUUCUUG (SEQ ID NO: 53), UCUGAAGGUGUUCUU (SEQ ID NO: 54), CUGAAGGUGUUCUUGUA (SEQ ID NO: 55), CUGAAGGUGUUCUUGU (SEQ ID NO: 56), CUGAAGGUGUUCUUG (SEQ ID NO: 57), UGAAGGUGUUCUUGU (SEQ ID NO: 58), or UGAAGGUGUUCUUGUA (SEQ ID NO: 59), wherein each U can be optionally and independently replaced by T, and wherein the composition is optionally chirally controlled.

In some embodiments, the present disclosure provides a chirally controlled oligonucleotide composition of an oligonucleotide selected from any of the Tables. In some embodiments, the present disclosure provides a chirally controlled oligonucleotide composition of an oligonucleotide selected from any of the Tables, wherein the oligonucleotide is conjugated to a lipid or a targeting moiety.

In some embodiments, an oligonucleotide is at least 10, 11, 12, 13, 14, 15, 16, 17, 18, 19, 20 bases long, and optionally no more than 25, 30, 35, 40, 45, 50, 55, or 60 bases long. In some embodiments, an oligonucleotide is no more than 25 bases long. In some embodiments, an oligonucleotide is no more than 30 bases long. In some embodiments, an oligonucleotide is no more than 35 bases long. In some embodiments, an oligonucleotide is no more than 40 bases long. In some embodiments, an oligonucleotide is no more than 45 bases long. In some embodiments, an oligonucleotide is no more than 50 bases long. In some embodiments, an oligonucleotide is no more than 55 bases long. In some embodiments, an oligonucleotide is no more than 60 bases long. In some embodiments, each base is independently optionally substituted A, T, C, G, or U, or an optionally substituted tautomer of A, T, C, G, or U In some embodiments, provided oligonucleotides comprise additional chemical moieties besides their oligonucleotide chains (oligonucleotide backbones and bases), e.g., lipid moieties, targeting moieties, etc. In some embodiments, a lipid is a fatty acid. In some embodiments, an oligonucleotide is conjugated to a fatty acid. In some embodiments, a fatty acid comprises 10, 11, 12, 13, 14, 15, 16, 17, 18, 19, 20, 21, 22, 23, 24, 25, 26, 27, 28, 29, 30 or more carbon atoms.

In some embodiments, a lipid is stearic acid or turbinaric acid. In some embodiments, a lipid is stearic acid acid. In some embodiments, a lipid is turbinaric acid.

In some embodiments, a lipid comprises an optionally substituted, $C_{10}$-$C_{80}$, $C_{10}$-$C_{60}$, or $C_{10}$-$C_{40}$ saturated or partially unsaturated aliphatic group, wherein one or more methylene units are optionally and independently replaced by $C_1$-$C_6$ alkylene, $C_1$-$C_6$ alkenylene, —C≡C—, a $C_1$-$C_6$ heteroaliphatic moiety, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

In some embodiments, a lipid is selected from the group consisting of: lauric acid, myristic acid, palmitic acid, stearic acid, oleic acid, linoleic acid, alpha-linolenic acid, gamma-linolenic acid, docosahexaenoic acid (DHA or cis-DHA), turbinaric acid and dilinoleyl.

In some embodiments, a lipid is conjugated to an oligonucleotide chain, optionally through one or more linker moieties. In some embodiments, a lipid is not conjugated to an oligonucleotide chain.

In some embodiments, a provided oligonucleotide is conjugated, optionally through a linker, to a chemical moiety, e.g., a lipid moiety, a peptide moiety, a targeting moiety, a carbohydrate moiety, a sulfonamide moiety, an antibody or a fragment thereof. In some embodiments, a provided compound, e.g., an oligonucleotide, has the structure of:

$A^c$-[-$L^{LD}$-$(R^{LD})_a$]$_b$,$A^c$-[-$L^M$-$(R^D)_a$]$_b$,[$(A^c)_a$-$L^M$]$_b$-$R^D$, $(A^c)_a$-$L^M$-$(A^c)_b$, or$(A^c)_a$-$L^M$-$(R^D)_b$, or a slat thereof, wherein:

$A^c$ is an oligonucleotide chain (e.g., H-$A^c$, $[H]_a$-$A^c$ or $[H]_b$-$A^c$ is an oligonucleotide);

a is 1-1000;

b is 1-1000;

each of $L^{LD}$ and $L^M$ is independently a linker moiety;

$R^{LD}$ is a lipid moiety; and each $R^D$ is independently a lipid moiety or a targeting moiety.

In some embodiments, a provided compound, e.g., an oligonucleotide, has the structure of:

$A^c$-[-$L^{LD}$-$(R^{LD})_a$]$_b$,$A^c$-[-$L^M$-$(R^D)_a$]$_b$,[$(A^c)_a$-$L^M$]$_b$-$R^D$, $(A^c)_a$-$L^M$-$(A^c)_b$, or$(A^c)_a$-$L^M(R^D)_6$, or a salt thereof, wherein:

$A^c$ is an oligonucleotide chain (e.g., H-$A^c$, $[H]_a$-$A^c$ or $[H]_b$-$A^c$ is an oligonucleotide);

a is 1-1000;

b is 1-1000;

each $R^D$ is independently $R^{LD}$, $R^{CD}$ or $R^{TD}$;

$R^{CD}$ is an optionally substituted, linear or branched group selected from a $C_{1-100}$ aliphatic group and a $C_{1-100}$ heteroaliphatic group having 1-30 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more CH or carbon atoms are optionally and independently replaced with $Cy^L$;

$R^{LD}$ is an optionally substituted, linear or branched $C_{1-100}$ aliphatic group wherein one or more methylene units are optionally and independently replaced with $C_{1-6}$ alkylene, $C_{1-6}$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more CH or carbon atoms are optionally and independently replaced with $Cy^L$;

$R^{TD}$ is a targeting moiety;

each of $L^{LD}$ and $L^M$ is independently a covalent bond, or a bivalent or multivalent, optionally substituted, linear or branched group selected from a $C_{1-100}$ aliphatic group and a $C_{1-100}$ heteroaliphatic group having 1-30 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each R' is independently —R, —C(O)R, —C(O)OR, or —S(O)$_2$R; and each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or two or more R groups on the same atom are optionally and independently taken together with the atom to form an optionally substituted, 3-30 membered monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms.

In some embodiments, the present disclosure provides an oligonucleotide composition comprising a plurality of oligonucleotides each having the structure of:

$A^c$-[-$L^{LD}$-$(R^{LD})_a$]$_b$,$A^c$-[-$L^M$-$(R^D)_a$]$_b$,[$(A^c)_a$-$L^M$]$_b$-$R^D$, $(A^c)_a$-$L^M$-$(A^c)_b$, or$(A^c)_a$-$L^M(R^D)_6$, or a salt thereof.

In some embodiments, $[H]_b$-$A^c$ (wherein b is 1-1000) is an oligonucleotide of any one of the Tables. In some embodiments, $[H]_b$-$A^c$ is an oligonucleotide of Table A1.

In some embodiments, a is 1-100. In some embodiments, a is 1-50. In some embodiments, a is 1-40. In some embodiments, a is 1-30. In some embodiments, a is 1-20. In some embodiments, a is 1-15. In some embodiments, a is 1-10. In some embodiments, a is 1-9. In some embodiments, a is 1-8. In some embodiments, a is 1-7. In some embodiments, a is 1-6. In some embodiments, a is 1-5. In some embodiments, a is 1-4. In some embodiments, a is 1-3. In some embodiments, a is 1-2. In some embodiments, a is 1. In some embodiments, a is 2. In some embodiments, a is 3. In some embodiments, a is 4. In some embodiments, a is 5. In some embodiments, a is 6. In some embodiments, a is 7. In some embodiments, a is 8. In some embodiments, a is 9. In some embodiments, a is 10. In some embodiments, a is more than 10. In some embodiments, b is 1-100. In some embodiments, b is 1-50. In some embodiments, b is 1-40. In some embodiments, b is 1-30. In some embodiments, b is 1-20. In some embodiments, b is 1-15. In some embodiments, b is 1-10. In some embodiments, b is 1-9. In some embodiments, b is 1-8. In some embodiments, b is 1-7. In some embodiments, b is 1-6. In some embodiments, b is 1-5. In some embodiments, b is 1-4. In some embodiments, b is 1-3. In some embodiments, b is 1-2. In some embodiments, b is 1. In some embodiments, b is 2. In some embodiments, b is 3. In some embodiments, b is 4. In some embodiments, b is 5. In some embodiments, b is 6. In some embodiments, b is 7. In some embodiments, b is 8. In some embodiments, b is 9. In some embodiments, b is 10. In some embodiments, b is more than 10. In some embodiments, an oligonucleotide has the structure of $A^c$-$L^{LD}$-$R^{LD}$. In some embodiments, AG is conjugated through one or more of its sugar, base and/or internucleotidic linkage moieties. In some embodiments, $A^c$ is conjugated through its 5'-OH (5'-O—). In some embodiments, $A^c$ is conjugated through its 3'-OH (3'-O—). In some embodiments, before conjugation, $A^c$-$(H)_b$ (b is an integer of 1-1000 depending on valency of $A^c$) is an oligonucleotide as described herein, for example, one of those described in any one of the Tables. In some embodiments, $L^M$ is -L-. In some embodiments, $L^M$ comprises a phosphorothioate group. In some embodiments, $L^M$ is —C(O)NH—$(CH_2)_6$—OP(═O)(S)—O—. In some embodiments, the —C(O)NH end is connected to $R^{LD}$, and the —O— end is connected to the oligonucleotide, e.g., through 5'- or 3'-end. In some embodiments, RED is optionally substituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, RID is optionally substituted $C_{10-80}$ aliphatic. In some embodiments, $R^{LD}$ is optionally substituted $C_{20-80}$ aliphatic. In some embodiments, $R^{LD}$ is optionally substituted $C_{10-70}$ aliphatic. In some embodiments, $R^{LD}$ is optionally substituted $C_{20-70}$ aliphatic. In some embodiments, $R^{LD}$ is optionally substituted $C_{10-60}$ aliphatic. In some embodiments, $R^{LD}$ is optionally substituted $C_{20-60}$ aliphatic. In some embodiments, $R^{LD}$ is optionally substituted $C_{10-50}$ aliphatic. In some embodiments, $R^{LD}$ is optionally substituted $C_{20-50}$ aliphatic. In some embodiments, $R^{LD}$ is optionally substituted $C_{10-40}$ aliphatic. In some embodiments, $R^{LD}$ is optionally substituted $C_{20-40}$ aliphatic. In some embodiments, $R^{LD}$ is optionally substituted $C_{10-30}$ aliphatic. In some embodiments, $R^{LD}$ is optionally substituted $C_{20-30}$ aliphatic. In some embodiments, $R^{LD}$ is unsubstituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, $R^{LD}$ is unsubstituted $C_{10-80}$ aliphatic. In some embodiments, $R^{LD}$ is unsubstituted $C_{20-80}$ aliphatic. In some embodiments, $R^{LD}$ is unsubstituted $C_{10-70}$ aliphatic. In some embodiments, $R^{LD}$ is unsubstituted $C_{20-70}$ aliphatic. In some embodiments, $R^{LD}$ is unsubstituted $C_{10-60}$ aliphatic. In some embodiments, $R^{LD}$ is unsubstituted $C_{20-60}$ aliphatic. In some embodiments, $R^{LD}$ is unsubstituted $C_{10-50}$ aliphatic. In some embodiments, $R^{LD}$ is unsubstituted $C_{20-50}$ aliphatic. In some embodiments, $R^{LD}$ is unsubstituted $C_{10-40}$ aliphatic. In some embodiments, $R^{LD}$ is unsubstituted $C_{20-40}$ aliphatic. In some embodiments, $R^{LD}$ is unsubstituted $C_{10-30}$ aliphatic. In some embodiments, $R^{LD}$ is unsubstituted $C_{20-30}$ aliphatic.

In some embodiments, incorporation of a lipid moiety into an oligonucleotide improves at least one property of the oligonucleotide compared to an otherwise identical oligonucleotide without the lipid moiety. In some embodiments, improved properties include increased activity (e.g., increased ability to induce desirable skipping of a deleterious exon), decreased toxicity, and/or improved distribution to a tissue. In some embodiments, a tissue is muscle tissue. In some embodiments, a tissue is skeletal muscle, gastrocnemius, triceps, heart or diaphragm. In some embodiments, improved properties include reduced hTLR9 agonist activity. In some embodiments, improved properties include hTLR9 antagonist activity. In some embodiments, improved properties include increased hTLR9 antagonist activity.

In some embodiments, an oligonucleotide or oligonucleotide composition is: a DMD oligonucleotide or oligonucleotide composition; an oligonucleotide or oligonucleotide composition comprising a non-negatively charged internucleotidic linkage; or a DMD oligonucleotide comprising a non-negatively charged internucleotidic linkage.

In some embodiments, the present disclosure pertains to a composition comprising an a DMD oligonucleotide comprising at least one chirally controlled phosphorothioate internucleotidic linkage in the Rp or Sp configuration, at least one natural phosphate internucleotidic linkage, and at least one non-negatively charged internucleotidic linkage. In some embodiments, the present disclosure pertains to a composition comprising an a DMD oligonucleotide comprising at least one phosphorothioate internucleotidic linkage, at least one natural phosphate internucleotidic linkage, and at least one non-negatively charged internucleotidic linkage. In some embodiments, the present disclosure pertains to a composition comprising an a DMD oligonucleotide comprising at least one phosphorothioate internucleotidic linkage, at least one natural phosphate internucleotidic linkage, and at least one chirally controlled non-negatively charged internucleotidic linkage. In some embodiments, the present disclosure pertains to a composition comprising an a DMD oligonucleotide comprising at least one chirally controlled phosphorothioate internucleotidic linkage in the Rp or Sp configuration, at least one natural phosphate internucleotidic linkage, and at least one chirally controlled non-negatively charged internucleotidic linkage.

In some embodiments, a DMD oligonucleotide (e.g., an oligonucleotide whose base sequence contains no more than 5, 4, 3, 2, or 1 mismatches when hybridizing to a portion of a DMD transcript or a DMD genetic sequence having the same length) is capable of mediating skipping of one or more exons of the Dystrophin transcript.

In some embodiments, a DMD oligonucleotide has a base sequence which consists of the base sequence of an example oligonucleotide disclosed herein (e.g., an oligonucleotide listed in a Table), or a base sequence which comprises a 15-base portion of an example oligonucleotide nucleotide described herein. In some embodiments, a DMD oligonucleotide has a length of 15 to 50 bases.

In some embodiments, an oligonucleotide comprises a nucleobase modification, a sugar modification, and/or an internucleotidic linkage. In some embodiments, a DMD oligonucleotide has a pattern of nucleobase modifications, sugar modifications, and/or internucleotidic linkages of an example oligonucleotide described herein (or any portion thereof having a length of at least 5 bases).

In some embodiments, an oligonucleotide comprises a nucleobase modification which is BrU.

In some embodiments, an oligonucleotide comprises a sugar modification which is 2'-OMe, 2'-F, 2'-MOE, or LNA.

In some embodiments, an oligonucleotide comprises an internucleotidic linkage which is a natural phosphate linkage or a phosphorothioate internucleotidic linkage. In some embodiments, a phosphorothioate internucleotidic linkage is not chirally controlled. In some embodiments, a phosphorothioate internucleotidic linkage is a chirally controlled internucleotidic linkage (e.g., Sp or Rp).

In some embodiments, an oligonucleotide comprises a non-negatively charged internucleotidic linkage. In some embodiments, a DMD oligonucleotide comprises a neutral internucleotidic linkage. In some embodiments, a neutral internucleotidic linkage is or comprises a triazole, alkyne, or cyclic guanidine moiety.

In some embodiments, an internucleotidic linkage comprising a triazole moiety (e.g., an optionally substituted triazolyl group) in a provided oligonucleotide, e.g., a DMD oligonucleotide, has the structure of:

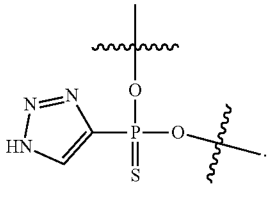.

In some embodiments, an internucleotidic linkage comprising a triazole moiety has the formula of

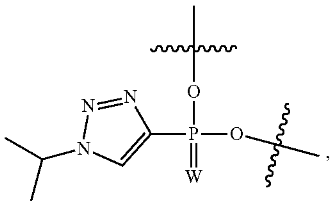, where W is O or S. In some embodiments, an internucleotidic linkage comprising an alkyne moiety (e.g., an optionally substituted alkynyl group) has the formula of:

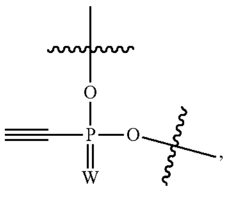, wherein W is O or S. In some embodiments, an internucleotidic linkage comprises a guanidine moiety. In some embodiments, an internucleotidic linkage comprises a cyclic guanidine moiety. In some embodiments, an internucleotidic linkage comprising a cyclic guanidine moiety has the structure of:

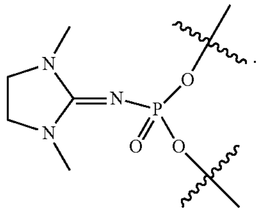.

In some embodiments, a neutral internucleotidic linkage or internucleotidic linkage comprising a cyclic guanidine moiety is stereochemically controlled.

In some embodiments, a DMD oligonucleotide comprises a lipid moiety In some embodiments, an internucleotidic linkage comprises a Tmg group (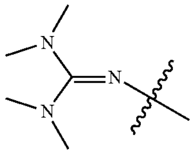).

In some embodiments, an internucleotidic linkage comprises a Tmg group and has the structure of

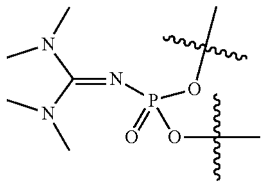

(the "Tmg internucleotidic linkage"). In some embodiments, neutral internucleotidic linkages include internucleotidic linkages of PNA and PMO, and an Tmg internucleotidic linkage.

In general, properties of oligonucleotide compositions as described herein can be assessed using any appropriate assay. Relative toxicity and/or protein binding properties for different compositions (e.g., stereocontrolled vs non-stereocontrolled, and/or different stereocontrolled compositions) are typically desirably determined in the same assay, in some embodiments substantially simultaneously and in some embodiments with reference to historical results.

Those of skill in the art will be aware of and/or will readily be able to develop appropriate assays for particular oligonucleotide compositions. The present disclosure provides descriptions of certain particular assays, for example that may be useful in assessing one or more features of oligonucleotide composition behavior e.g., complement activation, injection site inflammation, protein biding, etc.

For example, certain assays that may be useful in the assessment of toxicity and/or protein binding properties of oligonucleotide compositions may include any assay described and/or exemplified herein.

Among other things, in some embodiments, the present disclosure provides an oligonucleotide composition, comprising a plurality of oligonucleotides of a particular oligonucleotide type defined by:

1) base sequence;
2) pattern of backbone linkages;
3) pattern of backbone chiral centers; and
4) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages; and the oligonucleotide composition being characterized in that, when it is contacted with a transcript in a transcript splicing system, splicing of the transcript is altered relative to that observed under a reference condition selected from the group consisting of absence of the composition, presence of a reference composition, and combinations thereof.

In some embodiments, the present disclosure provides a composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled and it is enriched, relative to a substantially racemic preparation of oligonucleotides having the same base sequence, pattern of backbone linkages and pattern of backbone phosphorus modifications, for oligonucleotides of the particular oligonucleotide type, wherein:

the oligonucleotide composition is characterized in that, when it is contacted with a transcript in a transcript splicing system, splicing of the transcript is altered in that level of skipping of an exon is increased relative to that observed under a reference condition selected from the group consisting of absence of the composition, presence of a reference composition, and combinations thereof.

In some embodiments, the present disclosure provides a composition comprising a plurality of oligonucleotides of a particular oligonucleotide type defined by:

1) base sequence;
2) pattern of backbone linkages; and
3) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 non-negatively charged internucleotidic linkages;

the oligonucleotide composition is characterized in that, when it is contacted with a transcript in a transcript splicing system, splicing of the transcript is altered in that level of skipping of an exon is increased relative to that observed under a reference condition selected from the group consisting of absence of the composition, presence of a reference composition, and combinations thereof.

In some embodiments, the present disclosure provides a composition comprising a plurality of oligonucleotides of a particular oligonucleotide type defined by:

1) base sequence;
2) pattern of backbone linkages; and
3) pattern of backbone phosphorus modifications, wherein:

oligonucleotides of the plurality comprise:

1) a 5'-end region comprising 1, 2, 3, 4, 5, 6, 7, 8, 9, 10 or more nucleoside units comprising a 2'-F modified sugar moiety;
2) a 3'-end region comprising 1, 2, 3, 4, 5, 6, 7, 8, 9, 10 or more nucleoside units comprising a 2'-F modified sugar moiety; and
3) a middle region between the 5'-end region and the 3'-region comprising 1, 2, 3, 4, 5, 6, 7, 8, 9, 10 or more nucleotidic units comprising a phosphodiester linkage.

In some embodiments, the present disclosure provides a composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages; and oligonucleotides of the plurality comprise at least 1, 2, 3, 4, 5, 6, 7, 8, 9, 10, 11, 12, 13, 14, 15, 16, 17, 18, 19, or 20 non-negatively charged internucleotidic linkages.

In some embodiments, the present disclosure provides a composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications, wherein:

the oligonucleotides of the plurality comprise cholesterol; L-carnitine (amide and carbamate bond); Folic acid; Cleavable lipid (1,2-dilaurin and ester bond); Insulin receptor ligand; Gambogic acid; CPP; Glucose (tri- and hex-antennary); or Mannose (tri- and hex-antennary, alpha and beta).

In some embodiments, the present disclosure provides a pharmaceutical composition comprising an oligonucleotide or an oligonucleotide composition of the present disclosure and a pharmaceutically acceptable carrier.

In some embodiments, the present disclosure provides a method for altering splicing of a target transcript, comprising administering an oligonucleotide composition of the present disclosure. In some embodiments, the present disclosure provides a method for reducing level of a transcript or a product thereof, comprising administering an oligonucleotide composition of the present disclosure. In some embodiments, the present disclosure provides a method for increase level of a transcript or a product thereof, comprising administering an oligonucleotide composition of the present disclosure. A method for treating muscular dystrophy, Duchenne (Duchenne's) muscular dystrophy (DMD), or Becker (Becker's) muscular dystrophy (BMD), comprising administering to a subject susceptible thereto or suffering therefrom a composition described in the present disclosure.

In some embodiments, the present disclosure provides a method for treating muscular dystrophy, Duchenne (Duchenne's) muscular dystrophy (DMD), or Becker (Becker's) muscular dystrophy (BMD), comprising administering to a subject susceptible thereto or suffering therefrom a composition comprising any DMD oligonucleotide disclosed herein.

In some embodiments, the present disclosure provides a method for treating muscular dystrophy, Duchenne (Duchenne's) muscular dystrophy (DMD), or Becker (Becker's) muscular dystrophy (BMD), comprising (a) administering to a subject susceptible thereto or suffering therefrom a composition comprising any oligonucleotide disclosed herein, and (b) administering to the subject additional treatment which is capable of preventing, treating, ameliorating or slowing the progress of muscular dystrophy, Duchenne (Duchenne's) muscular dystrophy (DMD), or Becker (Becker's) muscular dystrophy (BMD).

DEFINITIONS

Figure 1:
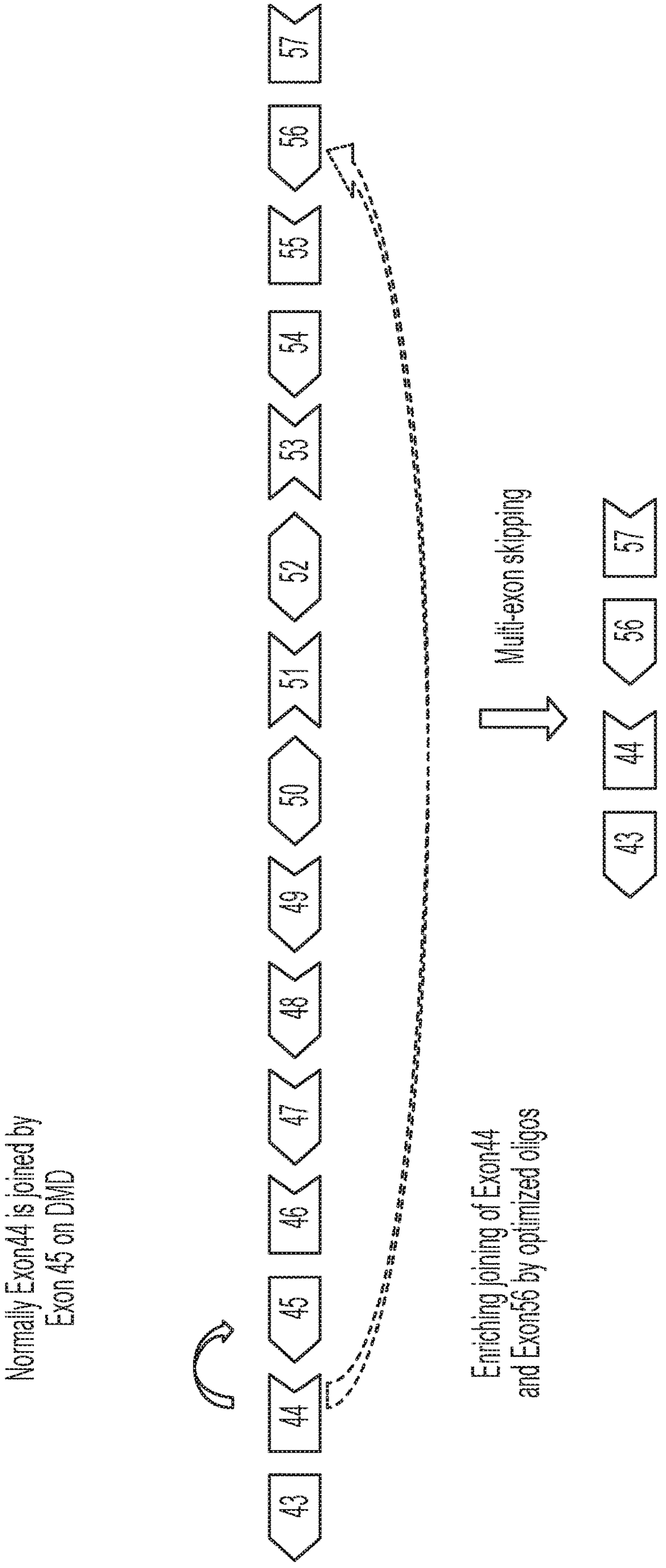
FIG. 1 shows an example of multiple exon skipping.

As used herein, the following definitions shall apply unless otherwise indicated. For purposes of this disclosure, the chemical elements are identified in accordance with the Periodic Table of the Elements, CAS version, Handbook of Chemistry and Physics, 75th Ed. Additionally, general principles of organic chemistry are described in "Organic Chemistry", Thomas Sorrell, University Science Books, Sausalito: 1999, and "March's Advanced Organic Chemistry", 5th Ed., Ed.: Smith, M. B. and March, J., John Wiley & Sons, New York: 2001.

Aliphatic: The term "aliphatic" or "aliphatic group", as used herein, means a straight-chain (i.e., unbranched) or branched, substituted or unsubstituted hydrocarbon chain that is completely saturated or that contains one or more units of unsaturation, or a monocyclic hydrocarbon or bicyclic or polycyclic hydrocarbon that is completely saturated or that contains one or more units of unsaturation, but which is not aromatic (also referred to herein as "carbocycle" "cycloaliphatic" or "cycloalkyl"), or combinations thereof. In some embodiments, aliphatic groups contain 1-100 aliphatic carbon atoms. In some embodiments, aliphatic groups contain 1-20 aliphatic carbon atoms. In other embodiments, aliphatic groups contain 1-10 aliphatic carbon atoms. In other embodiments, aliphatic groups contain 1-9 aliphatic carbon atoms. In other embodiments, aliphatic groups contain 1-8 aliphatic carbon atoms. In other embodiments, aliphatic groups contain 1-7 aliphatic carbon atoms. In other embodiments, aliphatic groups contain 1-6 aliphatic carbon atoms. In still other embodiments, aliphatic groups contain 1-5 aliphatic carbon atoms, and in yet other embodiments, aliphatic groups contain 1, 2, 3, or 4 aliphatic carbon atoms. In some embodiments, "cycloaliphatic" (or "carbocycle" or "cycloalkyl") refers to a monocyclic or bicyclic or polycyclic hydrocarbon that is completely saturated or that contains one or more units of unsaturation, but which is not aromatic. In some embodiments, "cycloaliphatic" (or "carbocycle" or "cycloalkyl") refers to a monocyclic $C_3$-$C_6$ hydrocarbon that is completely saturated or that contains one or more units of unsaturation, but which is not aromatic. Suitable aliphatic groups include, but are not limited to, linear or branched, substituted or unsubstituted alkyl, alkenyl, alkynyl groups and hybrids thereof such as (cycloalkyl)alkyl, (cycloalkenyl) alkyl or (cycloalkyl)alkenyl.

Alkenyl: As used herein, the term "alkenyl" refers to an aliphatic group, as defined herein, having one or more double bonds.

Alkyl: As used herein, the term "alkyl" is given its ordinary meaning in the art and may include saturated aliphatic groups, including straight-chain alkyl groups, branched-chain alkyl groups, cycloalkyl (alicyclic) groups, alkyl substituted cycloalkyl groups, and cycloalkyl substituted alkyl groups. In some embodiments, an alkyl has 1-100 carbon atoms. In certain embodiments, a straight chain or branched chain alkyl has about 1-20 carbon atoms in its backbone (e.g., $C_1$-$C_{20}$ for straight chain, $C_2$-$C_{20}$ for branched chain), and alternatively, about 1-10. In some embodiments, cycloalkyl rings have from about 3-10 carbon atoms in their ring structure where such rings are monocyclic, bicyclic, or polycyclic, and alternatively about 5, 6 or 7 carbons in the ring structure. In some embodiments, an alkyl group may be a lower alkyl group, wherein a lower alkyl group comprises 1-4 carbon atoms (e.g., $C_1$-$C_4$ for straight chain lower alkyls).

Alkynyl: As used herein, the term "alkynyl" refers to an aliphatic group, as defined herein, having one or more triple bonds.

Animal: As used herein, the term "animal" refers to any member of the animal kingdom. In some embodiments, "animal" refers to humans, at any stage of development. In some embodiments, "animal" refers to non-human animals, at any stage of development. In certain embodiments, the non-human animal is a mammal (e.g., a rodent, a mouse, a rat, a rabbit, a monkey, a dog, a cat, a sheep, cattle, a primate, and/or a pig). In some embodiments, animals include, but are not limited to, mammals, birds, reptiles, amphibians, fish, and/or worms. In some embodiments, an animal may be a transgenic animal, a genetically-engineered animal, and/or a clone.

Approximately: As used herein, the terms "approximately" or "about" in reference to a number are generally taken to include numbers that fall within a range of 5%, 10%, 15%, or 20% in either direction (greater than or less than) of the number unless otherwise stated or otherwise evident from the context (except where such number would be less than 0% or exceed 100% of a possible value). In some embodiments, use of the term "about" in reference to dosages means±5 mg/kg/day.

Aryl: The term "aryl", as used herein, used alone or as part of a larger moiety as in "aralkyl," "aralkoxy," or "aryloxyalkyl," refers to monocyclic, bicyclic or polycyclic ring systems having a total of, e.g., five to thirty ring members, wherein at least one ring in the system is aromatic. In some embodiments, an aryl group is a monocyclic, bicyclic or polycyclic ring system having a total of five to fourteen ring members, wherein at least one ring in the system is aromatic, and wherein each ring in the system contains 3 to 7 ring members. In some embodiments, an aryl group is a biaryl group. The term "aryl" may be used interchangeably with the term "aryl ring." In certain embodiments of the present disclosure, "aryl" refers to an aromatic ring system which includes, but not limited to, phenyl, biphenyl, naphthyl, binaphthyl, anthracyl and the like, which may bear one or more substituents. Also included within the scope of the term "aryl," as it is used herein, is an aromatic ring fused to one or more non-aromatic rings, such as indanyl, phthalimidyl, naphthimidyl, phenanthridinyl, or tetrahydronaphthyl, and the like.

Characteristic sequence: A "characteristic sequence" is a sequence that is found in all members of a family of polypeptides or nucleic acids, and therefore can be used by those of ordinary skill in the art to define members of the family.

Comparable: The term "comparable" is used herein to describe two (or more) sets of conditions or circumstances that are sufficiently similar to one another to permit comparison of results obtained or phenomena observed. In some embodiments, comparable sets of conditions or circumstances are characterized by a plurality of substantially identical features and one or a small number of varied features. Those of ordinary skill in the art will appreciate that sets of conditions are comparable to one another when characterized by a sufficient number and type of substantially identical features to warrant a reasonable conclusion that differences in results obtained or phenomena observed under the different sets of conditions or circumstances are caused by or indicative of the variation in those features that are varied.

Cycloaliphatic: The term “cycloaliphatic,” “carbocycle,” “carbocyclyl,” “carbocyclic radical,” and “carbocyclic ring,” are used interchangeably, and as used herein, refer to saturated or partially unsaturated, but non-aromatic, cyclic aliphatic monocyclic, bicyclic, or polycyclic ring systems, as described herein, having, unless otherwise specified, from 3 to 30 ring members. Cycloaliphatic groups include, without limitation, cyclopropyl, cyclobutyl, cyclopentyl, cyclopentenyl, cyclohexyl, cyclohexenyl, cycloheptyl, cycloheptenyl, cyclooctyl, cyclooctenyl, norbornyl, adamantyl, and cyclooctadienyl. In some embodiments, a cycloaliphatic group has 3-6 carbons. In some embodiments, a cycloaliphatic group is saturated and is cycloalkyl. The term “cycloaliphatic” may also include aliphatic rings that are fused to one or more aromatic or nonaromatic rings, such as decahydronaphthyl or 1,2,3,4-tetrahydronaphth-1-yl. In some embodiments, a cycloaliphatic group is bicyclic. In some embodiments, a cycloaliphatic group is tricyclic. In some embodiments, a cycloaliphatic group is polycyclic. In some embodiments, “cycloaliphatic” refers to $C_3$-$C_6$ monocyclic hydrocarbon, or $C_8$-$C_{10}$ bicyclic or polycyclic hydrocarbon, that is completely saturated or that contains one or more units of unsaturation, but which is not aromatic, or a $C_9$-$C_{16}$ polycyclic hydrocarbon that is completely saturated or that contains one or more units of unsaturation, but which is not aromatic.

Dosing regimen: As used herein, a “dosing regimen” or “therapeutic regimen” refers to a set of unit doses (typically more than one) that are administered individually to a subject, typically separated by periods of time. In some embodiments, a given therapeutic agent has a recommended dosing regimen, which may involve one or more doses. In some embodiments, a dosing regimen comprises a plurality of doses each of which are separated from one another by a time period of the same length; in some embodiments, a dosing regime comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second dose amount same as the first dose amount.

Heteroaliphatic: The term “heteroaliphatic” refers to an aliphatic group wherein one or more units selected from C, CH, $CH_2$, and $CH_3$ are independently replaced by one or more heteroatoms. In some embodiments, a heteroaliphatic group is heteroalkyl. In some embodiments, a heteroaliphatic group is heteroalkenyl.

Heteroaryl: The terms “heteroaryl” and “heteroar-”, as used herein, used alone or as part of a larger moiety, e.g., “heteroaralkyl,” or “heteroaralkoxy,” refer to monocyclic, bicyclic or polycyclic ring systems having a total of, e.g., five to thirty ring members, wherein at least one ring in the system is aromatic and at least one aromatic ring atom is a heteroatom. In some embodiments, a heteroaryl group is a group having 5 to 10 ring atoms (i.e., monocyclic, bicyclic or polycyclic), in some embodiments 5, 6, 9, or 10 ring atoms. In some embodiments, a heteroaryl group has 6, 10, or 14 $\pi$ electrons shared in a cyclic array; and having, in addition to carbon atoms, from one to five heteroatoms. Heteroaryl groups include, without limitation, thienyl, furanyl, pyrrolyl, imidazolyl, pyrazolyl, triazolyl, tetrazolyl, oxazolyl, isoxazolyl, oxadiazolyl, thiazolyl, isothiazolyl, thiadiazolyl, pyridyl, pyridazinyl, pyrimidinyl, pyrazinyl, indolizinyl, purinyl, naphthyridinyl, and pteridinyl. In some embodiments, a heteroaryl is a heterobiaryl group, such as bipyridyl and the like. The terms “heteroaryl” and “heteroar-”, as used herein, also include groups in which a heteroaromatic ring is fused to one or more aryl, cycloaliphatic, or heterocyclyl rings, where the radical or point of attachment is on the heteroaromatic ring. Non-limiting examples include indolyl, isoindolyl, benzothienyl, benzofuranyl, dibenzofuranyl, indazolyl, benzimidazolyl, benzthiazolyl, quinolyl, isoquinolyl, cinnolinyl, phthalazinyl, quinazolinyl, quinoxalinyl, 4H-quinolizinyl, carbazolyl, acridinyl, phenazinyl, phenothiazinyl, phenoxazinyl, tetrahydroquinolinyl, tetrahydroisoquinolinyl, and pyrido[2,3-b]-1,4-oxazin-3(4H)-one. A heteroaryl group may be monocyclic, bicyclic or polycyclic. The term “heteroaryl” may be used interchangeably with the terms “heteroaryl ring,” “heteroaryl group,” or “heteroaromatic,” any of which terms include rings that are optionally substituted. The term “heteroaralkyl” refers to an alkyl group substituted by a heteroaryl group, wherein the alkyl and heteroaryl portions independently are optionally substituted.

Heteroatom: The term “heteroatom” means an atom that is not carbon or hydrogen. In some embodiments, a heteroatom is oxygen, sulfur, nitrogen, phosphorus, boron or silicon (including any oxidized form of nitrogen, sulfur, phosphorus, or silicon; the quaternized form of any basic nitrogen or a substitutable nitrogen of a heterocyclic ring (for example, N as in 3,4-dihydro-2H-pyrrolyl), NH (as in pyrrolidinyl) or $NR^+$ (as in N-substituted pyrrolidinyl); etc.). In some embodiments, a heteroatom is boron, nitrogen, oxygen, silicon, sulfur, or phosphorus. In some embodiments, a heteroatom is nitrogen, oxygen, silicon, sulfur, or phosphorus. In some embodiments, a heteroatom is nitrogen, oxygen, sulfur, or phosphorus. In some embodiments, a heteroatom is nitrogen, oxygen or sulfur.

Heterocycle: As used herein, the terms “heterocycle,” “heterocyclyl,” “heterocyclic radical,” and “heterocyclic ring”, as used herein, are used interchangeably and refer to a monocyclic, bicyclic or polycyclic ring moiety (e.g., 3-30 membered) that is saturated or partially unsaturated and has one or more heteroatom ring atoms. In some embodiments, a heterocyclyl group is a stable 5- to 7-membered monocyclic or 7- to 10-membered bicyclic heterocyclic moiety that is either saturated or partially unsaturated, and having, in addition to carbon atoms, one or more, preferably one to four, heteroatoms, as defined above. When used in reference to a ring atom of a heterocycle, the term “nitrogen” includes substituted nitrogen. As an example, in a saturated or partially unsaturated ring having 0-3 heteroatoms selected from oxygen, sulfur and nitrogen, the nitrogen may be N (as in 3,4-dihydro-2H-pyrrolyl), NH (as in pyrrolidinyl), or $^+NR$ (as in N-substituted pyrrolidinyl). A heterocyclic ring can be attached to its pendant group at any heteroatom or carbon atom that results in a stable structure and any of the ring atoms can be optionally substituted. Examples of such saturated or partially unsaturated heterocyclic radicals include, without limitation, tetrahydrofuranyl, tetrahydrothienyl, pyrrolidinyl, piperidinyl, pyrrolinyl, tetrahydroquinolinyl, tetrahydroisoquinolinyl, decahydroquinolinyl, oxazolidinyl, piperazinyl, dioxanyl, dioxolanyl, diazepinyl, oxazepinyl, thiazepinyl, morpholinyl, and quinuclidinyl. The terms "heterocycle," "heterocyclyl," "heterocyclyl ring," "heterocyclic group," "heterocyclic moiety," and "heterocyclic radical," are used interchangeably herein, and also include heterocyclyl rings fused to one or more aryl, heteroaryl, or cycloaliphatic rings, such as indolinyl, 3H-indolyl, chromanyl, phenanthridinyl, or tetrahydroquinolinyl. A heterocyclyl group may be monocyclic, bicyclic or polycyclic. The term "heterocyclylalkyl" refers to an alkyl group substituted by a heterocyclyl, wherein the alkyl and heterocyclyl portions independently are optionally substituted.

Intraperitoneal: The phrases "intraperitoneal administration" and "administered intraperitonealy" as used herein have their art-understood meaning referring to administration of a compound or composition into the peritoneum of a subject.

In vitro: As used herein, the term "in vitro" refers to events that occur in an artificial environment, e.g., in a test tube or reaction vessel, in cell culture, etc., rather than within an organism (e.g., animal, plant, and/or microbe).

In vivo: As used herein, the term "in vivo" refers to events that occur within an organism (e.g., animal, plant, and/or microbe).

Lower alkyl: The term "lower alkyl" refers to a $C_{1-4}$ straight or branched alkyl group. Example lower alkyl groups are methyl, ethyl, propyl, isopropyl, butyl, isobutyl, and tert-butyl.

Lower haloalkyl: The term "lower haloalkyl" refers to a $C_{1-4}$ straight or branched alkyl group that is substituted with one or more halogen atoms.

Optionally substituted: As described herein, compounds of the disclosure, e.g., oligonucleotides, lipids, carbohydrates, etc., may contain "optionally substituted" moieties. In general, the term "substituted," whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent selected from a specified group, the substituent may be either the same or different at every position. Combinations of substituents envisioned by this disclosure are preferably those that result in the formation of stable or chemically feasible compounds. The term "stable," as used herein, refers to compounds that are not substantially altered when subjected to conditions to allow for their production, detection, and, in certain embodiments, their recovery, purification, and use for one or more of the purposes disclosed herein.

Suitable monovalent substituents are halogen; —$(CH_2)_{0-4}R^o$; —$(CH_2)_{0-4}OR^o$; —$O(CH_2)_{0-4}R^o$, —O—$(CH_2)_{0-4}C(O)OR^o$; —$(CH_2)_{0-4}CH(OR^o)_2$; —$(CH_2)_{0-4}Ph$, which may be substituted with $R^o$; —$(CH_2)_{0-4}O(CH_2)_{0-1}Ph$ which may be substituted with $R^o$; —CH═CHPh, which may be substituted with $R^o$; —$(CH_2)_{0-4}O(CH_2)_{0-1}$— pyridyl which may be substituted with $R^o$; —$NO_2$; —CN; —$N_3$; —$(CH_2)_{0-4}N(R^o)_2$; —$(CH_2)_{0-4}N(R^o)C(O)R^o$; —$N(R^o)C(S)R^o$; —$(CH_2)_{0-4}N(R^o)C(O)N(R^o)_2$; —$N(R^o)C(S)N(R^o)_2$; —$(CH_2)_{0-4}N(R^o)C(O)OR^o$; —$N(R^o)N(R^o)C(O)R^o$; —$N(R^o)N(R^o)C(O)N(R^o)_2$; —$N(R^o)N(R^o)C(O)OR^o$; —$(CH_2)_{0-4}C(O)R^o$; —$C(S)R^o$; —$(CH_2)_{0-4}C(O)OR^o$; —$(CH_2)_{0-4}C(O)SR^o$; —$(CH_2)_{0-4}C(O)OSi(R^o)_3$; —$(CH_2)_{0-4}OC(O)R^o$; —$OC(O)(CH_2)_{0-4}SR^o$, —$SC(S)SR^o$; —$(CH_2)_{0-4}SC(O)R^o$; —$(CH_2)_{0-4}C(O)N(R^o)_2$; —$C(S)N(R^o)_2$; —$C(S)SR^o$; —$SC(S)SR^o$, —$(CH_2)_{0-4}OC(O)N(R^o)_2$; —$C(O)N(OR^o)R^o$; —$C(O)C(O)R^o$; —$C(O)CH_2C(O)R^o$; —$C(NOR^o)R^o$; —$(CH_2)_{0-4}SSR^o$; —$(CH_2)_{0-4}S(O)_2R^o$; —$(CH_2)_{0-4}S(O)_2OR^o$; —$(CH_2)_{0-4}OS(O)_2R^o$; —$S(O)_2N(R^o)_2$; —$(CH_2)_{0-4}S(O)R^o$; —$N(R^oS(O)_2N(R^o)_2$; —$N(R^oS(O)_2R^o$; —$N(OR^o)R^o$; —$C(NH)N(R^o)_2$; —$Si(R^o)_3$; —$OSi(R^o)_3$; —$P(R^o)_2$; —$P(OR^o)_2$; —$P(R^o)(OR^o)$; —$OP(R^o)_2$; —$OP(OR^o)_2$; —$OP(R^o)(OR^o)$; —$P[N(R^o)_2]_2$; —$P(R^o)[N(R^o)_2]$; —$P(OR^o)[N(R^o)_2]$; —$OP[N(R^o)_2]_2$; —$OP(R^o)[N(R^o)_2]$; —$OP(OR^o)[N(R^o)_2]$; —$N(R^o)P(R^o)_2$; —$N(R^o)P(OR^o)_2$; —$N(R^o)P(R^o)(OR^o)$; —$N(R^o)P[N(R^o)_2]_2$; —$N(R^o)P(R^o)[N(R^o)_2]$; —$N(R^o)P(OR^o)[N(R^o)_2]$; —$B(R^o)_2$; —$B(R^o)(OR^o)$; —$B(OR^o)_2$; —$OB(R^o)_2$; —$OB(R^o)(OR^o)$; —$OB(OR^o)_2$; —$P(O)(R^o)_2$; —$P(O)(R^o)(OR^o)$; —$P(O)(R^o)(SR^o)$; —$P(O)(R^o)[N(R^o)_2]$; —$P(O)(OR^o)_2$; —$P(O)(SR^o)_2$; —$P(O)(OR^o)[N(R^o)_2]$; —$P(O)(SR^o)[N(R^o)_2]$; —$P(O)(OR^o)(SR^o)$; —$P(O)[N(R^o)_2]_2$; —$OP(O)(R^o)_2$; —$OP(O)(R^o)(OR^o)$; —$OP(O)(R^o)(SR^o)$; —$OP(O)(R^o)[N(R^o)_2]$; —$OP(O)(OR^o)_2$; —$OP(O)(SR^o)_2$; —$OP(O)(OR^o)[N(R^o)_2]$; —$OP(O)(SR^o)[N(R^o)_2]$; —$OP(O)(OR^o)(SR^o)$; —$OP(O)[N(R^o)_2]_2$; —$SP(O)(R^o)_2$; —$SP(O)(R^o)(OR^o)$; —$SP(O)(R^o)(SR^o)$; —$SP(O)(R^o)[N(R^o)_2]$; —$SP(O)(OR^o)_2$; —$SP(O)(SR^o)_2$; —$SP(O)(OR^o)[N(R^o)_2]$; —$SP(O)(SR^o)[N(R^o)_2]$; —$SP(O)(OR^o)(SR^o)$; —$SP(O)[N(R^o)_2]_2$; —$N(R^o)P(O)(R^o)_2$; —$N(R^o)P(O)(R^o)(OR^o)$; —$N(R^o)P(O)(R^o)(SR^o)$; —$N(R^o)P(O)(R^o)[N(R^o)_2]$; —$N(R^o)P(O)(OR^o)_2$; —$N(R^o)P(O)(SR^o)_2$; —$N(R^o)P(O)(OR^o)[N(R^o)_2]$; —$N(R^o)P(O)(SR^o)[N(R^o)_2]$; —$N(R^o)P(O)(OR^o)(SR^o)$; —$N(R^o)P(O)[N(R^o)_2]_2$; —$P(R^o)_2[B(R^o)_3]$; —$P(OR^o)_2[B(R^o)_3]$; —$P(NR^o)_2[B(R^o)_3]$; —$P(R^o)(OR^o)[B(R^o)_3]$; —$P(R^o)[N(R^o)_2][B(R^o)_3]$; —$P(OR^o)[N(R^o)_2][B(R^o)_3]$; —$OP(R^o)_2[B(R^o)_3]$; —$OP(OR^o)_2[B(R^o)_3]$; —$OP(NR^o)_2[B(R^o)_3]$; —$OP(R^o)(OR^o)[B(R^o)_3]$; —$OP(R^o)[N(R^o)_2][B(R^o)_3]$; —$OP(OR^o)[N(R^o)_2][B(R^o)_3]$; —$N(R^o)P(R^o)_2[B(R^o)_3]$; —$N(R^o)P(OR^o)_2[B(R^o)_3]$; —$N(R^o)P(NR^o)_2[B(R^o)_3]$; —$N(R^o)P(R^o)(OR^o)[B(R^o)_3]$; —$N(R^o)P(R^o)[N(R^o)_2][B(R^o)_3]$; —$N(R^o)P(OR^o)[N(R^o)_2][B(R^o)_3]$; —$P(OR')[B(R')_3]$—; —($C_{1-4}$ straight or branched alkylene)O—$N(R^o)_2$; or —($C_{1-4}$ straight or branched alkylene)C(O)O—$N(R^o)_2$, wherein each $R^o$ may be substituted as defined below and is independently hydrogen, $C_{1-20}$ aliphatic, $C_{1-20}$ heteroaliphatic having 1-5 heteroatoms independently selected from nitrogen, oxygen, sulfur, silicon and phosphorus, —$CH_2$—($C_{6-20}$ aryl), —$O(CH_2)_{0-1}$ ($C_{6-20}$ aryl), —$CH_2$-(5-20 membered heteroaryl ring having 1-5 heteroatoms independently selected from nitrogen, oxygen, sulfur, silicon and phosphorus), a 5-20 membered, monocyclic, bicyclic, or polycyclic, saturated, partially unsaturated or aryl ring having 0-5 heteroatoms independently selected from nitrogen, oxygen, sulfur, silicon and phosphorus, or, notwithstanding the definition above, two independent occurrences of $R^o$, taken together with their intervening atom(s), form a 3-20 membered, monocyclic, bicyclic, or polycyclic, saturated, partially unsaturated or aryl ring having 0-5 heteroatoms independently selected from nitrogen, oxygen, sulfur, silicon and phosphorus, which may be substituted as defined below.

Suitable monovalent substituents on $R^o$ (or the ring formed by taking two independent occurrences of $R^o$ together with their intervening atoms), are independently halogen, —$(CH_2)_{0-2}R^\bullet$, -(halo$R^\bullet$), —$(CH_2)_{0-2}OH$, —$(CH_2)_{0-2}OR^\bullet$, —$(CH_2)_{0-2}CH(OR^\bullet)_2$; —O(halo$R^\bullet$), —CN, —$N_3$, —$(CH_2)_{0-2}C(O)R^\bullet$, —$(CH_2)_{0-2}C(O)OH$, —$(CH_2)_{0-2}C(O)OR^\bullet$, —$(CH_2)_{0-2}SR^\bullet$, —$(CH_2)_{0-2}SH$, —$(CH_2)_{0-2}NH_2$, —$(CH_2)_{0-2}NHR^\bullet$, —$(CH_2)_{0-2}NR^\bullet_2$, —$NO_2$, —$SiR^\bullet_3$, —$OSiR^\bullet_3$, —$C(O)SR^\bullet$, —($C_{1-4}$ straight or branched alkylene)$C(O)OR^{\bullet}$, or $—SSR^{\bullet}$ wherein each $R^{\bullet}$ is unsubstituted or where preceded by "halo" is substituted only with one or more halogens, and is independently selected from $C_{1-4}$ aliphatic, $—CH_2Ph$, $—O(CH_2)_{0-1}Ph$, and a 5-6-membered saturated, partially unsaturated, or aryl ring having 0-4 heteroatoms independently selected from nitrogen, oxygen, and sulfur. Suitable divalent substituents on a saturated carbon atom of $R^o$ include ═O and ═S.

Suitable divalent substituents, e.g., on a suitable carbon atom, nitrogen atom, are independently the following: ═O, ═S, $═CR^*_2$, $═NNR^*_2$, ═NNHC(O)R*, ═NNHC(O)OR*, $═NNHS(O)_2R^*$, ═NR*, ═NOR*, $—O(C(R^*_2))_{2-3}O—$, or $—S(C(R^*_2))_{2-3}S—$, wherein each R* may be substituted as defined below and is independently hydrogen, $C_{1-20}$ aliphatic, $C_{1-20}$ heteroaliphatic having 1-5 heteroatoms independently selected from nitrogen, oxygen, sulfur, silicon and phosphorus, $—CH_2—(C_{6-20}$ aryl), $—O(CH_2)_{0-1}(C_{6-20}$ aryl), $—CH_2$-(5-20 membered heteroaryl ring having 1-5 heteroatoms independently selected from nitrogen, oxygen, sulfur, silicon and phosphorus), a 5-20 membered, monocyclic, bicyclic, or polycyclic, saturated, partially unsaturated or aryl ring having 0-5 heteroatoms independently selected from nitrogen, oxygen, sulfur, silicon and phosphorus, or, notwithstanding the definition above, two independent occurrences of R*, taken together with their intervening atom(s), form a 3-20 membered, monocyclic, bicyclic, or polycyclic, saturated, partially unsaturated or aryl ring having 0-5 heteroatoms independently selected from nitrogen, oxygen, sulfur, silicon and phosphorus, which may be substituted as defined below. Suitable divalent substituents that are bound to vicinal substitutable atoms of an "optionally substituted" group include: $—O(CR^*_2)_{2-3}O—$.

Suitable monovalent substituents on R* (or the ring formed by taking two independent occurrences of R* together with their intervening atoms), are independently halogen, $—(CH_2)_{0-2}R^{\bullet}$, -(halo$R^{\bullet}$), $—(CH_2)_{0-2}OH$, $—(CH_2)_{0-2}OR^{\bullet}$, $—(CH_2)_{0-2}CH(OR^{\bullet})_2$; —O(halo$R^{\bullet}$), —CN, $—N_3$, $—(CH_2)_{0-2}C(O)R^{\bullet}$, $—(CH_2)_{0-2}C(O)OH$, $—(CH_2)_{0-2}C(O)OR^{\bullet}$, $—(CH_2)_{0-2}SR^{\bullet}$, $—(CH_2)_{0-2}SH$, $—(CH_2)_{0-2}NH_2$, $—(CH_2)_{0-2}NHR^{\bullet}$, $—(CH_2)_{0-2}NR^{\bullet}_2$, $—NO_2$, $—SiR^{\bullet}_3$, $—OSiR^{\bullet}_3$, $—C(O)SR^{\bullet}$, $—(C_{1-4}$ straight or branched alkylene)$C(O)OR^{\bullet}$, or $—SSR^{\bullet}$ wherein each $R^{\bullet}$ is unsubstituted or where preceded by "halo" is substituted only with one or more halogens, and is independently selected from $C_{1-4}$ aliphatic, $—CH_2Ph$, $—O(CH_2)_{0-1}Ph$, and a 5-6-membered saturated, partially unsaturated, or aryl ring having 0-4 heteroatoms independently selected from nitrogen, oxygen, and sulfur. Suitable divalent substituents on a saturated carbon atom of R* include ═O and ═S.

In some embodiments, suitable substituents on a substitutable nitrogen of an "optionally substituted" group include $—R^{\dagger}$, $—NR^{\dagger}_2$, $—C(O)R^{\dagger}$, $—C(O)OR^{\dagger}$, $—C(O)C(O)R^{\dagger}$, $—C(O)CH_2C(O)R^{\dagger}$, $—S(O)_2R^{\dagger}$, $—S(O)_2NR^{\dagger}_2$, $—C(S)NR^{\dagger}_2$, $—C(NH)NR^{\dagger}_2$, or $—N(R^{\dagger})S(O)_2R^{\dagger}$; wherein each $R^{\dagger}$ is independently hydrogen, $C_{1-6}$ aliphatic which may be substituted as defined below, unsubstituted —OPh, or an unsubstituted 5-6 membered saturated, partially unsaturated, or aryl ring having 0-4 heteroatoms independently selected from nitrogen, oxygen, or sulfur, or, notwithstanding the definition above, two independent occurrences of $R^{\dagger}$, taken together with their intervening atom(s) form an unsubstituted 3-12 membered saturated, partially unsaturated, or aryl mono- or bicyclic ring having 0-4 heteroatoms independently selected from nitrogen, oxygen, or sulfur.

In some embodiments, suitable substituents on the aliphatic group of $R^{\dagger}$ are independently halogen, $—R^{\bullet}$, -(halo$R^{\bullet}$), —OH, $OR^{\bullet}$, —O(halo$R^{\bullet}$), —CN, —C(O)OH, $—C(O)OR^{\bullet}$, $—NH_2$, $—NHR^{\bullet}$, $—NR^{\bullet}_2$, or $—NO_2$, wherein each $R^{\bullet}$ is unsubstituted or where preceded by "halo" is substituted only with one or more halogens, and is independently $C_{1-4}$ aliphatic, $—CH_2Ph$, $—O(CH_2)_{0-1}Ph$, or a 5-6 membered saturated, partially unsaturated, or aryl ring having 0-4 heteroatoms independently selected from nitrogen, oxygen, or sulfur.

Oral: The phrases "oral administration" and "administered orally" as used herein have their art-understood meaning referring to administration by mouth of a compound or composition.

Parenteral: The phrases "parenteral administration" and "administered parenterally" as used herein have their art-understood meaning referring to modes of administration other than enteral and topical administration, usually by injection, and include, without limitation, intravenous, intramuscular, intraarterial, intrathecal, intracapsular, intraorbital, intracardiac, intradermal, intraperitoneal, transtracheal, subcutaneous, subcuticular, intraarticulare, subcapsular, subarachnoid, intraspinal, and intrasternal injection and infusion.

Partially unsaturated: As used herein, the term "partially unsaturated" refers to a ring moiety that includes at least one double or triple bond. The term "partially unsaturated" is intended to encompass rings having multiple sites of unsaturation, but is not intended to include aryl or heteroaryl moieties, as herein defined.

Pharmaceutical composition: As used herein, the term "pharmaceutical composition" refers to an active agent, formulated together with one or more pharmaceutically acceptable carriers. In some embodiments, active agent is present in unit dose amount appropriate for administration in a therapeutic regimen that shows a statistically significant probability of achieving a controlled therapeutic effect when administered to a relevant population. In some embodiments, pharmaceutical compositions may be specially formulated for administration in solid or liquid form, including those adapted for the following: oral administration, for example, drenches (aqueous or non-aqueous solutions or suspensions), tablets, e.g., those targeted for buccal, sublingual, and systemic absorption, boluses, powders, granules, pastes for application to the tongue; parenteral administration, for example, by subcutaneous, intramuscular, intravenous or epidural injection as, for example, a sterile solution or suspension, or sustained-release formulation; topical application, for example, as a cream, ointment, or a controlled-release patch or spray applied to the skin, lungs, or oral cavity; intravaginally or intrarectally, for example, as a pessary, cream, or foam; sublingually; ocularly; transdermally; or nasally, pulmonary, and to other mucosal surfaces.

Pharmaceutically acceptable: As used herein, the phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable carrier: As used herein, the term "pharmaceutically acceptable carrier" means a pharmaceutically-acceptable material, composition or vehicle, such as a liquid or solid filler, diluent, excipient, or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; pH buffered solutions; polyesters, polycarbonates and/or polyanhydrides; and other non-toxic compatible substances employed in pharmaceutical formulations.

Pharmaceutically acceptable salt: The term "pharmaceutically acceptable salt", as used herein, refers to salts of such compounds that are appropriate for use in pharmaceutical contexts, i.e., salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, S. M. Berge, et al. describes pharmaceutically acceptable salts in detail in J. Pharmaceutical Sciences, 66:1-19 (1977). In some embodiments, pharmaceutically acceptable salts include, but are not limited to, nontoxic acid addition salts, which are salts of an amino group formed with inorganic acids such as hydrochloric acid, hydrobromic acid, phosphoric acid, sulfuric acid and perchloric acid or with organic acids such as acetic acid, maleic acid, tartaric acid, citric acid, succinic acid or malonic acid or by using other methods used in the art such as ion exchange. In some embodiments, pharmaceutically acceptable salts include, but are not limited to, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. In some embodiments, pharmaceutically acceptable salts include, when appropriate, nontoxic ammonium, quaternary ammonium, and amine cations formed using counterions such as halide, hydroxide, carboxylate, sulfate, phosphate, nitrate, alkyl having from 1 to 6 carbon atoms, sulfonate and aryl sulfonate. In some embodiments, a provided compound comprises one or more acidic groups, e.g., an oligonucleotide, and a pharmaceutically acceptable salt is an alkali, alkaline earth metal, or ammonium (e.g., an ammonium salt of $N(R)_3$, wherein each R is independently as defined and described in the present disclosure) salt. Representative alkali or alkaline earth metal salts include salts of sodium, lithium, potassium, calcium, magnesium, and the like. In some embodiments, a pharmaceutically acceptable salt is a sodium salt. In some embodiments, a pharmaceutically acceptable salt is a potassium salt. In some embodiments, a pharmaceutically acceptable salt is a calcium salt. In some embodiments, pharmaceutically acceptable salts include, when appropriate, nontoxic ammonium, quaternary ammonium, and amine cations formed using counterions such as halide, hydroxide, carboxylate, sulfate, phosphate, nitrate, alkyl having from 1 to 6 carbon atoms, sulfonate and aryl sulfonate. In some embodiments, a provided compound comprises more than one acid groups, for example, a provided oligonucleotide may comprise two or more acidic groups (e.g., in natural phosphate linkages and/or modified internucleotidic linkages). In some embodiments, a pharmaceutically acceptable salt, or generally a salt, of such a compound comprises two or more cations, which can be the same or different. In some embodiments, in a pharmaceutically acceptable salt (or generally, a salt), each acidic group having sufficient acidity independently exists as its salt form (e.g., in an oligonucleotide comprising natural phosphate linkages and phosphorothioate internucleotidic linkages, each of the natural phosphate linkages and phosphorothioate internucleotidic linkages independently exists as its salt form). In some embodiments, a pharmaceutically acceptable salt of an oligonucleotide is a sodium salt of a provided oligonucleotide. In some embodiments, a pharmaceutically acceptable salt of an oligonucleotide is a sodium salt of a provided oligonucleotide, wherein each acidic linkage, e.g., each natural phosphate linkage and phosphorothioate internucleotidic linkage, exists as a sodium salt form (all sodium salt).

Protecting group: The term "protecting group," as used herein, is well known in the art and includes those described in detail in *Protecting Groups in Organic Synthesis*, T. W. Greene and P. G. M. Wuts, 3$^{rd}$ edition, John Wiley & Sons, 1999, the entirety of which is incorporated herein by reference. Also included are those protecting groups specially adapted for nucleoside and nucleotide chemistry, e.g., those described in *Current Protocols in Nucleic Acid Chemistry*, edited by Serge L. Beaucage et al. June 2012, the entirety of Chapter 2 is incorporated herein by reference. Suitable amino-protecting groups include methyl 1 carbamate, ethyl carbamante, 9-fluorenylmethyl carbamate (Fmoc), 9-(2-sulfo) fluorenylmethyl carbamate, 9-(2,7-dibromo)fluoroenylmethyl carbamate, 2,7-di-t-butyl-[9-(10,10-dioxo-10,10,10,10-tetrahydrothioxanthyl)]methyl carbamate (DBD-Tmoc), 4-methoxyphenacyl carbamate (Phenoc), 2,2,2-trichloroethyl carbamate (Troc), 2-trimethylsilylethyl carbamate (Teoc), 2-phenylethyl carbamate (hZ), 1-(1-adamantyl)-1-methylethyl carbamate (Adpoc), 1,1-dimethyl-2-haloethyl carbamate, 1,1-dimethyl-2,2-dibromoethyl carbamate (DB-t-BOC), 1,1-dimethyl-2,2,2-trichloroethyl carbamate (TCBOC), 1-methyl-1-(4-biphenylyl)ethyl carbamate (Bpoc), 1-(3,5-di-t-butylphenyl)-1-methylethyl carbamate (t-Bumeoc), 2-(2'- and 4'-pyridyl)ethyl carbamate (Pyoc), 2-(N,N-dicyclohexylcarboxamido)ethyl carbamate, t-butyl carbamate (BOC), 1-adamantyl carbamate (Adoc), vinyl carbamate (Voc), allyl carbamate (Alloc), 1-isopropylallyl carbamate (Ipaoc), cinnamyl carbamate (Coc), 4-nitrocinnamyl carbamate (Noc), 8-quinolyl carbamate, N-hydroxypiperidinyl carbamate, alkyldithio carbamate, benzyl carbamate (Cbz), p-methoxybenzyl carbamate (Moz), p-nitobenzyl carbamate, p-bromobenzyl carbamate, p-chlorobenzyl carbamate, 2,4-dichlorobenzyl carbamate, 4-methylsulfinylbenzyl carbamate (Msz), 9-anthrylmethyl carbamate, diphenylmethyl carbamate, 2-methylthioethyl carbamate, 2-methylsulfonylethyl carbamate, 2-(p-toluenesulfonyl)ethyl carbamate, [2-(1,3-dithianyl)]methyl carbamate (Dmoc), 4-methylthiophenyl carbamate (Mtpc), 2,4-dimethylthiophenyl carbamate (Bmpc), 2-phosphonioethyl carbamate (Peoc), 2-triphenylphosphonioisopropyl carbamate (Ppoc), 1,1-dimethyl-2-cyanoethyl carbamate, m-chloro-p-acyloxybenzyl carbamate, p-(dihydroxyboryl)benzyl carbamate, 5-benzisoxazolylmethyl carbamate, 2-(trifluoromethyl)-6-chromonylmethyl carbamate (Tcroc), m-nitrophenyl carbamate, 3,5-dimethoxybenzyl carbamate, o-nitrobenzyl carbamate, 3,4-dimethoxy-6-nitrobenzyl carbamate, phenyl(o-nitrophenyl)methyl carbamate, phenothiazinyl-(10)-carbonyl derivative, N'-p-toluenesulfonylaminocarbonyl derivative, N'-phenylaminothiocarbonyl derivative, t-amyl carbamate, S-benzyl thiocarbamate, p-cyanobenzyl carbamate, cyclobutyl carbamate, cyclohexyl carbamate, cyclopentyl carbamate, cyclopropylmethyl carbamate, p-decyloxybenzyl carbamate, 2,2-dimethoxycarbonylvinyl carbamate, o-(N,N-dimethylcarboxamido)benzyl carbamate, 1,1-dimethyl-3-(N,N-dimethylcarboxamido) propyl carbamate, 1,1-dimethylpropynyl carbamate, di(2-pyridyl)methyl carbamate, 2-furanylmethyl carbamate, 2-iodoethyl carbamate, isoborynl carbamate, isobutyl carbamate, isonicotinyl carbamate, p-(p'-methoxyphenylazo)benzyl carbamate, 1-methylcyclobutyl carbamate, 1-methylcyclohexyl carbamate, 1-methyl-1-cyclopropylmethyl carbamate, 1-methyl-1-(3,5-dimethoxyphenyl)ethyl carbamate, 1-methyl-1-(p-phenylazophenyl)ethyl carbamate, 1-methyl-1-phenylethyl carbamate, 1-methyl-1-(4-pyridyl)ethyl carbamate, phenyl carbamate, p-(phenylazo)benzyl carbamate, 2,4,6-tri-t-butylphenyl carbamate, 4-(trimethylammonium) benzyl carbamate, 2,4,6-trimethylbenzyl carbamate, formamide, acetamide, chloroacetamide, trichloroacetamide, trifluoroacetamide, phenylacetamide, 3-phenylpropanamide, picolinamide, 3-pyridylcarboxamide, N-benzoylphenylalanyl derivative, benzamide, p-phenylbenzamide, o-nitrophenylacetamide, o-nitrophenoxyacetamide, acetoacetamide, (N'-dithiobenzyloxycarbonylamino)acetamide, 3-(p-hydroxyphenyl)propanamide, 3-(o-nitrophenyl)propanamide, 2-methyl-2-(o-nitrophenoxy)propanamide, 2-methyl-2-(o-phenylazophenoxy)propanamide, 4-chlorobutanamide, 3-methyl-3-nitrobutanamide, o-nitrocinnamide, N-acetylmethionine derivative, o-nitrobenzamide, o-(benzoyloxymethyl)benzamide, 4,5-diphenyl-3-oxazolin-2-one, N-phthalimide, N-dithiasuccinimide (Dts), N-2,3-diphenylmaleimide, N-2,5-dimethylpyrrole, N-1,1,4,4-tetramethyldisilylazacyclopentane adduct (STABASE), 5-substituted 1,3-dimethyl-1,3,5-triazacyclohexan-2-one, 5-substituted 1,3-dibenzyl-1,3,5-triazacyclohexan-2-one, 1-substituted 3,5-dinitro-4-pyridone, N-methylamine, N-allylamine, N-[2-(trimethylsilyl)ethoxy]methylamine (SEM), N-3-acetoxypropylamine, N(1-isopropyl-4-nitro-2-oxo-3-pyroolin-3-yl)amine, quaternary ammonium salts, N-benzylamine, N-di(4-methoxyphenyl)methylamine, N-5-dibenzosuberylamine, N-triphenylmethylamine (Tr), N-[(4-methoxyphenyl)diphenylmethyl]amine (MMTr), N-9-phenylfluorenylamine (PhF), N-2,7-dichloro-9-fluorenylmethyleneamine, N-ferrocenylmethylamino (Fcm), N-2-picolylamino N'-oxide, N-1,1-dimethylthiomethyleneamine, N-benzylideneamine, N-p-methoxybenzylideneamine, N-diphenylmethyleneamine, N-[(2-pyridyl)mesityl]methyleneamine, N—(N',N'-dimethylaminomethylene) amine, N,N'-isopropylidenediamine, N-p-nitrobenzylideneamine, N-salicylideneamine, N-5-chlorosalicylideneamine, N-(5-chloro-2-hydroxyphenyl) phenylmethyleneamine, N-cyclohexylideneamine, N-(5,5-dimethyl-3-oxo-1-cyclohexenyl)amine, N-borane derivative, N-diphenylborinic acid derivative, N-[phenyl (pentacarbonylchromium- or tungsten)carbonyl]amine, N-copper chelate, N-zinc chelate, N-nitroamine, N-nitrosoamine, amine N-oxide, diphenylphosphinamide (Dpp), dimethylthiophosphinamide (Mpt), diphenylthiophosphinamide (Ppt), dialkyl phosphoramidates, dibenzyl phosphoramidate, diphenyl phosphoramidate, benzenesulfenamide, 0-nitrobenzenesulfenamide (Nps), 2,4-dinitrobenzenesulfenamide, pentachlorobenzenesulfenamide, 2-nitro-4-methoxybenzenesulfenamide, triphenylmethylsulfenamide, 3-nitropyridinesulfenamide (Npys), p-toluenesulfonamide (Ts), benzenesulfonamide, 2,3,6, -trimethyl-4-methoxybenzenesulfonamide (Mtr), 2,4,6-trimethoxybenzenesulfonamide (Mtb), 2,6-dimethyl-4-methoxybenzenesulfonamide (Pme), 2,3,5,6-tetramethyl-4-methoxybenzenesulfonamide (Mte), 4-methoxybenzenesulfonamide (Mbs), 2,4,6-trimethylbenzenesulfonamide (Mts), 2,6-dimethoxy-4-methylbenzenesulfonamide (iMds), 2,2,5,7,8-pentamethylchroman-6-sulfonamide (Pmc), methanesulfonamide (Ms), β-trimethylsilylethanesulfonamide (SES), 9-anthracenesulfonamide, 4-(4',8'-dimethoxynaphthylmethyl)benzenesulfonamide (DNMBS), benzylsulfonamide, trifluoromethylsulfonamide, and phenacylsulfonamide.

Suitably protected carboxylic acids further include, but are not limited to, silyl-, alkyl-, alkenyl-, aryl-, and arylalkyl-protected carboxylic acids. Examples of suitable silyl groups include trimethylsilyl, triethylsilyl, t-butyldimethylsilyl, t-butyldiphenylsilyl, triisopropylsilyl, and the like. Examples of suitable alkyl groups include methyl, benzyl, p-methoxybenzyl, 3,4-dimethoxybenzyl, trityl, t-butyl, tetrahydropyran-2-yl. Examples of suitable alkenyl groups include allyl. Examples of suitable aryl groups include optionally substituted phenyl, biphenyl, or naphthyl. Examples of suitable arylalkyl groups include optionally substituted benzyl (e.g., p-methoxybenzyl (MPM), 3,4-dimethoxybenzyl, O-nitrobenzyl, p-nitrobenzyl, p-halobenzyl, 2,6-dichlorobenzyl, p-cyanobenzyl), and 2- and 4-picolyl.

Suitable hydroxyl protecting groups include methyl, methoxylmethyl (MOM), methylthiomethyl (MTM), t-butylthiomethyl, (phenyldimethylsilyl) methoxymethyl (SMOM), benzyloxymethyl (BOM), p-methoxybenzyloxymethyl (PMBM), (4-methoxyphenoxy)methyl (p-AOM), guaiacolmethyl (GUM), t-butoxymethyl, 4-pentenyloxymethyl (POM), siloxymethyl, 2-methoxyethoxymethyl (MEM), 2,2,2-trichloroethoxymethyl, bis(2-chloroethoxy)methyl, 2-(trimethylsilyl)ethoxymethyl (SEMOR), tetrahydropyranyl (THP), 3-bromotetrahydropyranyl, tetrahydrothiopyranyl, 1-methoxycyclohexyl, 4-methoxytetrahydropyranyl (MTHP), 4-methoxytetrahydrothiopyranyl, 4-methoxytetrahydrothiopyranyl S,S-dioxide, 1-[(2-chloro-4-methyl)phenyl]-4-methoxypiperidin-4-yl (CTMP), 1,4-dioxan-2-yl, tetrahydrofuranyl, tetrahydrothiofuranyl, 2,3,3a, 4,5,6,7,7a-octahydro-7,8,8-trimethyl-4,7-methanobenzofuran-2-yl, 1-ethoxyethyl, 1-(2-chloroethoxy) ethyl, 1-methyl-1-methoxyethyl, 1-methyl-1-benzyloxyethyl, 1-methyl-1-benzyloxy-2-fluoroethyl, 2,2,2-trichloroethyl, 2-trimethylsilylethyl, 2-(phenylselenyl)ethyl, t-butyl, allyl, p-chlorophenyl, p-methoxyphenyl, 2,4-dinitrophenyl, benzyl, p-methoxybenzyl, 3,4-dimethoxybenzyl, o-nitrobenzyl, p-nitrobenzyl, p-halobenzyl, 2,6-dichlorobenzyl, p-cyanobenzyl, p-phenylbenzyl, 2-picolyl, 4-picolyl, 3-methyl-2-picolyl N-oxido, diphenylmethyl, p,p'-dinitrobenzhydryl, 5-dibenzosuberyl, triphenylmethyl, α-naphthyldiphenylmethyl, p-methoxyphenyldiphenylmethyl, di(p-methoxyphenyl)phenylmethyl, tri(p-methoxyphenyl)methyl, 4-(4'-bromophenacyloxyphenyl)diphenylmethyl, 4,4',4"-tris(4,5-dichlorophthalimidophenyl)methyl, 4,4',4"-tris(levulinoyloxyphenyl)methyl, 4,4',4"-tris(benzoyloxyphenyl)methyl, 3-(imidazol-1-yl)bis(4',4"-dimethoxyphenyl)methyl, 1,1-bis(4-methoxyphenyl)-1'-pyrenylmethyl, 9-anthryl, 9-(9-phenyl)xanthenyl, 9-(9-phenyl-10-oxo)anthryl, 1,3-benzodithiolan-2-yl, benzisothiazolyl S,S-dioxido, trimethylsilyl (TMS), triethylsilyl (TES), triisopropylsilyl (TIPS), dimethylisopropylsilyl (IPDMS), diethylisopropylsilyl (DEIPS), dimethylthexylsilyl, t-butyldimethylsilyl (TBDMS), t-butyldiphenylsilyl (TBDPS), tribenzylsilyl, tri-p-xylylsilyl, triphenylsilyl, diphenylmethylsilyl (DPMS), -butylmethoxyphenylsilyl (TBMPS), formate, benzoylformate, acetate, chloroacetate, dichloroacetate, trichloroacetate, trifluoroacetate, methoxyacetate, triphenylmethoxyacetate, phenoxyacetate, p-chlorophenoxyacetate, 3-phenylpropionate, 4-oxopentanoate (levulinate), 4,4-(ethylenedithio) pentanoate (levulinoyldithioacetal), pivaloate, adamantoate, crotonate, 4-methoxycrotonate, benzoate, p-phenylbenzoate, 2,4,6-trimethylbenzoate (mesitoate), alkyl methyl carbonate, 9-fluorenylmethyl carbonate (Fmoc), alkyl ethyl carbonate, alkyl 2,2,2-trichloroethyl carbonate (Troc), 2-(trimethylsilyl)ethyl carbonate (TMSEC), 2-(phenylsulfonyl)ethyl carbonate (Psec), 2-(triphenylphosphonio)ethyl carbonate (Peoc), alkyl isobutyl carbonate, alkyl vinyl carbonate alkyl allyl carbonate, alkyl p-nitrophenyl carbonate, alkyl benzyl carbonate, alkyl p-methoxybenzyl carbonate, alkyl 3,4-dimethoxybenzyl carbonate, alkyl o-nitrobenzyl carbonate, alkyl p-nitrobenzyl carbonate, alkyl S-benzyl thiocarbonate, 4-ethoxy-1-napththyl carbonate, methyl dithiocarbonate, 2-iodobenzoate, 4-azidobutyrate, 4-nitro-4-methylpentanoate, o-(dibromomethyl)benzoate, 2-formylbenzenesulfonate, 2-(methylthiomethoxy)ethyl, 4-(methylthiomethoxy) butyrate, 2-(methylthiomethoxymethyl)benzoate, 2,6-dichloro-4-methylphenoxyacetate, 2,6-dichloro-4-(1,1,3,3-tetramethylbutyl) phenoxyacetate, 2,4-bis(1,1-dimethylpropyl) phenoxyacetate, chlorodiphenylacetate, isobutyrate, monosuccinoate, (E)-2-methyl-2-butenoate, o-(methoxycarbonyl)benzoate, α-naphthoate, nitrate, alkyl N,N,N',N'-tetramethylphosphorodiamidate, alkyl N-phenylcarbamate, borate, dimethylphosphinothioyl, alkyl 2,4-dinitrophenylsulfenate, sulfate, methanesulfonate (mesylate), benzylsulfonate, and tosylate (Ts). For protecting 1,2- or 1,3-diols, the protecting groups include methylene acetal, ethylidene acetal, 1-t-butylethylidene ketal, 1-phenylethylidene ketal, (4-methoxyphenyl)ethylidene acetal, 2,2,2-trichloroethylidene acetal, acetonide, cyclopentylidene ketal, cyclohexylidene ketal, cycloheptylidene ketal, benzylidene acetal, p-methoxybenzylidene acetal, 2,4-dimethoxybenzylidene ketal, 3,4-dimethoxybenzylidene acetal, 2-nitrobenzylidene acetal, methoxymethylene acetal, ethoxymethylene acetal, dimethoxymethylene ortho ester, 1-methoxyethylidene ortho ester, 1-ethoxyethylidine ortho ester, 1,2-dimethoxyethylidene ortho α-methoxybenzylidene ester, ortho ester, 1-(N,N-dimethylamino)ethylidene derivative, α-(N,N'-dimethylamino)benzylidene derivative, 2-oxacyclopentylidene ortho di-t-butylsilylene ester, group (DTBS), 1,3-(1,1,3,3-tetraisopropyldisiloxanylidene) derivative (TIPDS), tetra-t-butoxydisiloxane-1,3-diylidene derivative (TBDS), cyclic carbonates, cyclic boronates, ethyl boronate, and phenyl boronate.

In some embodiments, a hydroxyl protecting group is acetyl, t-butyl, tbutoxymethyl, methoxymethyl, tetrahydropyranyl, 1-ethoxyethyl, 1-(2-chloroethoxy)ethyl, 2-trimethylsilylethyl, p-chlorophenyl, 2,4-dinitrophenyl, benzyl, benzoyl, p-phenylbenzoyl, 2,6-dichlorobenzyl, diphenylmethyl, p-nitrobenzyl, triphenylmethyl (trityl), 4,4'-dimethoxytrityl, trimethylsilyl, triethylsilyl, t-butyldimethylsilyl, t-butyldiphenylsilyl, triphenylsilyl, triisopropylsilyl, benzoylformate, chloroacetyl, trichloroacetyl, trifiuoroacetyl, pivaloyl, 9-fluorenylmethyl carbonate, mesylate, tosylate, triflate, trityl, monomethoxytrityl (MMTr), 4,4'-dimethoxytrityl, (DMTr) and 4,4',4"-trimethoxytrityl (TMTr), 2-cyanoethyl (CE or Cne), 2-(trimethylsilyl)ethyl (TSE), 2-(2-nitrophenyl)ethyl, 2-(4-cyanophenyl)ethyl 2-(4-nitrophenyl)ethyl (NPE), 2-(4-nitrophenylsulfonyl)ethyl, 3,5-dichlorophenyl, 2,4-dimethylphenyl, 2-nitrophenyl, 4-nitrophenyl, 2,4,6-trimethylphenyl, 2-(2-nitrophenyl)ethyl, butylthiocarbonyl, 4,4',4"-tris(benzoyloxy)trityl, diphenylcarbamoyl, levulinyl, 2-(dibromomethyl)benzoyl (Dbmb), 2-(isopropylthiomethoxymethyl)benzoyl (Ptmt), 9-phenylxanthen-9-yl (pixyl) or 9-(p-methoxyphenyl)xanthine-9-yl (MOX). In some embodiments, each of the hydroxyl protecting groups is, independently selected from acetyl, benzyl, t-butyldimethylsilyl, t-butyldiphenylsilyl and 4,4'-dimethoxytrityl. In some embodiments, the hydroxyl protecting group is selected from the group consisting of trityl, monomethoxytrityl and 4,4'-dimethoxytrityl group.

In some embodiments, a phosphorous protecting group is a group attached to the internucleotide phosphorous linkage throughout oligonucleotide synthesis. In some embodiments, the phosphorous protecting group is attached to the sulfur atom of the internucleotide phosphorothioate linkage. In some embodiments, the phosphorous protecting group is attached to the oxygen atom of the internucleotide phosphorothioate linkage. In some embodiments, the phosphorous protecting group is attached to the oxygen atom of the internucleotide phosphate linkage. In some embodiments the phosphorous protecting group is 2-cyanoethyl (CE or Cne), 2-trimethylsilylethyl, 2-nitroethyl, 2-sulfonylethyl, methyl, benzyl, o-nitrobenzyl, 2-(p-nitrophenyl)ethyl (NPE or Npe), 2-phenylethyl, 3-(N-tert-butylcarboxamido)-1-propyl, 4-oxopentyl, 4-methylthio-1-butyl, 2-cyano-1,1-dimethylethyl, 4-N-methylaminobutyl, 3-(2-pyridyl)-1-propyl, 2-[N-methyl-N-(2-pyridyl)]aminoethyl, 2-(N-formyl,N-methyl) aminoethyl, 4-[N-methyl-N-(2,2,2-trifluoroacetyl)amino] butyl.

Protein: As used herein, the term “protein” refers to a polypeptide (i.e., a string of at least two amino acids linked to one another by peptide bonds). In some embodiments, proteins include only naturally-occurring amino acids. In some embodiments, proteins include one or more non-naturally-occurring amino acids (e.g., moieties that form one or more peptide bonds with adjacent amino acids). In some embodiments, one or more residues in a protein chain contain a non-amino-acid moiety (e.g., a glycan, etc). In some embodiments, a protein includes more than one polypeptide chain, for example linked by one or more disulfide bonds or associated by other means. In some embodiments, proteins contain L-amino acids, D-amino acids, or both; in some embodiments, proteins contain one or more amino acid modifications or analogs known in the art. Useful modifications include, e.g., terminal acetylation, amidation, methylation, etc. The term “peptide” is generally used to refer to a polypeptide having a length of less than about 100 amino acids, less than about 50 amino acids, less than 20 amino acids, or less than 10 amino acids.

Subject: As used herein, the term “subject” or “test subject” refers to any organism to which a provided compound or composition is administered in accordance with the present disclosure e.g., for experimental, diagnostic, prophylactic, and/or therapeutic purposes. Typical subjects include animals (e.g., mammals such as mice, rats, rabbits, non-human primates, and humans; insects; worms; etc.) and plants. In some embodiments, a subject may be suffering from, and/or susceptible to a disease, disorder, and/or condition.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and/or chemical phenomena.

Suffering from: An individual who is "suffering from" a disease, disorder, and/or condition has been diagnosed with and/or displays one or more symptoms of a disease, disorder, and/or condition.

Susceptible to: An individual who is "susceptible to" a disease, disorder, and/or condition is one who has a higher risk of developing the disease, disorder, and/or condition than does a member of the general public. In some embodiments, an individual who is susceptible to a disease, disorder and/or condition may not have been diagnosed with the disease, disorder, and/or condition. In some embodiments, an individual who is susceptible to a disease, disorder, and/or condition may exhibit symptoms of the disease, disorder, and/or condition. In some embodiments, an individual who is susceptible to a disease, disorder, and/or condition may not exhibit symptoms of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Systemic: The phrases "systemic administration," "administered systemically," "peripheral administration," and "administered peripherally" as used herein have their art-understood meaning referring to administration of a compound or composition such that it enters the recipient's system.

Tautomeric forms: The phrase "tautomeric forms," as used herein and generally understood in the art, is used to describe different isomeric forms of organic compounds that are capable of facile interconversion. Tautomers may be characterized by the formal migration of a hydrogen atom or proton, accompanied by a switch of a single bond and adjacent double bond. In some embodiments, tautomers may result from prototropic tautomerism (i.e., the relocation of a proton). In some embodiments, tautomers may result from valence tautomerism (i.e., the rapid reorganization of bonding electrons). All such tautomeric forms are intended to be included within the scope of the present disclosure. In some embodiments, tautomeric forms of a compound exist in mobile equilibrium with each other, so that attempts to prepare the separate substances results in the formation of a mixture. In some embodiments, tautomeric forms of a compound are separable and isolatable compounds. In some embodiments of the disclosure, chemical compositions may be provided that are or include pure preparations of a single tautomeric form of a compound. In some embodiments of the disclosure, chemical compositions may be provided as mixtures of two or more tautomeric forms of a compound. In certain embodiments, such mixtures contain equal amounts of different tautomeric forms; in certain embodiments, such mixtures contain different amounts of at least two different tautomeric forms of a compound. In some embodiments of the disclosure, chemical compositions may contain all tautomeric forms of a compound. In some embodiments of the disclosure, chemical compositions may contain less than all tautomeric forms of a compound. In some embodiments of the disclosure, chemical compositions may contain one or more tautomeric forms of a compound in amounts that vary over time as a result of interconversion. In some embodiments of the disclosure, the tautomerism is keto-enol tautomerism. One of skill in the chemical arts would recognize that a keto-enol tautomer can be "trapped" (i.e., chemically modified such that it remains in the "enol" form) using any suitable reagent known in the chemical arts in to provide an enol derivative that may subsequently be isolated using one or more suitable techniques known in the art. Unless otherwise indicated, the present disclosure encompasses all tautomeric forms of relevant compounds, whether in pure form or in admixture with one another.

Therapeutic agent: As used herein, the phrase "therapeutic agent" refers to any agent that, when administered to a subject, has a therapeutic effect and/or elicits a desired biological and/or pharmacological effect. In some embodiments, a therapeutic agent is any substance that can be used to alleviate, ameliorate, relieve, inhibit, prevent, delay onset of, reduce severity of, and/or reduce incidence of one or more symptoms or features of a disease, disorder, and/or condition.

Therapeutically effective amount: As used herein, the term "therapeutically effective amount" means an amount of a substance (e.g., a therapeutic agent, composition, and/or formulation) that elicits a desired biological response when administered as part of a therapeutic regimen. In some embodiments, a therapeutically effective amount of a substance is an amount that is sufficient, when administered to a subject suffering from or susceptible to a disease, disorder, and/or condition, to treat, diagnose, prevent, and/or delay the onset of the disease, disorder, and/or condition. As will be appreciated by those of ordinary skill in this art, the effective amount of a substance may vary depending on such factors as the desired biological endpoint, the substance to be delivered, the target cell or tissue, etc. For example, the effective amount of compound in a formulation to treat a disease, disorder, and/or condition is the amount that alleviates, ameliorates, relieves, inhibits, prevents, delays onset of, reduces severity of and/or reduces incidence of one or more symptoms or features of the disease, disorder, and/or condition. In some embodiments, a therapeutically effective amount is administered in a single dose; in some embodiments, multiple unit doses are required to deliver a therapeutically effective amount.

Treat: As used herein, the term "treat," "treatment," or "treating" refers to any method used to partially or completely alleviate, ameliorate, relieve, inhibit, prevent, delay onset of, reduce severity of, and/or reduce incidence of one or more symptoms or features of a disease, disorder, and/or condition. Treatment may be administered to a subject who does not exhibit signs of a disease, disorder, and/or condition. In some embodiments, treatment may be administered to a subject who exhibits only early signs of the disease, disorder, and/or condition, for example for the purpose of decreasing the risk of developing pathology associated with the disease, disorder, and/or condition.

Unit dose: The expression "unit dose" as used herein refers to an amount administered as a single dose and/or in a physically discrete unit of a pharmaceutical composition. In many embodiments, a unit dose contains a predetermined quantity of an active agent. In some embodiments, a unit dose contains an entire single dose of the agent. In some embodiments, more than one unit dose is administered to achieve a total single dose. In some embodiments, administration of multiple unit doses is required, or expected to be required, in order to achieve an intended effect. A unit dose may be, for example, a volume of liquid (e.g., an acceptable carrier) containing a predetermined quantity of one or more therapeutic agents, a predetermined amount of one or more therapeutic agents in solid form, a sustained release formulation or drug delivery device containing a predetermined amount of one or more therapeutic agents, etc. It will be appreciated that a unit dose may be present in a formulation that includes any of a variety of components in addition to the therapeutic agent(s). For example, acceptable carriers (e.g., pharmaceutically acceptable carriers), diluents, stabilizers, buffers, preservatives, etc., may be included as described infra. It will be appreciated by those skilled in the art, in many embodiments, a total appropriate daily dosage of a particular therapeutic agent may comprise a portion, or a plurality, of unit doses, and may be decided, for example, by the attending physician within the scope of sound medical judgment. In some embodiments, the specific effective dose level for any particular subject or organism may depend upon a variety of factors including the disorder being treated and the severity of the disorder; activity of specific active compound employed; specific composition employed; age, body weight, general health, sex and diet of the subject; time of administration, and rate of excretion of the specific active compound employed; duration of the treatment; drugs and/or additional therapies used in combination or coincidental with specific compound(s) employed, and like factors well known in the medical arts.

Unsaturated: The term "unsaturated," as used herein, means that a moiety has one or more units of unsaturation.

Wild-type: As used herein, the term "wild-type" has its art-understood meaning that refers to an entity having a structure and/or activity as found in nature in a "normal" (as contrasted with mutant, diseased, altered, etc) state or context. Those of ordinary skill in the art will appreciate that wild type genes and polypeptides often exist in multiple different forms (e.g., alleles).

Nucleic acid: The term "nucleic acid" includes any nucleotides, analogs thereof, and polymers thereof. The term "polynucleotide" as used herein refer to a polymeric form of nucleotides of any length, either ribonucleotides (RNA) or deoxyribonucleotides (DNA) or analogs thereof. These terms refer to the primary structure of the molecules and include double- and single-stranded DNA, and double- and single-stranded RNA. These terms include, as equivalents, analogs of either RNA or DNA made from nucleotide analogs and modified polynucleotides such as, though not limited to, methylated, protected and/or capped nucleotides or polynucleotides. The terms encompass poly- or oligo-ribonucleotides (RNA) and poly- or oligo-deoxyribonucleotides (DNA); RNA or DNA derived from N-glycosides or C-glycosides of nucleobases and/or modified nucleobases; nucleic acids derived from sugars and/or modified sugars; and nucleic acids derived from phosphate bridges and/or modified phosphorus-atom bridges (also referred to herein as "internucleotidic linkages"). The term encompasses nucleic acids containing any combinations of nucleobases, modified nucleobases, sugars, modified sugars, natural natural phosphate internucleotidic linkages or non-natural internucleotidic linkages. Examples include, and are not limited to, nucleic acids containing ribose moieties, nucleic acids containing deoxy-ribose moieties, nucleic acids containing both ribose and deoxyribose moieties, nucleic acids containing ribose and modified ribose moieties. Unless otherwise specified, the prefix poly-refers to a nucleic acid containing 2 to about 10,000 nucleotide monomer units and wherein the prefix oligo-refers to a nucleic acid containing 2 to about 200 nucleotide monomer units.

Nucleotide: The term "nucleotide" as used herein refers to a monomeric unit of a polynucleotide that consists of a heterocyclic base, a sugar, and one or more phosphate groups or phosphorus-containing internucleotidic linkages. Naturally occurring bases, (guanine, (G), adenine, (A), cytosine, (C), thymine, (T), and uracil (U)) are derivatives of purine or pyrimidine, though it should be understood that naturally and non-naturally occurring base analogs are also included. Naturally occurring sugars include the pentose (five-carbon sugar) deoxyribose (which is found in natural DNA) or ribose (which is found in natural RNA), though it should be understood that naturally and non-naturally occurring sugar analogs are also included, such as sugars with 2'-modifications, sugars in locked nucleic acid (LNA) and phosphorodiamidate morpholino oligomer (PMO). Nucleotides are linked via internucleotidic linkages to form nucleic acids, or polynucleotides. Many internucleotidic linkages are known in the art (such as, though not limited to, natural phosphate linkage, phosphorothioate linkages, boranophosphate linkages and the like). Artificial nucleic acids include PNAs (peptide nucleic acids), phosphotriesters, phosphorothionates, H-phosphonates, phosphoramidates, boranophosphates, methylphosphonates, phosphonoacetates, thiophosphonoacetates and other variants of the phosphate backbone of native nucleic acids, etc. In some embodiments, a nucleotide is a natural nucleotide comprising a naturally occurring nucleobase, a natural occurring sugar and the natural phosphate linkage. In some embodiments, a nucleotide is a modified nucleotide or a nucleotide analog, which is a structural analog that can be used in lieu of a natural nucleotide.

Modified nucleotide: The term "modified nucleotide" includes any chemical moiety which differs structurally from a natural nucleotide but is capable of performing at least one function of a natural nucleotide. In some embodiments, a modified nucleotide comprises a modification at a sugar, base and/or internucleotidic linkage. In some embodiments, a modified nucleotide comprises a modified sugar, modified nucleobase and/or modified internucleotidic linkage. In some embodiments, a modified nucleotide is capable of at least one function of a nucleotide, e.g., forming a subunit in a polymer capable of base-pairing to a nucleic acid comprising an at least complementary sequence of bases.

Analog: The term "analog" includes any chemical moiety which differs structurally from a reference chemical moiety or class of moieties, but which is capable of performing at least one function of such a reference chemical moiety or class of moieties. As non-limiting examples, a nucleotide analog differs structurally from a nucleotide but performs at least one function of a nucleotide; a nucleobase analog differs structurally from a nucleobase but performs at least one function of a nucleobase; a sugar analog differs structurally from a nucleobase but performs at least one function of a sugar, etc.

Nucleoside: The term "nucleoside" refers to a moiety wherein a nucleobase or a modified nucleobase is covalently bound to a sugar or modified sugar.

Modified nucleoside: The term "modified nucleoside" refers to a chemical moiety which is chemically distinct from a natural nucleoside, but which is capable of performing at least one function of a nucleoside. In some embodiments, a modified nucleoside is derived from or chemically similar to a natural nucleoside, but which comprises a chemical modification which differentiates it from a natural nucleoside. Non-limiting examples of modified nucleosides include those which comprise a modification at the base and/or the sugar. Non-limiting examples of modified nucleosides include those with a 2'-modification at a sugar. Non-limiting examples of modified nucleosides also include abasic nucleosides (which lack a nucleobase). In some embodiments, a modified nucleoside is capable of at least one function of a nucleoside, e.g., forming a moiety in a polymer capable of base-pairing to a nucleic acid comprising an at least complementary sequence of bases.

Nucleoside analog: The term "nucleoside analog" refers to a chemical moiety which is chemically distinct from a natural nucleoside, but which is capable of performing at least one function of a nucleoside. In some embodiments, a nucleoside analog comprises an analog of a sugar and/or an analog of a nucleobase. In some embodiments, a modified nucleoside is capable of at least one function of a nucleoside, e.g., forming a moiety in a polymer capable of base-pairing to a nucleic acid comprising a complementary sequence of bases.

Sugar: The term "sugar" refers to a monosaccharide or polysaccharide in closed and/or open form. In some embodiments, sugars are monosaccharides. In some embodiments, sugars are polysaccharides. Sugars include, but are not limited to, ribose, deoxyribose, pentofuranose, pentopyranose, and hexopyranose moieties. As used herein, the term "sugar" also encompasses structural analogs used in lieu of conventional sugar molecules, such as glycol, polymer of which forms the backbone of the nucleic acid analog, glycol nucleic acid ("GNA"), etc. As used herein, the term "sugar" also encompasses structural analogs used in lieu of natural or naturally-occurring nucleotides, such as modified sugars and nucleotide sugars. In some embodiments, a sugar is D-2-deoxyribose. In some embodiments, a sugar is beta-D-deoxyribofuranose. In some embodiments, a sugar moiety is a beta-D-deoxyribofuranose moiety. In some embodiments, a sugar is D-ribose. In some embodiments, a sugar is beta-D-ribofuranose. In some embodiments, a sugar moiety is a beta-D-ribofuranose moiety. In some embodiments, a sugar is optionally substituted beta-D-deoxyribofuranose or beta-D-ribofuranose. In some embodiments, a sugar moiety is an optionally substituted beta-D-deoxyribofuranose or beta-D-ribofuranose moiety. In some embodiments, a sugar moiety/unit in an oligonucleotide, nucleic acid, etc. is a sugar which comprises one or more carbon atoms each independently connected to an internucleotidic linkage, e.g., optionally substituted beta-D-deoxyribofuranose or beta-D-ribofuranose whose 5'-C and/or 3'-C are each independently connected to an internucleotidic linkage (e.g., a natural phosphate linkage, a modified internucleotidic linkage, a chirally controlled internucleotidic linkage, etc.).

Modified sugar: The term "modified sugar" refers to a moiety that can replace a sugar. A modified sugar mimics the spatial arrangement, electronic properties, or some other physicochemical property of a sugar. In some embodiments, a modified sugar is substituted beta-D-deoxyribofuranose or beta-D-ribofuranose. In some embodiments, a modified sugar comprises a 2'-modification. In some embodiments, a modified sugar comprises a linker (e.g., optionally substituted bivalent heteroaliphatic) connecting two sugar carbon atoms (e.g., C2 and C4), e.g., as found in LNA. In some embodiments, a linker is —O—CH(R)—, wherein R is as described in the present disclosure. In some embodiments, a linker is —O—CH(R)—, wherein O is connected to C2, and —CH(R)— is connected to C4 of a sugar, and R is as described in the present disclosure. In some embodiments, R is methyl. In some embodiments, R is —H. In some embodiments, —CH(R)— is of S configuration. In some embodiments, —CH(R)— is of R configuration.

Nucleobase: The term "nucleobase" refers to the parts of nucleic acids that are involved in the hydrogen-bonding that binds one nucleic acid strand to another complementary strand in a sequence specific manner. The most common naturally-occurring nucleobases are adenine (A), guanine (G), uracil (U), cytosine (C), and thymine (T). In some embodiments, a modified nucleobase is a substituted nucleobase which nucleobase is selected from A, T, C, G, U, and tautomers thereof. In some embodiments, the naturally-occurring nucleobases are modified adenine, guanine, uracil, cytosine, or thymine. In some embodiments, the naturally-occurring nucleobases are methylated adenine, guanine, uracil, cytosine, or thymine. In some embodiments, a nucleobase is a "modified nucleobase," e.g., a nucleobase other than adenine (A), guanine (G), uracil (U), cytosine (C), and thymine (T). In some embodiments, the modified nucleobases are methylated adenine, guanine, uracil, cytosine, or thymine. In some embodiments, the modified nucleobase mimics the spatial arrangement, electronic properties, or some other physicochemical property of the nucleobase and retains the property of hydrogen-bonding that binds one nucleic acid strand to another in a sequence specific manner. In some embodiments, a modified nucleobase can pair with all of the five naturally occurring bases (uracil, thymine, adenine, cytosine, or guanine) without substantially affecting the melting behavior, recognition by intracellular enzymes or activity of the oligonucleotide duplex. As used herein, the term "nucleobase" also encompasses structural analogs used in lieu of natural or naturally-occurring nucleotides, such as modified nucleobases and nucleobase analogs. In some embodiments, a nucleobase is an optionally substituted A, T, C, G, or U, or a substituted nucleobase which nucleobase is selected from A, T, C, G, U, and tautomers thereof.

Modified nucleobase: The terms "modified nucleobase", "modified base" and the like refer to a chemical moiety which is chemically distinct from a nucleobase, but which is capable of performing at least one function of a nucleobase. In some embodiments, a modified nucleobase is a nucleobase which comprises a modification. In some embodiments, a modified nucleobase is capable of at least one function of a nucleobase, e.g., forming a moiety in a polymer capable of base-pairing to a nucleic acid comprising an at least complementary sequence of bases. In some embodiments, a modified nucleobase is a substituted nucleobase which nucleobase is selected from A, T, C, G, U, and tautomers thereof.

Chiral ligand: The term "chiral ligand" or "chiral auxiliary" refers to a moiety that is chiral and can be incorporated into a reaction so that the reaction can be carried out with certain stereoselectivity. In some embodiments, the term may also refer to a compound that comprises such a moiety.

Blocking group: The term "blocking group" refers to a group that masks the reactivity of a functional group. The functional group can be subsequently unmasked by removal of the blocking group. In some embodiments, a blocking group is a protecting group.

Moiety: The term "moiety" refers to a specific segment or functional group of a molecule. Chemical moieties are often recognized chemical entities embedded in or appended to a molecule. In some embodiments, a moiety of a compound is a monovalent, bivalent, or polyvalent group formed from the compound by removing one or more —H and/or equivalents thereof from a compound. In some embodiments, depending on its context, "moiety" may also refer to a compound or entity from which the moiety is derived from.

Solid support: The term "solid support" when used in the context of preparation of nucleic acids, oligonucleotides, or other compounds refers to any support which enables synthesis of nucleic acids, oligonucleotides or other compounds. In some embodiments, the term refers to a glass or a polymer, that is insoluble in the media employed in the reaction steps performed to synthesize nucleic acids, and is derivatized to comprise reactive groups. In some embodiments, the solid support is Highly Cross-linked Polystyrene (HCP) or Controlled Pore Glass (CPG). In some embodiments, the solid support is Controlled Pore Glass (CPG). In some embodiments, the solid support is hybrid support of Controlled Pore Glass (CPG) and Highly Cross-linked Polystyrene (HCP).

Reading frame: The term "reading frame" refers to one of the six possible reading frames, three in each direction, of a double stranded DNA molecule. The reading frame that is used determines which codons are used to encode amino acids within the coding sequence of a DNA molecule.

Antisense: As used herein, an "antisense" nucleic acid molecule comprises a nucleotide sequence which is complementary to a "sense" nucleic acid encoding a protein, e.g., complementary to the coding strand of a double-stranded cDNA molecule, complementary to an mRNA sequence or complementary to the coding strand of a gene. Accordingly, an antisense nucleic acid molecule can associate via hydrogen bonds to a sense nucleic acid molecule. In some embodiments, transcripts may be generated from both strands. In some embodiments, transcripts may or may not encode protein products. In some embodiments, when directed or targeted to a particular nucleic acid sequence, a "antisense" sequence may refer to a sequence that is complementary to the particular nucleic acid sequence.

Oligonucleotide: the term "oligonucleotide" refers to a polymer or oligomer of nucleotide monomers, containing any combination of nucleobases, modified nucleobases, sugars, modified sugars, natural phosphate linkages, or non-natural internucleotidic linkages.

Oligonucleotides can be single-stranded or double-stranded. As used herein, the term "oligonucleotide strand" encompasses a single-stranded oligonucleotide. A single-stranded oligonucleotide can have double-stranded regions and a double-stranded oligonucleotide can have single-stranded regions. Example oligonucleotides include, but are not limited to structural genes, genes including control and termination regions, self-replicating systems such as viral or plasmid DNA, single-stranded and double-stranded siRNAs and other RNA interference reagents (RNAi agents or iRNA agents), shRNA, antisense oligonucleotides, ribozymes, microRNAs, microRNA mimics, supermirs, aptamers, antimirs, antagomirs, Ul adaptors, triplex-forming oligonucleotides, G-quadruplex oligonucleotides, RNA activators, immuno-stimulatory oligonucleotides, and decoy oligonucleotides.

Double-stranded and single-stranded oligonucleotides that are effective in inducing RNA interference may also be referred to as siRNA, RNAi agent, or iRNA agent. In some embodiments, these RNA interference inducing oligonucleotides associate with a cytoplasmic multi-protein complex known as RNAi-induced silencing complex (RISC). In many embodiments, single-stranded and double-stranded RNAi agents are sufficiently long that they can be cleaved by an endogenous molecule, e.g., by Dicer, to produce smaller oligonucleotides that can enter the RISC machinery and participate in RISC mediated cleavage of a target sequence, e.g. a target mRNA.

Oligonucleosides of the present disclosure can be of various lengths. In particular embodiments, oligonucleosides can range from about 2 to about 200 nucleosides in length. In various related embodiments, oligonucleosides, single-stranded, double-stranded, and triple-stranded, can range in length from about 4 to about 10 nucleosides, from about 10 to about 50 nucleosides, from about 20 to about 50 nucleosides, from about 15 to about 30 nucleosides, from about 20 to about 30 nucleosides in length. In some embodiments, the oligonucleoside is from about 9 to about 39 nucleosides in length. In some embodiments, the oligonucleoside is at least 15 nucleosides in length. In some embodiments, the oligonucleoside is at least 20 nucleosides in length. In some embodiments, the oligonucleoside is at least 25 nucleosides in length. In some embodiments, the oligonucleoside is at least 30 nucleosides in length. In some embodiments, the oligonucleoside is a duplex of complementary strands of at least 18 nucleosides in length. In some embodiments, the oligonucleoside is a duplex of complementary strands of at least 21 nucleosides in length. In some embodiments, for the purpose of oligonucleotide lengths, each nucleoside counted independently comprises an optionally substituted nucleobase selected from A, T, C, G, U and their tautomers.

Internucleotidic linkage: As used herein, the phrase "internucleotidic linkage" refers generally to a linkage, typically a phosphorus-containing linkage, between nucleotide units of a nucleic acid or an oligonucleotide, and is interchangeable with "inter-sugar linkage", "internucleosidic linkage," and "phosphorus atom bridge," as used above and herein. As appreciated by those skilled in the art, natural DNA and RNA contain natural phosphate linkages. In some embodiments, an internucleotidic linkage is a natural phosphate linkage (—OP(O)(OH)O—, typically existing as its anionic form —OP(O)($O^-$)O— at pH e.g., ~7.4), as found in naturally occurring DNA and RNA molecules. In some embodiments, an internucleotidic linkage is a modified internucleotidic linkage (or non-natural internucleotidic linkage), which is structurally different from a natural phosphate linkage but may be utilized in place of a natural phosphate linkage, e.g., phosphorothioate internucleotidic linkage, PMO linkages, etc. In some embodiments, an internucleotidic linkage is a modified internucleotidic linkage wherein one or more oxygen atoms of a natural phosphodiester linkage are independently replaced by one or more organic or inorganic moieties. In some embodiments, such an organic or inorganic moiety is selected from but not limited to ═S, ═Se, ═NR', —SR', —SeR', —$N(R')_2$, $B(R')_3$, —S—, —Se—, and —N(R')—, wherein each R' is independently as defined and described below. In some embodiments, an internucleotidic linkage is a phosphotriester linkage. In some embodiments, an internucleotidic linkage is a phosphorothioate diester linkage (phosphorothioate internucleotidic linkage,

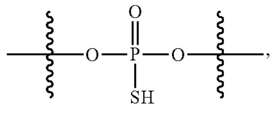

typically existing as its anionic form —OP(O)(S)O— at pH e.g., ~7.4). It is understood by a person of ordinary skill in the art that an internucleotidic linkage may exist as an anion or cation at a given pH due to the existence of acid or base moieties in the linkage. In some embodiments, an internucleotidic linkage is a non-negatively charged internucleotidic linkage at a given pH. In some embodiments, an internucleotidic linkage is a neutral internucleotidic linkage at a given pH. In some embodiments, a given pH is pH ~7.4. In some embodiments, a given pH is in the range of pH about 0, 1, 2, 3, 4, 5, 6 or 7 to pH about 7, 8, 9, 10, 11, 12, 13 or 14. In some embodiments, a given pH is in the range of pH 5-9. In some embodiments, a given pH is in the range of pH 6-8. In some embodiments, an internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, etc., as described in the present disclosure. In some embodiments, a non-negatively charged internucleotidic linkage has the structure of formula I-n-1, I-n-2, I-n-3, I-n-4, II, II-a-1, II-a-2, II-b-1, II-b-2, II-c-1, II-c-2, II-d-1, II-d-2, etc., as described in the present disclosure. In some embodiments, an internucleotidic linkage is one of, e.g., PNA (peptide nucleic acid) or PMO (phosphorodiamidate Morpholino oligomer) linkage. In some embodiments, an internucleotidic linkage comprises a chiral linkage phosphorus. In some embodiments, an internucleotidic linkage is a chirally controlled internucleotidic linkage. In some embodiments, an internucleotidic linkage is selected from: s (phosphorothioate), s1, s2, s3, s4, s5, s6, s7, s8, s9, s10, s11, s12, s13, s14, s15, s16, s17 or s18, wherein each of s1, s2, s3, s4, s5, s6, s7, s8, s9, s10, s11, s12, s13, s14, s15, s16, s17 and s18 is independently as described in WO 2017/062862.

Unless otherwise specified, the Rp/Sp designations preceding an oligonucleotide sequence describe the configurations of linkage phosphorus in chirally controlled internucleotidic linkages sequentially from 5' to 3' of the oligonucleotide sequence. For instance, in (Rp, Sp)-ATsCs1GA, the phosphorus in the "s" linkage between T and C has Rp configuration and the phosphorus in "s1" linkage between C and G has Sp configuration. In some embodiments, "All-(Rp)" or "All-(Sp)" is used to indicate that all chiral linkage phosphorus atoms in chirally controlled internucleotidic linkages have the same Rp or Sp configuration, respectively. For instance, All-(Rp)-GsCsCsTsCsAsGsTsCsTsGsCsTsTsCsGsCsAsCsC(SEQ ID NO: 60) indicates that all the chiral linkage phosphorus atoms in the oligonucleotide have Rp configuration; All-(Sp)-GsCsCsTsCsAsGsTsCsTsGsCsTsTsCsGsCsAsCsC(SEQ ID NO: 60) indicates that all the chiral linkage phosphorus atoms in the oligonucleotide have Sp configuration.

Oligonucleotide type: As used herein, the phrase "oligonucleotide type" is used to define oligonucleotides that have a particular base sequence, pattern of backbone linkages (i.e., pattern of internucleotidic linkage types, for example, natural phosphate linkages, phosphorothioate internucleotidic linkages, negatively charged internucleotidic linkages, neutral internucleotidic linkages etc), pattern of backbone chiral centers (i.e. pattern of linkage phosphorus stereochemistry (Rp/Sp)), and pattern of backbone phosphorus modifications (e.g., pattern of "—X-L-$R^1$" groups in formula I). In some embodiments, oligonucleotides of a common designated "type" are structurally identical to one another.

One of skill in the art will appreciate that synthetic methods of the present disclosure provide for a degree of control during the synthesis of an oligonucleotide strand such that each nucleotide unit of the oligonucleotide strand can be designed and/or selected in advance to have a particular stereochemistry at the linkage phosphorus and/or a particular modification at the linkage phosphorus, and/or a particular base, and/or a particular sugar. In some embodiments, an oligonucleotide strand is designed and/or selected in advance to have a particular combination of stereocenters at the linkage phosphorus. In some embodiments, an oligonucleotide strand is designed and/or determined to have a particular combination of modifications at the linkage phosphorus. In some embodiments, an oligonucleotide strand is designed and/or selected to have a particular combination of bases. In some embodiments, an oligonucleotide strand is designed and/or selected to have a particular combination of one or more of the above structural characteristics. The present disclosure provides compositions comprising or consisting of a plurality of oligonucleotide molecules (e.g., chirally controlled oligonucleotide compositions). In some embodiments, all such molecules are of the same type. In some embodiments, all such molecules are structurally identical to one another. In some embodiments, provided compositions comprise a plurality of oligonucleotides of different types, typically in pre-determined (non-random) relative amounts.

Chiral control: As used herein, "chiral control" refers to control of the stereochemical designation of a chiral linkage phosphorus in a chiral internucleotidic linkage within an oligonucleotide. In some embodiments, a control is achieved through a chiral element that is absent from the sugar and base moieties of an oligonucleotide, for example, in some embodiments, a control is achieved through use of one or more chiral auxiliaries during oligonucleotide preparation as exemplified in the present disclosure, which chiral auxiliaries often are part of chiral phosphoramidites used during oligonucleotide preparation. In contrast to chiral control, a person having ordinary skill in the art appreciates that conventional oligonucleotide synthesis which does not use chiral auxiliaries cannot control stereochemistry at a chiral internucleotidic linkage if such conventional oligonucleotide synthesis is used to form the chiral internucleotidic linkage. In some embodiments, the stereochemical designation of each chiral linkage phosphorus in a chiral internucleotidic linkage within an oligonucleotide is controlled.

Chirally controlled oligonucleotide composition: The terms "chirally controlled (stereocontrolled or stereodefined) oligonucleotide composition", "chirally controlled (stereocontrolled or stereodefined) nucleic acid composition", and the like, as used herein, refers to a composition that comprises a plurality of oligonucleotides (or nucleic acids, chirally controlled oligonucleotides or chirally controlled nucleic acids) which share 1) a common base sequence, 2) a common pattern of backbone linkages; 3) a common pattern of backbone chiral centers, and 4) a common pattern of backbone phosphorus modifications (oligonucleotides of a particular type), wherein the plurality of oligonucleotides (or nucleic acids) share the same stereochemistry at one or more chiral internucleotidic linkages (chirally controlled internucleotidic linkages, whose chiral linkage phosphorus is Rp or Sp, not a random Rp and Sp mixture as non-chirally controlled internucleotidic linkages). Level of the plurality of oligonucleotides (or nucleic acids) in a chirally controlled oligonucleotide composition is non-random (pre-determined, controlled). Chirally controlled oligonucleotide compositions are typically prepared through chirally controlled oligonucleotide preparation to stereoselectively form one or more chiral internucleotidic linkages (e.g., using chiral auxiliaries as exemplified in the present disclosure, compared to non-chirally controlled (stereorandom, non-stereoselective, racemic) oligonucleotide synthesis such as traditional phosphoramidite-based oligonucleotide synthesis using no chiral auxiliaries or chiral catalysts to purposefully control stereoselectivity). A chirally controlled oligonucleotide composition is enriched, relative to a substantially racemic preparation of oligonucleotides having the common base sequence, the common pattern of backbone linkages, and the common pattern of backbone phosphorus modifications, for oligonucleotides of the plurality. In some embodiments, a chirally controlled oligonucleotide composition comprises a plurality of oligonucleotides of a particular oligonucleotide type defined by: 1) base sequence; 2) pattern of backbone linkages; 3) pattern of backbone chiral centers; and 4) pattern of backbone phosphorus modifications, wherein it is enriched, relative to a substantially racemic preparation of oligonucleotides having the same base sequence, pattern of backbone linkages, and pattern of backbone phosphorus modifications, for oligonucleotides of the particular oligonucleotide type. As one having ordinary skill in the art readily appreciates, such enrichment can be characterized in that compared to a substantially racemic preparation, at each chirally controlled internucleotidic linkage, a higher level of the linkage phosphorus has the desired configuration. In some embodiments, each chirally controlled internucleotidic linkage independently has a diastereopurity of at least 80%, 85%, 90%, 91%, 92%, 93%, 94%, 95%, 96%, 97%, 98%, or 99% with respect to its chiral linkage phosphorus. In some embodiments, each independently has a diastereopurity of at least 90%. In some embodiments, each independently has a diastereopurity of at least 95%. In some embodiments, each independently has a diastereopurity of at least 97%. In some embodiments, each independently has a diastereopurity of at least 98%. In some embodiments, oligonucleotides of a plurality have the same constitution. In some embodiments, oligonucleotides of a plurality have the same constitution and stereochemistry, and are structurally identical.

In some embodiments, the plurality of oligonucleotides in a chirally controlled oligonucleotide composition share the same base sequence, the same, if any, nucleobase, sugar, and internucleotidic linkage modifications, and the same stereochemistry (Rp or Sp) independently at linkage phosphorus chiral centers of one or more chirally controlled internucleotidic linkages, though stereochemistry of certain linkage phosphorus chiral centers may differ. In some embodiments, about 0.1%-100%, (e.g., about 1%-100%, 5%-100%, 10%-100%, 20%-100%, 30%-100%, 40%-100%, 50%-100%, 60%-100%, 70%-100%, 80-100%, 90-100%, 95-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a chirally controlled oligonucleotide composition are oligonucleotides of the plurality. In some embodiments, about 0.1%-100%, (e.g., about 1%-100%, 5%-100%, 10%-100%, 20%-100%, 30%-100%, 40%-100%, 50%-100%, 60%-100%, 70%-100%, 80-100%, 90-100%, 95-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a chirally controlled oligonucleotide composition that share the common base sequence are oligonucleotides of the plurality. In some embodiments, about 0.1%-100%, (e.g., about 1%-100%, 5%-100%, 10%-100%, 20%-100%, 30%-100%, 40%-100%, 50%-100%, 60%-100%, 70%-100%, 80-100%, 90-100%, 95-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a chirally controlled oligonucleotide composition that share the common base sequence, the common pattern of backbone linkages, and the common pattern of backbone phosphorus modifications are oligonucleotides of the plurality. In some embodiments, about 0.1%-100%, (e.g., about 1%-100%, 5%-100%, 10%-100%, 20%-100%, 30%-100%, 40%-100%, 50%-100%, 60%-100%, 70%-100%, 80-100%, 90-100%, 95-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a chirally controlled oligonucleotide composition, or of all oligonucleotides in a composition that share a common base sequence (e.g., of a plurality of oligonucleotide or an oligonucleotide type), or of all oligonucleotides in a composition that share a common base sequence, a common pattern of backbone linkages, and a common pattern of backbone phosphorus modifications (e.g., of a plurality of oligonucleotide or an oligonucleotide type), or of all oligonucleotides in a composition that share a common base sequence, a common patter of base modifications, a common pattern of sugar modifications, a common pattern of internucleotidic linkage types, and/or a common pattern of internucleotidic linkage modifications (e.g., of a plurality of oligonucleotide or an oligonucleotide type), or of all oligonucleotides in a composition that share the same constitution, are oligonucleotides of the plurality. In some embodiments, a percentage is at least $(DP)^{NCI}$, wherein DP is a percentage selected from 85%-100%, and NCI is the number of chirally controlled internucleotidic linkage. In some embodiments, DP is at least 85%, 90%, 91%, 92%, 93%, 94%, 95%, 96%, 97%, 98%, or 99%. In some embodiments, DP is at least 85%. In some embodiments, DP is at least 90%. In some embodiments, DP is at least 95%. In some embodiments, DP is at least 96%. In some embodiments, DP is at least 97%. In some embodiments, DP is at least 98%. In some embodiments, DP is at least 99%. In some embodiments, DP reflects diastereopurity of linkage phosphorus chiral centers chirally controlled internucleotidic linkages. In some embodiments, diastereopurity of a linkage phosphorus chiral center of an internucleotidic linkage may be typically assessed using an appropriate dimer comprising such an internucleotidic linkage and the two nucleoside units being linked by the internucleotidic linkage. In some embodiments, the plurality of oligonucleotides share the same stereochemistry at about 1-50 (e.g., about 1-10, 1-20, 5-10, 5-20, 10-15, 10-20, 10-25, 10-30, or about 1, 2, 3, 4, 5, 6, 7, 8, 9, 10, 11, 12, 13, 14, 15, 16, 17, 18, 19, or 20, or at least 1, 2, 3, 4, 5, 6, 7, 8, 9, 10, 11, 12, 13, 14, 15, 16, 17, 18, 19, or 20) chiral internucleotidic linkages. In some embodiments, the plurality of oligonucleotides share the same stereochemistry at about 0.1%-100% (e.g., about 1%-100%, 5%-100%, 10%-100%, 20%-100%, 30%-100%, 40%-100%, 50%-100%, 60%-100%, 70%-100%, 80-100%, 90-100%, 95-100%, 50%-90%, about 5%, 10%, 15%, 20%, 25%, 30%, 35%, 40%, 45%, 50%, 55%, 60%, 65%, 70%, 75%, 80%, 85%, 90%, 95%, or 100%, or at least 5%, 10%, 15%, 20%, 25%, 30%, 35%, 40%, 45%, 50%, 55%, 60%, 65%, 70%, 75%, 80%, 85%, 90%, 95%, or 99%) of chiral internucleotidic linkages. In some embodiments, each chiral internucleotidic linkage is a chiral controlled internucleotidic linkage, and the composition is a completely chirally controlled oligonucleotide composition. In some embodiments, not all chiral internucleotidic linkages are chiral controlled internucleotidic linkages, and the composition is a partially chirally controlled oligonucleotide composition. In some embodiments, a chirally controlled oligonucleotide composition comprises predetermined levels of individual oligonucleotide or nucleic acids types. For instance, in some embodiments a chirally controlled oligonucleotide composition comprises one oligonucleotide type at a predetermined level (e.g., as described above). In some embodiments, a chirally controlled oligonucleotide composition comprises more than one oligonucleotide type, each independently at a predetermined level. In some embodiments, a chirally controlled oligonucleotide composition comprises multiple oligonucleotide types, each independently at a predetermined level. In some embodiments, a chirally controlled oligonucleotide composition is a composition of oligonucleotides of an oligonucleotide type, which composition comprises a predetermined level of a plurality of oligonucleotides of the oligonucleotide type.

Chirally pure: as used herein, the phrase "chirally pure" is used to describe an oligonucleotide or compositions thereof, in which all or nearly all (the rest are impurities) of the oligonucleotide molecules exist in a single diastereomeric form with respect to the linkage phosphorus atoms. In many embodiments, as appreciated by those skilled in the art, a chirally pure oligonucleotide composition is substantially pure in that substantially all of the oligonucleotides in the composition are structurally identical (being the same stereoisomer).

Linkage phosphorus: as defined herein, the phrase "linkage phosphorus" is used to indicate that the particular phosphorus atom being referred to is the phosphorus atom present in an internucleotidic linkage, which phosphorus atom corresponds to the phosphorus atom of a natural phosphate linkage as occurs in naturally occurring DNA and RNA. In some embodiments, a linkage phosphorus atom is in a modified internucleotidic linkage. In some embodiments, a linkage phosphorus atom is the P of $P^L$ of formula I. In some embodiments, a linkage phosphorus atom is chiral.

P-modification: as used herein, the term "P-modification" refers to any modification at the linkage phosphorus other than a stereochemical modification. In some embodiments, a P-modification comprises addition, substitution, or removal of a pendant moiety covalently attached to a linkage phosphorus. In some embodiments, the "P-modification" is W, Y, Z, or —X-L-$R^1$ of formula I.

Blockmer: the term "blockmer," as used herein, refers to an oligonucleotide whose pattern of structural features characterizing each individual nucleotide unit is characterized by the presence of at least two consecutive nucleotide units sharing a common structural feature at the nucleobase, sugar and/or internucleotidic linkage. By common structural feature is meant common chemistry and/or stereochemistry, e.g., common modifications at nucleobases, sugars, and/or internucleotidic linkages and common stereochemistry at linkage phosphorus chiral centers. In some embodiments, the at least two consecutive nucleotide units sharing a common structural feature are referred to as a "block".

In some embodiments, a blockmer is a "stereoblockmer," e.g., at least two consecutive nucleotide units have the same stereochemistry at the linkage phosphorus. Such at least two consecutive nucleotide units form a "stereoblock." For instance, (Sp, Sp)-ATsCs1GA is a stereoblockmer because at least two consecutive nucleotide units, the Ts and the Cs1, have the same stereochemistry at the linkage phosphorus (both Sp). In the same oligonucleotide (Sp, Sp)-ATsCs1GA, TsCs1 forms a block, and it is a stereoblock.

In some embodiments, a blockmer is a "P-modification blockmer," e.g., at least two consecutive nucleotide units have the same modification at the linkage phosphorus. Such at least two consecutive nucleotide units form a "P-modification block". For instance, (Rp, Sp)-ATsCsGA is a P-modification blockmer because at least two consecutive nucleotide units, the Ts and the Cs, have the same P-modification (i.e., both are a phosphorothioate diester). In the same oligonucleotide of (Rp, Sp)-ATsCsGA, TsCs forms a block, and it is a P-modification block.

In some embodiments, a blockmer is a "linkage blockmer," e.g., at least two consecutive nucleotide units have identical stereochemistry and identical modifications at the linkage phosphorus. At least two consecutive nucleotide units form a "linkage block". For instance, (Rp, Rp)-ATsCsGA is a linkage blockmer because at least two consecutive nucleotide units, the Ts and the Cs, have the same stereochemistry (both Rp) and P-modification (both phosphorothioate). In the same oligonucleotide of (Rp, Rp)-ATsCsGA, TsCs forms a block, and it is a linkage block.

In some embodiments, a blockmer is a "sugar modification blockmer," e.g., at least two consecutive nucleotide units have identical sugar modifications. In some embodiments, a sugar modification blockmer is a 2'-F blockmer wherein at least two consecutive nucleotide units have 2'-F modification at their sugars. In some embodiments, a sugar modification blockmer is a 2'-OR blockmer wherein at lead two consecutive nucleotide units independently have 2'-OR modification at their sugars, wherein each R is independent as described in the present disclosure. In some embodiments, a sugar modification blockmer is a 2'-OMe blockmer wherein at least two consecutive nucleotide units have 2'-OMe modification at their sugars. In some embodiments, a sugar modification blockmer is a 2'-MOE blockmer wherein at lead two consecutive nucleotide units have 2'-MOE modification at their sugars. In some embodiments, a sugar modification blockmer is a LNA blockmer wherein at least two consecutive nucleotide units have LNA sugars.

In some embodiments, a blockmer comprises one or more blocks independently selected from a sugar modification block, a stereoblock, a P-modification block and a linkage block. In some embodiments, a blockmer is a stereoblockmer with respect to one block, and/or a P-modification blockmer with respect to another block, and/or a linkage blockmer with respect to yet another block.

Altmer: the term "altmer," as used herein, refers to an oligonucleotide whose pattern of structural features characterizing each individual nucleotide unit is characterized in that no two consecutive nucleotide units of the oligonucleotide strand share a particular structural feature at the nucleobase, sugar, and/or the internucleotidic phosphorus linkage. In some embodiments, an altmer is designed such that it comprises a repeating pattern. In some embodiments, an altmer is designed such that it does not comprise a repeating pattern.

In some embodiments, an altmer is a "stereoaltmer," e.g., no two consecutive nucleotide units have the same stereochemistry at the linkage phosphorus. For instance, (Rp, Sp, Rp, Sp, Rp, Sp, Rp, Sp, Rp, Sp Rp, Sp, Rp, Sp, Rp, Sp, Rp, Sp, Rp)-GsCsCsTsCsAsGsTsCsTsGsCsTsTsCsGsCsAsCsC (SEQ ID NO: 60).

Gapmer: as used herein, the term "gapmer" refers to an oligonucleotide characterized in that one or more nucleotide units (gap) do not have the structural features (e.g., nucleobase modifications, sugar modifications, internucleotidic linkage modifications, linkage phosphours stereochemistry, etc.) contained by nucleotide units flanking such one or more nucleotide units at both ends. In some embodiments, a gapmer comprises a gap of one or more natural phosphate linkages, independently flanked at both ends by non-natural internucleotidic linkages. In some embodiments, a gapmer is a sugar modification gapmer, wherein the gapmer comprises a gap of one or more nucleotide units comprising no sugar modifications which the flanking nucleotide at both ends contain. In some embodiments, a gapmer comprises a gap, wherein each nucleotide unit in the gap region contains no 2'-modification that is contained in nucleotide units flanking the gap at both ends. In some embodiments, a provided oligonucleotide comprising a gap, wherein each nucleotide unit in the gap region contains no 2'-OR modification, while nucleotide units flanking the gap at each end independently comprise a 2'-OR modification. In some embodiments, a provided oligonucleotide comprising a gap, wherein each nucleotide unit in the gap region contains no 2'-F modification, while nucleotide units flanking the gap at each end independently comprise a 2'-F modification.

Skipmer: as used herein, the term "skipmer" refers to a type of gapmer in which every other internucleotidic phosphorus linkage of the oligonucleotide strand is a phosphate diester linkage (a natural phosphate linkage), for example such as those found in naturally occurring DNA or RNA, and every other internucleotidic phosphorus linkage of the oligonucleotide strand is a modified internucleotidic linkage (a non-natural internucleotidic linkage).

For purposes of this disclosure, the chemical elements are identified in accordance with the Periodic Table of the Elements, CAS version, *Handbook of Chemistry and Physics,* 67th Ed., 1986-87, inside cover.

Unless otherwise specified, salts, such as pharmaceutically acceptable acid or base addition salts, stereoisomeric forms, and tautomeric forms, of compounds (e.g., oligonucleotides, agents, etc.) are included. Unless otherwise specified, singular forms "a", "an", and "the" include the plural reference unless the context clearly indicates otherwise (and vice versa). Thus, for example, a reference to "a compound" may include a plurality of such compounds.

DETAILED DESCRIPTION OF CERTAIN EMBODIMENTS

Synthetic oligonucleotides provide useful molecular tools in a wide variety of applications. For example, oligonucleotides are useful in therapeutic, diagnostic, research, and new nanomaterials applications. The use of naturally occurring nucleic acids (e.g., unmodified DNA or RNA) is limited, for example, by their susceptibility to endo- and exo-nucleases. As such, various synthetic counterparts have been developed to circumvent these shortcomings. These include synthetic oligonucleotides that contain chemical modification, e.g., base modifications, sugar modifications, backbone modifications, etc., which, among other things, render these molecules less susceptible to degradation and improve other properties of oligonucleotides. Chemical modifications may also lead to certain undesired effects, such as increased toxicities, etc. From a structural point of view, modifications to natural phosphate linkages can introduce chirality, and certain properties of oligonucleotides may be affected by the configurations of the phosphorus atoms that form the backbone of the oligonucleotides.

In some embodiments, an oligonucleotide or oligonucleotide composition is: a DMD oligonucleotide or oligonucleotide composition; an oligonucleotide or oligonucleotide composition comprising a non-negatively charged internucleotidic linkage; or a DMD oligonucleotide comprising a non-negatively charged internucleotidic linkage.

In some embodiments, the chirality of the backbone (e.g., the configurations of the phosphorus atoms) or inclusion of natural phosphate linkages or non-natural internucleotidic linkages in the backbone and/or modifications of a sugar and/or nucleobase, and/or the addition of chemical moieties can affect properties and activities of oligonucleotides, e.g., the ability of a DMD oligonucleotide (e.g., an oligonucleotide antisense to a Dystrophin (DMD) transcript sequence) to skip one or more exons, and/or other properties of a DMD oligonucleotide, including but not limited to, increased stability, improved pharmacokinetics, and/or decreased immunogenicity, etc. Suitable assays for assessing properties and/or activities of provided compounds, e.g., oligonucleotides, and compositions thereof are widely known in the art and can be utilized in accordance with the present disclosure. For example, to test immunogenicity, various DMD oligonucleotides were tested in mouse serum in vivo and demonstrated minimal activation of cytokines, and various DMD oligonucleotides were tested ex vivo in human PBMC (peripheral blood mononuclear cells) for cytokine activity (e.g., IL-12p40, IL-12p70, IL-1alpha, IL-1beta, IL-6, MCP-1, MIP-1alpha, MIP-1beta, and TNF-alpha).

In some embodiments, technologies (e.g., oligonucleotides, compositions, and methods of use thereof) of the present disclosure can be utilized to target various nucleic acids (e.g., by hybridizing to a target sequence of a target nucleic acid, and/or providing level reduction, degradation, splicing modulation, transcription suppression, etc. of the target nucleic acid, etc.) In some embodiments, provided technologies are particularly useful for modulating splicing of transcripts, e.g., to increase levels of desired splicing products and/or to reduce levels of undesired splicing products. In some embodiments, provided technologies are particularly useful for reducing levels of transcripts, e.g., pre-mRNA, RNA, etc., and in many instances, reducing levels of products arising from or encoded by such transcripts such as mRNA, proteins, etc.

In some embodiments, a transcript is pre-mRNA. In some embodiments, a splicing product is mature RNA. In some embodiments, a splicing product is mRNA. In some embodiments, splicing modulation or alteration comprises skipping one or more exons. In some embodiments, splicing of a transcript is improved in that exon skipping increases levels of mRNA and proteins that have improved beneficial activities compared with absence of exon skipping. In some embodiments, an exon causing frameshift is skipped. In some embodiments, an exon comprising an undesired mutation is skipped. In some embodiments, an exon comprising a premature termination codon is skipped. An undesired mutation can be a mutation causing changes in protein sequences; it can also be a silent mutation. In some embodiments, a transcript is a transcript of Dystrophin (DMD).

In some embodiments, splicing of a transcript is improved in that exon skipping lowers levels of mRNA and proteins that have undesired activities compared with absence of exon skipping. In some embodiments, a target is knocked down through exon skipping which, by skipping one or more exons, causes premature stop codon and/or frameshift mutations. In some embodiments, provided oligonucleotides in provided compositions, e.g., oligonucleotides of a plurality, comprise base modifications, sugar modifications, and/or internucleotidic linkage modifications. In some embodiments, provided oligonucleotides comprise base modifications and sugar modifications. In some embodiments, provided oligonucleotides comprise base modifications and internucleotidic linkage modifications. In some embodiments, provided oligonucleotides comprise sugar modifications and internucleotidic modifications. In some embodiments, provided compositions comprise base modifications, sugar modifications, and internucleotidic linkage modifications. Example chemical modifications, such as base modifications, sugar modifications, internucleotidic linkage modifications, etc. are widely known in the art including but not limited to those described in this disclosure. In some embodiments, a modified base is substituted A, T, C, G or U. In some embodiments, a sugar modification is 2'-modification. In some embodiments, a 2'-modification is 2-F modification. In some embodiments, a 2'-modification is 2'-$OR^1$, wherein $R^1$ is not hydrogen. In some embodiments, a 2'-modification is 2'-$OR^1$, wherein $R^1$ is optionally substituted alkyl. In some embodiments, a 2'-modification is 2'-OMe. In some embodiments, a 2'-modification is 2'-MOE. In some embodiments, a modified sugar moiety is a bridged bicyclic or polycyclic ring. In some embodiments, a modified sugar moiety is a bridged bicyclic or polycyclic ring having 5-20 ring atoms wherein one or more ring atoms are optionally and independently heteroatoms. Example ring structures are widely known in the art, such as those found in BNA, LNA, etc. In some embodiments, provided oligonucleotides comprise both one or more modified internucleotidic linkages and one or more natural phosphate linkages. In some embodiments, oligonucleotides comprising both modified internucleotidic linkage and natural phosphate linkage and compositions thereof provide improved properties, e.g., activities and toxicities, etc. In some embodiments, a modified internucleotidic linkage is a chiral internucleotidic linkage. In some embodiments, a modified internucleotidic linkage is a phosphorothioate linkage. In some embodiments, a modified internucleotidic linkage is a substituted phosphorothioate linkage.

In some embodiments, provided oligonucleotides comprise one or more non-negatively charged internucleotidic linkages. In some embodiments, a non-negatively charged internucleotidic linkage is a positively charged internucleotidic linkage. In some embodiments, a non-negatively charged internucleotidic linkage is a neutral internucleotidic linkage. In some embodiments, a modified internucleotidic linkage (e.g., a non-negatively charged internucleotidic linkage) comprises optionally substituted triazolyl. In some embodiments, a modified internucleotidic linkage (e.g., a non-negatively charged internucleotidic linkage) comprises optionally substituted alkynyl. In some embodiments, a modified internucleotidic linkage comprises a triazole or alkyne moiety. In some embodiments, a triazole moiety, e.g., a triazolyl group, is optionally substituted. In some embodiments, a triazole moiety, e.g., a triazolyl group) is substituted. In some embodiments, a triazole moiety is unsubstituted. In some embodiments, a modified internucleotidic linkage comprises an optionally substituted guanidine moiety. In some embodiments, a modified internucleotidic linkage comprises an optionally substituted cyclic guanidine moiety. In some embodiments, a modified internucleotidic linkage comprises an optionally substituted cyclic guanidine moiety and has the structure of:

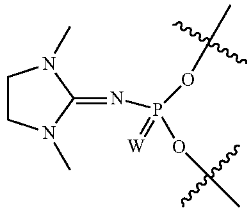
,

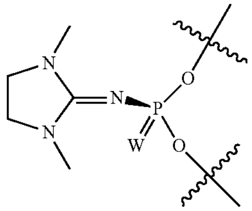
, or

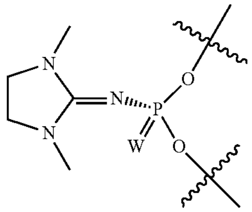
, wherein W is O or S. In some embodiments, W is O. In some embodiments, W is S. In some embodiments, a non-negatively charged internucleotidic linkage is stereochemically controlled.

In some embodiments, an internucleotidic linkage comprising an optionally substituted guanidine moiety is an internucleotidic linkage of formula I-n-2, I-n-3, I-n-4, II-a-2, II-b-1, II-b-2, II-c-1, II-c-2, II-d-1, or II-d-2 as described herein. In some embodiments, an internucleotidic linkage comprising an optionally substituted cyclic guanidine moiety is an internucleotidic linkage of formula II-a-2, II-b-1, II-b-2, II-c-1, II-c-2, II-d-1, or II-d-2.

Among other things, the present disclosure encompasses the recognition that stereorandom oligonucleotide preparations contain a plurality of distinct chemical entities that differ from one another, e.g., in the stereochemical structure of individual backbone linkage phosphorus chiral centers within the oligonucleotide chain. Without control of stereochemistry of backbone chiral centers, stereorandom oligonucleotide preparations provide uncontrolled compositions comprising undetermined levels of oligonucleotide stereoisomers with respect to the uncontrolled chiral centers, e.g., chiral linkage phosphorus. Even though these stereoisomers may have the same base sequence, they are different chemical entities at least due to their different backbone stereochemistry, and they can have, as demonstrated herein, different properties, e.g., activities, toxicities, etc. Among other things, the present disclosure provides new oligonucleotide compositions wherein stereochemistry of one or more linkage phosphorus chiral centers are independently controlled (e.g., in chirally controlled internucleotidic linkages). In some embodiments, the present disclosure provides chirally controlled oligonucleotide compositions which are or contain particular stereoisomers of oligonucleotides of interest.

In some embodiments, provided oligonucleotides contain increased levels of one or more isotopes. In some embodiments, provided oligonucleotides are labeled, e.g., by one or more isotopes of one or more elements, e.g., hydrogen, carbon, nitrogen, etc. In some embodiments, provided oligonucleotides in provided compositions, e.g., oligonucleotides of a plurality, comprise base modifications, sugar modifications, and/or internucleotidic linkage modifications, wherein the oligonucleotides contain an enriched level of deuterium. In some embodiments, provided oligonucleotides are labeled with deuterium (replacing —$^1$H with —$^2$H) at one or more positions. In some embodiments, one or more $^1$H of an oligonucleotide or any moiety conjugated to the oligonucleotide (e.g., a targeting moiety, lipid, etc.) is substituted with $^2$H. Such oligonucleotides can be used in any composition or method described herein.

In some embodiments, in an oligonucleotide, a pattern of backbone chiral centers can provide improved activity(s) or characteristic(s), including but not limited to: improved skipping of one or more exons, increased stability, increased activity, increased stability and activity, low toxicity, low immune response, improved protein binding profile, increased binding to certain proteins, and/or enhanced delivery.

In some embodiments, a pattern of backbone chiral centers is or comprises S, SS, SSS, SSSS, SSSSS, SSSSSS, SSSSSSS, SOS, SSOSS, SSSOSSS, SSSSOSSSS, SSSSSOSSSSS, SSSSSSOSSSSSS, SSSSSSSOSSSSSSS, SSSSSSSSOSSSSSSSS, SSSSSSSSSOSSSSSSSSS, SOSOSOSOS, SSOSOSOSOSS, SSSOSOSOSOSSS, SSSSOSOSOSOSSSS, SSSSSOSOSOSOSSSSS, SSSSSSOSOSOSOSSSSSS, SOSOSSOOS, SSOSOSSOOSS, SSSOSOSSOOSSS, SSSSSSOSOSSOOSSSSSS, SOSOOSOOS, SSSSOSOSSOOSSSS, SSSSSOSOSSOOSSSSS, ssoSOOSOOSS, SSSOSOOSOOSSS, SSSSOSOOSOOSSSS, SSSSSOSOOSOOSSSSS, SSSSSSOSOOSOOSSSSSS, SOSOSSOOS, SSOSOSSOOSO, SSSOSOSSOOSOS, SSSSOSOSSOOSOSS, SSSSSOSOSSOOSOSSS, SSSSSSOSOSSOOSOSSSS, soSOOSOOSO, SSOSOOSOOSOS, SSSOSOOSOOSOS, SSSSOSOOSOOSOSS, SSSSSOSOOSOOSOSSS, SSSSSSOSOOSOOSOSSSS, SSOSOSSOO, SSSOSOSSOOS, SSSSOSOSSOOS, SSSSSOSOSSOOSS, OOSSSSSSOSOSSOOSSSSSS, RS, SR, SRS, SRSS, SSRS, RR, RRR, RRRR, RRRRR, SRR, RRS, SRRS, SSRRS, SRRSS, SRRR, RRRS, SRRRS, SSRRRS, SSRRRS, RSRRR, SRRRSR, SSSRSSS, SSSSRSSSS, SSSSSRSSSSS, SSSSSSRSSSSSS, SSSSSSSRSSSSSSS, SSSSSSSSRSSSSSSSS, SSSSSSSSSRSSSSSSSSS, SRSRSRSRS, SSRSRSRSRSS, SSSRSRSRSRSSS, SSSSRSRSRSRSSSS, SSSSSRSRSRSRSSSSS, SSSSSSRSRSRSRSSSSSS, SRSRSSRRS, SSRSRSSRRSS, SSSRSRSSRRSSS, SSSSRSRSSRRSSSS, SSSSSRSRSSRRSSSSS, SSSSSSRSRSSRRSSSSSS, SRSRRSRRS, SSRSRRSRRSS, SSSRSRRSRRSSS, SSSSRSRRSRRSSSS, SSSSSRSRRSRRSSSSS, SSSSSSRSRRSRRSSSSSS, SRSRSSRRS, SSRSRSSRRSR, SSSRSRSSRRSRS, SSSSRSRSSRRSRSS, SSSSSRSRSSRRSRSSS, SSSSSSRSRSSRRSRSSSS, SRSRRSRRSR, SSRSRRSRRSRS, SSSRSRRSRRSRS, SSSSRSRRSRRSRSS, SSSSSRSRRSRRSRSSS, SSSSSSRSRRSRRSRSSSS, SSRSRSSRR, SSSRSRSSRRS, SSSSRSRSSRRS, SSSSSRSRSSRRSS, SSSSSSRSRSSRRSSS, RSSSSSSRSRSSRRSSS, RRSSSSSSRSRSSRRS, RRSSSSSSRSRSSRRSS, RRSSSSSSRSRSSRRSSS, RRSSSSSSRSRSSRRSSSS, RRSSSSSSRSRSSRRSSSSS, $(R)_n(S)_m$, $(S)_t(R)_n$, $(O)_t(R)_n(S)_m$, $(S)_t(O)_m$, $(O)_m(S)_t$, $(S)_t(R)_n(S)_m$, $(S)_t(O)_m(S)_n$, $(S)_t(O)_m$, wherein t, m and n are independently 1 to 20, O is a non-chiral internucleotidic linkage, R is a Rp chiral internucleotidic linkage, and S is an Sp chiral internucleotidic linkage. In some embodiments, the non-chiral center is a phosphodiester linkage. In some embodiments, the chiral center in a Sp configuration is a phosphorothioate linkage.

In some embodiments, the 5'-end region of provided oligonucleotides, e.g., a 5'-wing, comprises a stereochemistry pattern of S, SS, SSS, SSSS, SSSSS, SSSSSS, or SSSSSS. In some embodiments, each S is or represents an Sp phosphorothioate internucleotidic linkage. In some embodiments, the 5'-end region of provided oligonucleotides, e.g., a 5'-wing, comprises a stereochemistry pattern of S, SS, SSS, SSSS, SSSSS, SSSSSS, or SSSSSS, wherein the first S represents the first (the 5'-end) internucleotidic linkage of a provided oligonucleotide. In some embodiments, one or more nucleotidic units comprising an Sp internucleotidic linkage in the 5'-end region independently comprise —F. In some embodiments, each nucleotidic unit comprising an Sp internucleotidic linkage in the 5'-end region independently comprises —F. In some embodiments, one or more nucleotidic units comprising an Sp internucleotidic linkage in the 5'-end region independently comprise a sugar modification. In some embodiments, each nucleotidic unit comprising an Sp internucleotidic linkage in the 5'-end region independently comprises a sugar modification. In some embodiments, each 2'-modification is the same. In some embodiments, a sugar modification is a 2'-modification. In some embodiments, a 2'-modification is 2'-OR$^1$. In some embodiments, a 2'-modification is 2'-F. In some embodiments, the 3'-end region of provided oligonucleotides, e.g., a 3'-wing, comprises a stereochemistry pattern of S, SS, SSS, SSSS, SSSSS, SSSSSS, or SSSSSS. In some embodiments, each S is or represents an Sp phosphorothioate internucleotidic linkage. In some embodiments, the 3'-end region of provided oligonucleotides, e.g., a 3'-wing, comprises a stereochemistry pattern of S, SS, SSS, SSSS, SSSSS, SSSSSS, or SSSSSS, wherein the last S represents the last (the 3'-end) internucleotidic linkage of a provided oligonucleotide. In some embodiments, each S represents an Sp phosphorothioate internucleotidic linkage. In some embodiments, one or more nucleotidic units comprising an Sp internucleotidic linkage in the 3'-end region independently comprise —F. In some embodiments, each nucleotidic unit comprising an Sp internucleotidic linkage in the 3'-end region independently comprises —F. In some embodiments, one or more nucleotidic units comprising an Sp internucleotidic linkage in the 3'-end region independently comprise a sugar modification. In some embodiments, each nucleotidic unit comprising an Sp internucleotidic linkage in the 3'-end region independently comprises a sugar modification. In some embodiments, each 2'-modification is the same. In some embodiments, a sugar modification is a 2'-modification. In some embodiments, a 2'-modification is 2'-OR$^1$. In some embodiments, a 2'-modification is 2'-F. In some embodiments, provided oligonucleotides comprise both a 5'-end region, e.g., a 5'-wing, and a 3'-end region, e.g., a 3'-end wing, as described herein. In some embodiments, the 5'-end region comprises a stereochemistry pattern of SS, wherein the first S represents the first internucleotidic linkage of a provided oligonucleotide, the 3'-end region comprises a stereochemistry pattern of SS, wherein one or more nucleotidic unit comprising an Sp internucleotidic linkage in the 5'- or 3'-end region comprise —F. In some embodiments, the 5'-end region comprises a stereochemistry pattern of SS, wherein the first S represents the first internucleotidic linkage of a provided oligonucleotide, the 3'-end region comprises a stereochemistry pattern of SS, wherein one or more nucleotidic unit comprising an Sp internucleotidic linkage in the 5'- or 3'-end region comprise a 2'-F sugar modification. In some embodiments, provided oligonucleotides further comprise a middle region between the 5'-end and 3'-end regions, e.g., a core region, which comprises one or more natural phosphate linkages. In some embodiments, provided oligonucleotides further comprise a middle region between the 5'-end and 3'-end regions, e.g., a core region, which comprises one or more natural phosphate linkages and one or more internucleotidic linkages. In some embodiments, a middle region comprises one or more sugar moieties, wherein each sugar moiety independently comprises a 2'-OR[1] modification. In some embodiments, a middle region comprises one or more sugar moieties comprising no 2'-F modification. In some embodiments, a middle region comprises one or more Sp internucleotidic linkages. In some embodiments, a middle region comprises one or more Sp internucleotidic linkages and one or more natural phosphate linkages. In some embodiments, a middle region comprises one or more Rp internucleotidic linkages. In some embodiments, a middle region comprises one or more Rp internucleotidic linkages and one or more natural phosphate linkages. In some embodiments, a middle region comprises one or more Rp internucleotidic linkages and one or more Sp internucleotidic linkages.

In some embodiments, provided oligonucleotides comprise one or more modified internucleotidic linkages. In some embodiments, provided oligonucleotides comprise one or more chiral modified internucleotidic linkages. In some embodiments, provided oligonucleotides comprise one or more chirally controlled chiral modified internucleotidic linkages. In some embodiments, provided oligonucleotides comprise one or more natural phosphate linkages. In some embodiments, provided oligonucleotides comprise one or more modified internucleotidic linkages and one or more natural phosphate linkages. In some embodiments, a modified internucleotidic linkage is a phosphorothioate linkage. In some embodiments, each modified internucleotidic linkage is a phosphorothioate linkage. In some embodiments, a modified internucleotidic linkage comprises a triazole, substituted triazole, alkyne or Tmg.

In some embodiments, the present disclosure pertains to a nucleic acid which comprises a modified internucleotidic linkage comprising a triazole or alkyne moiety. In some embodiments, the present disclosure pertains to a nucleic acid which comprises a modified internucleotidic linkage comprising an optionally substituted triazolyl or alkynyl. In some embodiments, such a nucleic acid is a siRNA, double-straned siRNA, single-stranded siRNA, oligonucleotide, gapmer, skipmer, blockmer, antisense oligonucleotide, antagomir, microRNA, pre-microRNA, antimir, supermir, ribozyme, Ul adaptor, RNA activator, RNAi agent, decoy oligonucleotide, triplex forming oligonucleotide, aptamer or adjuvant. In some embodiments, the present disclosure pertains to an oligonucleotide which comprises a modified internucleotidic linkage comprising a triazole or alkyne moiety. In some embodiments, the present disclosure pertains to a DMD oligonucleotide which comprises a modified internucleotidic linkage comprising a triazole or alkyne moiety. In some embodiments, the present disclosure pertains to a nucleic acid which comprises a modified internucleotidic linkage comprising a triazole moiety. In some embodiments, the present disclosure pertains to a nucleic acid which comprises a modified internucleotidic linkage comprising optionally substituted triazolyl. In some embodiments, the present disclosure pertains to a nucleic acid which comprises a modified internucleotidic linkage comprising a substituted triazole moiety. In some embodiments, the present disclosure pertains to a nucleic acid which comprises a modified internucleotidic linkage comprising an alkyne moiety. In some embodiments, the present disclosure pertains to a nucleic acid or oligonucleotide which comprises, at a 5' end, a structure of the formula:

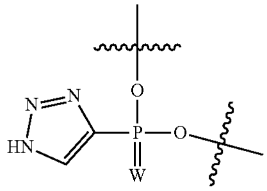
,
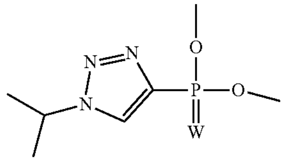
, or
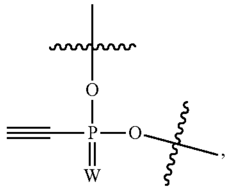
, wherein W is O or S. In some embodiments, an oligonucleotide is a single-stranded siRNA which comprises, at a 5' end, a structure of the formula:

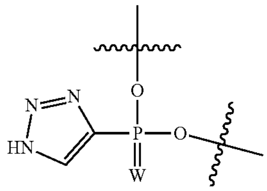
,
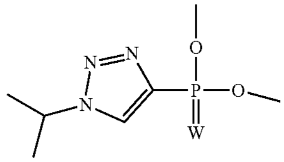
, or
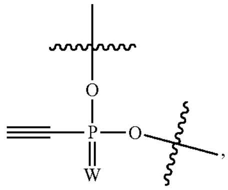
, wherein W is O or S. In some embodiments, a modified internucleotidic linkage is any modified internucleotidic linkage described in Krishna et al. 2012 J. Am. Chem. Soc. 134:11618-11631.

In some embodiments, the present disclosure pertains to a nucleic acid which comprises a modified internucleotidic linkage which comprises a guanidine moiety. In some embodiments, the present disclosure pertains to a nucleic acid which comprises a modified internucleotidic linkage which comprises a cyclic guanidine moiety. In some embodiments, the present disclosure pertains to a nucleic acid which comprises a modified internucleotidic linkage which comprises a cyclic guanidine moiety and has the structure of:

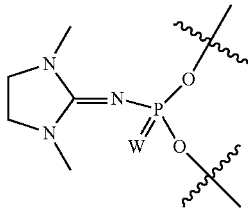, wherein W is O or S. In some embodiments, a neutral internucleotidic linkage or internucleotidic linkage comprising a cyclic guanidine is chirally controlled. In some embodiments, a nucleic acid comprising a non-negatively charged internucleotidic linkage or a modified internucleotidic linkage comprising a cyclic guanidine moiety is a siRNA, double-straned siRNA, single-stranded siRNA, oligonucleotide, gapmer, skipmer, blockmer, antisense oligonucleotide, antagomir, microRNA, pre-microRNA, antimir, supermir, ribozyme, Ul adaptor, RNA activator, RNAi agent, decoy oligonucleotide, triplex forming oligonucleotide, aptamer or adjuvant. In some embodiments, the present disclosure pertains to an oligonucleotide which comprises a modified internucleotidic linkage which comprises a cyclic guanidine moiety. In some embodiments, the present disclosure pertains to an oligonucleotide which comprises a modified internucleotidic linkage which has the structure of:

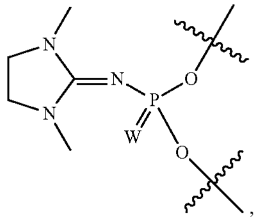, wherein W is O or S. In some embodiments, a neutral internucleotidic linkage or internucleotidic linkage comprising a cyclic guanidine moiety is chirally controlled. In some embodiments, the present disclosure pertains to a DMD oligonucleotide which comprises a modified internucleotidic linkage comprising a cyclic guanidine moiety. In some embodiments, the present disclosure pertains to a DMD oligonucleotide which comprises a modified internucleotidic linkage which has the structure of:

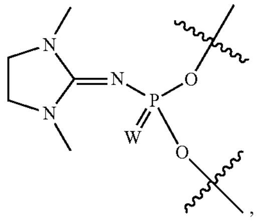, wherein W is O or S. In some embodiments, a neutral internucleotidic linkage or internucleotidic linkage comprising a cyclic guanidine moiety is chirally controlled. In some embodiments, the present disclosure pertains to a nucleic acid which comprises a modified internucleotidic linkage comprising a cyclic guanidine moiety. In some embodiments, the present disclosure pertains to a nucleic acid which comprises a modified internucleotidic linkage which has the structure of:

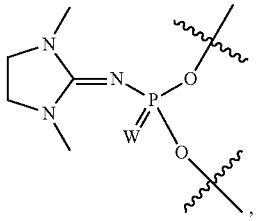, wherein W is O or S. In some embodiments, the present disclosure pertains to a nucleic acid or oligonucleotide which comprises, at a 5' end, a structure comprising a cyclic guanidine moiety. In some embodiments, the present disclosure pertains to a nucleic acid or oligonucleotide which comprises, at a 5' end, a structure of the formula:

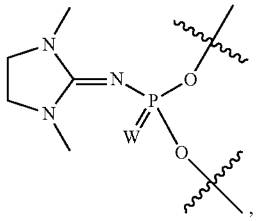, wherein W is O or S. In some embodiments, the oligonucleotide is a single-stranded siRNA which comprises, at a 5' end, a structure comprising a cyclic guanidine moiety. In some embodiments, the oligonucleotide is a single-stranded siRNA which comprises, at a 5' end, a structure of the formula:

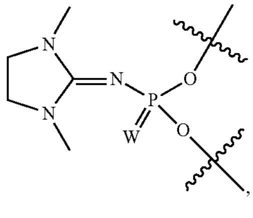, wherein W is O or S. In some embodiments, the internucleotidic linkage comprises

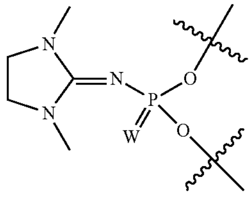

(wherein W is O or S) and is chirally controlled.

In some embodiments, provided oligonucleotides can bind to a transcript, and change the splicing pattern of the transcript. In some embodiments, provided oligonucleotides provides exon-skipping of an exon, with efficiency greater than a comparable oligonucleotide under one or more suitable conditions, e.g., as described herein. In some embodiments, a provided skipping efficiency is at least 10%, 20%, 30%, 40%, 50%, 60%, 70%, 80%, 90%, 100%, 110%, 120%, 130%, 140%, 150%, 160%, 170%, 180%, 190% more than, or 2, 3, 4, 5, 6, 7, 8, 9, 10, 11, 12, 13, 14, 15, 16, 17, 18, 19, 20, 30, 40, 50 or more fold of, that of a comparable oligonucleotide under one or more suitable conditions, e.g., as described herein. In some embodiments, a comparable oligonucleotide is an oligonucleotide which has fewer or no chirally controlled internucleotidic linkages and/or fewer or no non-negatively charged internucleotidic linkages but is otherwise identical.

In some embodiments, the present disclosure demonstrates that 2'-F modifications, among other things, can improve exon-skipping efficiency. In some embodiments, the present disclosure demonstrates that Sp internucleotidic linkages, among other things, at the 5'- and 3'-ends can improve oligonucleotide stability. In some embodiments, the present disclosure demonstrates that, among other things, natural phosphate linkages and/or Rp internucleotidic linkages can improve removal of oligonucleotides from a system. As appreciated by a person having ordinary skill in the art, various assays known in the art can be utilized to assess such properties in accordance with the present disclosure.

In some embodiments, provided oligonucleotides comprise one or more modified sugar moieties. In some embodiments, a modified sugar moiety comprises a 2'-modification. In some embodiments, a modified sugar moiety comprises a 2'-modification. In some embodiments, a 2'-modification is 2'-OR$^1$. In some embodiments, a 2'-modification is a 2'-OMe. In some embodiments, a 2'-modification is a 2'-MOE. In some embodiments, a 2'-modification is an LNA sugar modification. In some embodiments, a 2'-modification is 2'-F. In some embodiments, each sugar modification is independently a 2'-modification. In some embodiments, each sugar modification is independently 2'-OR$^1$ or 2'-F. In some embodiments, each sugar modification is independently 2'-OR$^1$ or 2'-F, wherein R$^1$ is optionally substituted $C_{1-6}$ alkyl. In some embodiments, each sugar modification is independently 2'-OR$^1$ or 2'-F, wherein at least one is 2'-F. In some embodiments, each sugar modification is independently 2'-OR$^1$ or 2'-F, wherein R$^1$ is optionally substituted $C_{1-6}$ alkyl, and wherein at least one is 2'-OR$^1$. In some embodiments, each sugar modification is independently 2'-OR$^1$ or 2'-F, wherein at least one is 2'-F, and at least one is 2'-OR$^1$. In some embodiments, each sugar modification is independently 2'-OR$^1$ or 2'-F, wherein R$^1$ is optionally substituted $C_{1-6}$ alkyl, and wherein at least one is 2'-F, and at least one is 2'-OR$^1$.

In some embodiments, 5% or more of the sugar moieties of provided oligonucleotides are modified. In some embodiments, 5%, 10%, 15%, 20%, 25%, 30%, 40%, 50%, 60%, 70%, 75%, 80%, 85%, 90%, 95%, or more of the sugar moieties of provided oligonucleotides are modified. In some embodiments, each sugar moiety of provided oligonucleotides is modified. In some embodiments, a modified sugar moiety comprises a 2'-modification. In some embodiments, a modified sugar moiety comprises a 2'-modification. In some embodiments, a 2'-modification is 2'-OR$^1$. In some embodiments, a 2'-modification is a 2'-OMe. In some embodiments, a 2'-modification is a 2'-MOE. In some embodiments, a 2'-modification is an LNA sugar modification. In some embodiments, a 2'-modification is 2'-F. In some embodiments, each sugar modification is independently a 2'-modification. In some embodiments, each sugar modification is independently 2'-OR$^1$ or 2'-F. In some embodiments, each sugar modification is independently 2'-OR$^1$ or 2'-F, wherein R$^1$ is optionally substituted $C_{1-6}$ alkyl. In some embodiments, each sugar modification is independently 2'-OR$^1$ or 2'-F, wherein at least one is 2'-F. In some embodiments, each sugar modification is independently 2'-OR$^1$ or 2'-F, wherein R$^1$ is optionally substituted $C_{1-6}$ alkyl, and wherein at least one is 2'-OR$^1$. In some embodiments, each sugar modification is independently 2'-OR$^1$ or 2'-F, wherein at least one is 2'-F, and at least one is 2'-OR$^1$. In some embodiments, each sugar modification is independently 2'-OR$^1$ or 2'-F, wherein R$^1$ is optionally substituted $C_{1-6}$ alkyl, and wherein at least one is 2'-F, and at least one is 2'-OR$^1$.

In some embodiments, provided oligonucleotides comprise one or more 2'-F. In some embodiments, provided oligonucleotides comprise two or more 2'-F.

In some embodiments, provided oligonucleotides comprise alternating 2'-F modified sugar moieties and 2'-OR$^1$ modified sugar moieties. In some embodiments, provided oligonucleotides comprise alternating 2'-F modified sugar moieties and 2'-OMe modified sugar moieties, e.g., [(2'-F)(2'-OMe)]x, [(2'-OMe)(2'-F)]x, etc., wherein x is 1-50. In some embodiments, provided oligonucleotides comprise at least two pairs of alternating 2'-F and 2'-OMe modifications. In some embodiments, provided oligonucleotides comprises alternating phosphodiester and phosphorothioate internucleotidic linkages, e.g., [(PO)(PS)]x, [(PS)(PO)]x, etc., wherein x is 1-50. In some embodiments, provided oligonucleotides comprise at least two pairs of alternating phosphodiester and phosphorothioate internucleotidic linkages.

In some embodiments, provided oligonucleotides comprise one or more natural phosphate linkages and one or more modified internucleotidic linkages. In some embodiments, provided oligonucleotides comprise one or more natural phosphate linkages and one or more modified internucleotidic linkages and one or more non-negatively charged internucleotidic linkages.

In some embodiments, the present disclosure provides an oligonucleotide composition comprising a plurality of oligonucleotides, wherein:

- oligonucleotides of the plurality have the same base sequence; and
- oligonucleotides of the plurality comprise one or more modified sugar moieties, or comprise one or more natural phosphate linkages and one or more modified internucleotidic linkages.

In some embodiments, oligonucleotides of a plurality comprise one or more modified sugar moieties. In some embodiments, provided oligonucleotides comprise one or more modified sugar moieties. In some embodiments, provided oligonucleotides comprise 2 or more modified sugar moieties. In some embodiments, provided oligonucleotides comprise 3 or more modified sugar moieties.

In some embodiments, provided compositions alter transcript splicing so that an undesired target and/or biological function are suppressed.

In some embodiments, provided compositions alter transcript splicing so a desired target and/or biological function is enhanced.

In some embodiments, each oligonucleotide of a plurality comprises one or more modified sugar moieties and modified internucleotidic linkages.

In some embodiments, each oligonucleotide of a plurality comprises no more than about 25 consecutive unmodified sugar moieties In some embodiments, each oligonucleotide of a plurality comprises no more than about 95% unmodified sugar moieties. In some embodiments, each oligonucleotide of a plurality comprises no more than about 90% unmodified sugar moieties. In some embodiments, each oligonucleotide of a plurality comprises no more than about 85% unmodified sugar moieties. In some embodiments, each oligonucleotide of a plurality comprises no more than about 15 consecutive unmodified sugar moieties.

In some embodiments, each oligonucleotide of a plurality comprises no more than about 95% unmodified sugar moieties.

In some embodiments, each oligonucleotide of a plurality comprises two or more modified internucleotidic linkages.

In some embodiments, about 5% of the internucleotidic linkages in each oligonucleotide of a plurality are modified internucleotidic linkages.

In some embodiments, each oligonucleotide of a plurality comprises no more than about 25 consecutive natural phosphate linkages. In some embodiments, each oligonucleotide of a plurality comprises no more than about 20 natural phosphate linkages.

In some embodiments, oligonucleotides of a plurality comprise no natural DNA nucleotide units. In some embodiments, oligonucleotides of a plurality comprise no more than 30 natural DNA nucleotides. In some embodiments, oligonucleotides of a plurality comprise no more than 30 consecutive DNA nucleotides.

In some embodiments, compared to a reference condition, provided chirally controlled oligonucleotide compositions are surprisingly effective. In some embodiments, desired biological effects (e.g., as measured by increased levels of desired mRNA, proteins, etc., decreased levels of undesired mRNA, proteins, etc.) can be enhanced by more than 5, 10, 15, 20, 25, 30, 40, 50, or 100 fold. In some embodiments, a change is measured by increase of a desired mRNA level compared to a reference condition. In some embodiments, a change is measured by decrease of an undesired mRNA level compared to a reference condition. In some embodiments, a reference condition is absence of oligonucleotide treatment. In some embodiments, a reference condition is a stereorandom composition of oligonucleotides having the same base sequence and chemical modifications.

In some embodiments, a desired biological effect is: improved skipping of one or more exons, increased stability, increased activity, increased stability and activity, low toxicity, low immune response, improved protein binding profile, increased binding to certain proteins, and/or enhanced delivery. In some embodiments, a desired biological effect is enhanced by more than 2 fold, 3 fold, 4 fold, 5 fold, 6 fold, 7 fold, 8 fold, 9 fold, 10 fold, 11 fold, 12 fold, 13 fold, 14 fold, 15 fold, 20 fold, 25 fold, 30 fold, 35 fold, 40 fold, 45 fold, 50 fold, 60 fold, 70 fold, 80 fold, 90 fold, 100 fold, 200 fold, or 500 fold.

In some embodiments, the structure of a DMD oligonucleotide is or comprises a wing-core-wing, wing-core, or core-wing structure. In some embodiments, a 5'-wing is a 5'-end region. In some embodiments, a 3'-wing is a 3'-end region. In some embodiments, a core is a middle region. In some embodiments, a 5'-end region is a 5'-wing region. In some embodiments, a 3'-end region is a 3'-wing region. In some embodiments, a middle region is a core region.

In some embodiments, an oligonucleotide having a wing-core-wing structure is designated a gapmer. In some embodiments, a gapmer is asymmetric, in that the chemistry of one wing is different from the chemistry of the other wing. In some embodiments, a gapmer is asymmetric, in that the chemistry of one wing is different from the chemistry of the other wing, wherein the wings differ in sugar modifications and/or internucleotidic linkages, or patterns thereof. In some embodiments, a gapmer is asymmetric, in that the chemistry of one wing is different from the chemistry of the other wing, wherein the wings differ in sugar modifications, wherein one wing comprises a sugar modification not present in the other wing; or both wings each comprise a sugar modification not found in the other wing; or both wings comprise different patterns of the same types of sugar modifications; or one wing comprises only one type of sugar modification, while the other wing comprises two types of sugar modifications; etc.

In some embodiments, an internucleotidic linkage between a wing region and a core region is considered part of the wing region. In some embodiments, an internucleotidic linkage between a 5'-wing region and a core region is considered part of the wing region. In some embodiments, an internucleotidic linkage between a 3'-wing region and a core region is considered part of the wing region. In some embodiments, an internucleotidic linkage between a wing region and a core region is considered part of the core region. In some embodiments, an internucleotidic linkage between a 5'-wing region and a core region is considered part of the core region. In some embodiments, an internucleotidic linkage between a 3'-wing region and a core region is considered part of the core region.

In some embodiments, a region (e.g., a wing region, a core region, a 5'-end region, a middle region, a 3'-end region, etc.) comprises 1, 2, 3, 4, 5, 6, 7, 8, 9, 10, 11, 12, 13, 14, 15, 16, 17, 18, 19, 20, 21, 22, 23, 24, 25, or more nucleoside units.

In some embodiments, provided oligonucleotides comprise two wing and one core regions. In some embodiments, provided oligonucleotides comprises a 5'-wing-core-wing-3' structure. In some embodiments, provided oligonucleotides are of a 5'-wing-core-wing-3' gapmer structure. In some embodiments, the two wing regions are identical. In some embodiments, the two wing regions are different. In some embodiments, the two wing regions are identical in chemical modifications. In some embodiments, the two wing regions are identical in 2'-modifications. In some embodiments, the two wing regions are identical in internucleotidic linkage modifications. In some embodiments, the two wing regions are identical in patterns of backbone chiral centers. In some embodiments, the two wing regions are identical in pattern of backbone linkages. In some embodiments, the two wing regions are identical in pattern of backbone linkage types. In some embodiments, the two wing regions are identical in pattern of backbone phosphorus modifications.

A wing region can be differentiated from a core region in that a wing region contains a different structure feature than a core region. For example, in some embodiments, a wing region differs from a core region in that they have different sugar modifications, base modifications, internucleotidic linkages, internucleotidic linkage stereochemistry, etc. In some embodiments, a wing region differs from a core region in that they have different 2'-modifications of the sugars.

In some embodiments, a region (e.g., a wing region, a core region, a 5'-end region, a middle region, a 3'-end region, etc.) comprises 1, 2, 3, 4, 5, 6, 7, 8, 9, 10, 11, 12, 13, 14, 15, 16, 17, 18, 19, 20, 21, 22, 23, 24, 25, or more modified internucleotidic linkages. In some embodiments, a region comprises 2 or more modified internucleotidic linkages. In some embodiments, a region comprises 3 or more modified internucleotidic linkages. In some embodiments, a region comprises 4 or more modified internucleotidic linkages. In some embodiments, a region comprises 5 or more modified internucleotidic linkages. In some embodiments, a region comprises 6 or more modified internucleotidic linkages. In some embodiments, a region comprises 7 or more modified internucleotidic linkages. In some embodiments, a region comprises 8 or more modified internucleotidic linkages. In some embodiments, a region comprises 9 or more modified internucleotidic linkages. In some embodiments, a region comprises 10 or more modified internucleotidic linkages.

In some embodiments, provided oligonucleotides comprise consecutive nucleoside units each of which comprises no 2'-OR$^1$ modifications (wherein R$^1$ is not hydrogen). In some embodiments, provided oligonucleotides comprise consecutive nucleoside units whose 2'-positions are independently unsubstituted or substituted with 2'-F. In some embodiments, such an oligonucleotide is a DMD oligonucleotide. In some embodiments, each of the consecutive nucleoside units is independently preceded and/or followed by a modified internucleotidic linkage. In some embodiments, each of the consecutive nucleoside units is independently preceded and/or followed by a phosphorothioate linkage. In some embodiments, each of the consecutive nucleoside units is independently preceded and/or followed by a chirally controlled modified internucleotidic linkage. In some embodiments, each of the consecutive nucleoside units is independently preceded and/or followed by a chirally controlled phosphorothioate linkage.

In some embodiments, a modified internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, etc., or a salt form thereof. In some embodiments, a modified internucleotidic linkage has a structure of formula I or a salt form thereof. In some embodiments, a modified internucleotidic linkage has a structure of formula I-a or a salt form thereof.

In some embodiments, a modified internucleotidic linkage is a non-negatively charged internucleotidic linkage. In some embodiments, a modified internucleotidic linkage is a positively-charged internucleotidic linkage. In some embodiments, a modified internucleotidic linkage is a neutral internucleotidic linkage. In some embodiments, a non-negatively charged internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, etc., or a salt form thereof. In some embodiments, a non-negatively charged internucleotidic linkage comprises an optionally substituted 3-20 membered heterocyclyl or heteroaryl group having 1-10 heteroatoms. In some embodiments, a non-negatively charged internucleotidic linkage comprises an optionally substituted 3-20 membered heterocyclyl or heteroaryl group having 1-10 heteroatoms, wherein at least one heteroatom is nitrogen. In some embodiments, such a heterocyclyl or heteroaryl group is of a 5-membered ring. In some embodiments, such a heterocyclyl or heteroaryl group is of a 6-membered ring.

In some embodiments, a non-negatively charged internucleotidic linkage comprises an optionally substituted 5-20 membered heteroaryl group having 1-10 heteroatoms. In some embodiments, a non-negatively charged internucleotidic linkage comprises an optionally substituted 5-20 membered heteroaryl group having 1-10 heteroatoms, wherein at least one heteroatom is nitrogen. In some embodiments, a non-negatively charged internucleotidic linkage comprises an optionally substituted 5-6 membered heteroaryl group having 1-4 heteroatoms, wherein at least one heteroatom is nitrogen. In some embodiments, a non-negatively charged internucleotidic linkage comprises an optionally substituted 5-membered heteroaryl group having 1-4 heteroatoms, wherein at least one heteroatom is nitrogen. In some embodiments, a heteroaryl group is directly bonded to a linkage phosphorus. In some embodiments, a non-negatively charged internucleotidic linkage comprises an optionally substituted triazolyl group. In some embodiments, a non-negatively charged internucleotidic linkage comprises an unsubstituted triazolyl group, e.g.,

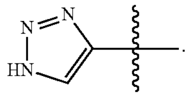

In some embodiments, a non-negatively charged internucleotidic linkage comprises a substituted triazolyl group, e.g.,

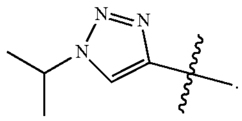 [SMILES: *c1cn(C(C)C)nn1]

In some embodiments, a non-negatively charged internucleotidic linkage comprises an optionally substituted 5-20 membered heterocyclyl group having 1-10 heteroatoms. In some embodiments, a non-negatively charged internucleotidic linkage comprises an optionally substituted 5-20 membered heterocyclyl group having 1-10 heteroatoms, wherein at least one heteroatom is nitrogen. In some embodiments, a non-negatively charged internucleotidic linkage comprises an optionally substituted 5-6 membered heterocyclyl group having 1-4 heteroatoms, wherein at least one heteroatom is nitrogen. In some embodiments, a non-negatively charged internucleotidic linkage comprises an optionally substituted 5-membered heterocyclyl group having 1-4 heteroatoms, wherein at least one heteroatom is nitrogen. In some embodiments, at least two heteroatoms are nitrogen. In some embodiments, a heterocyclyl group is directly bonded to a linkage phosphorus. In some embodiments, a heterocyclyl group is bonded to a linkage phosphorus through a linker, e.g., =N— when the heterocyclyl group is part of a guanidine moiety who directed bonded to a linkage phosphorus through its =N—. In some embodiments, a non-negatively charged internucleotidic linkage comprises an optionally substituted

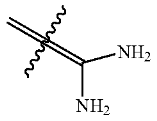

group. In some embodiments, a non-negatively charged internucleotidic linkage comprises an optionally substituted

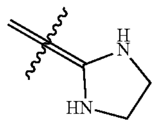 [SMILES: *=C1NCCN1]

group. In some embodiments, a non-negatively charged internucleotidic linkage comprises an substituted

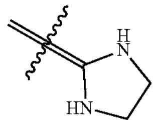 [SMILES: *=C1NCCN1]

group. In some embodiments, a non-negatively charged internucleotidic linkage comprises a

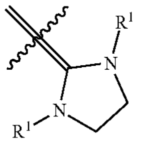

group. In some embodiments, each $R^1$ is independently optionally substituted $C_{1-20}$ alkyl. In some embodiments, each $R^1$ is independently optionally substituted $C_{1-6}$ alkyl. In some embodiments, each $R^1$ is independently methyl. In some embodiments, the two $R^1$ groups are different; for example, in some embodiments, one $R^1$ is methyl, and the other is $—CH_2(CH_2)_{10}CH_3$.

In some embodiments, a modified internucleotidic linkage, e.g., a non-negatively charged internucleotidic linkage, comprises a triazole or alkyne moiety, each of which is optionally substituted. In some embodiments, a modified internucleotidic linkage comprises a triazole moiety. In some embodiments, a modified internucleotidic linkage comprises a unsubstituted triazole moiety. In some embodiments, a modified internucleotidic linkage comprises a substituted triazole moiety. In some embodiments, a modified internucleotidic linkage comprises an alkyl moiety. In some embodiments, a modified internucleotidic linkage comprises an optionally substituted alkynyl group. In some embodiments, a modified internucleotidic linkage comprises an unsubstituted alkynyl group. In some embodiments, a modified internucleotidic linkage comprises a substituted alkynyl group. In some embodiments, an alkynyl group is directly bonded to a linkage phosphorus.

In some embodiments, an oligonucleotide comprising a non-negatively charged internucleotidic linkage can comprise any structure, format, or portion thereof described herein. In some embodiments, an oligonucleotide comprising a non-negatively charged internucleotidic linkage can comprise any structure, format, or portion thereof described herein as being a component of a DMD oligonucleotide. In some embodiments, any structure, format, or portion thereof described as being a component of any DMD oligonucleotide can be used in any oligonucleotide comprising a non-negatively charged internucleotidic linkage, whether or not that oligonucleotide targets DMD or not, or whether the oligonucleotide is capable of mediating skipping of a DMD exon or not. In some embodiments, an oligonucleotide comprising a non-negatively charged internucleotidic is double-stranded or single-stranded.

In some embodiments, a provided oligonucleotide composition is characterized in that, when it is contacted with the transcript in a transcript splicing system, splicing of the transcript is altered relative to that observed under reference conditions selected from the group consisting of absence of the composition, presence of a reference composition, and combinations thereof. In some embodiments, a desired splicing product is increased 10%, 20%, 30%, 40%, 50%, 60%, 70%, 80%, 90%, 100%, or 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 200, 300, 400, 500, 600, 700, 800, 900, 1000 fold or more. In some embodiments, a desired splicing reference is absent (e.g., cannot be reliably detected by quantitative PCR) under reference conditions. In some embodiments, as exemplified in the present disclosure, levels of the plurality of oligonucleotides, e.g., a plurality of oligonucleotides, in provided compositions are pre-determined.

In some embodiments, provided oligonucleotides, e.g., oligonucleotides of a plurality in a provided composition, comprise two or more regions. In some embodiments, provided comprise a 5'-end region, a 3'-end region, and a middle region in between. In some embodiments, provided oligonucleotides have two wing and one core regions. In some embodiments, provided oligonucleotides are of a wing-core-wing structure. In some embodiments, the two wing regions are identical. In some embodiments, the two wing regions are different. In some embodiments, a 5'-end region is a 5'-wing region. In some embodiments, a 5'-wing region is a 5'-end region. In some embodiments, a 3'-end region is a 3'-wing region. In some embodiments, a 3'-wing region is a 3'-end region. In some embodiments, a core region is a middle region.

In some embodiments, a region (e.g., a 5'-wing region, a 3'-wing, a core region, a 5'-end region, a middle region, etc.) comprises 1, 2, 3, 4, 5, 6, 7, 8, 9, 10, 11, 12, 13, 14, 15, 16, 17, 18, 19, 20, 21, 22, 23, 24, 25, or more nucleoside units. In some embodiments, a region comprises 2 or more nucleoside units. In some embodiments, a region comprises 3 or more nucleoside units. In some embodiments, a region comprises 4 or more nucleoside units. In some embodiments, a region comprises 5 or more nucleoside units. In some embodiments, a region comprises 6 or more nucleoside units. In some embodiments, a region comprises 7 or more nucleoside units. In some embodiments, a region comprises 8 or more nucleoside units. In some embodiments, a region comprises 9 or more nucleoside units. In some embodiments, a region comprises 10 or more nucleoside units.

In some embodiments, a region (e.g., a 5'-wing region, a 3'-wing, a core region, a 5'-end region, a middle region, etc.) comprises 1, 2, 3, 4, 5, 6, 7, 8, 9, 10, 11, 12, 13, 14, 15, 16, 17, 18, 19, 20, 21, 22, 23, 24, 25, or more modified internucleotidic linkages. In some embodiments, a region comprises 2 or more modified internucleotidic linkages. In some embodiments, the one or more modified internucleotidic linkages are consecutive. In some embodiments, a region comprises 2 or more consecutive modified internucleotidic linkages. In some embodiments, each internucleotidic linkage in a region is independently a modified internucleotidic linkage, wherein each chiral internucleotidic linkage is optionally and independently chirally controlled. In some embodiments, a chiral internucleotidic linkage or a modified internucleotidic linkage has the structure of formula I or a salt form thereof. In some embodiments, a chiral internucleotidic linkage or a modified internucleotidic linkage is a phosphorothioate internucleotidic linkage. In some embodiments, each chiral internucleotidic linkage or a modified internucleotidic linkage independently has the structure of formula I or a salt form thereof. In some embodiments, each chiral internucleotidic linkage or a modified internucleotidic linkage is a phosphorothioate internucleotidic linkage. In some embodiments, a region comprises 3 or consecutive modified internucleotidic linkages.

In some embodiments, a wing region comprises one or more natural phosphate linkages. In some embodiments, a core region comprises one or more natural phosphate linkages. In some embodiments, a 5'-end region comprises one or more natural phosphate linkages. In some embodiments, a 3'-end region comprises one or more natural phosphate linkages. In some embodiments, a middle region comprises one or more natural phosphate linkages. In some embodiments, the one or more natural phosphate linkages are consecutive.

In some embodiments, a natural phosphate linkage follows (e.g., connected to a 3'-position of a sugar moiety) or precedes (e.g., connected to a 5'-position of a sugar moiety) a nucleoside unit whose sugar moiety comprises a 2'-$OR^1$ modification, wherein $R^1$ is not hydrogen. In some embodiments, $R^1$ is optionally substituted $C_{1-6}$ aliphatic. In some embodiments, a modified internucleotidic linkage follows (e.g., connected to a 3'-position of a sugar moiety) or precedes (e.g., connected to a 5'-position of a sugar moiety) all or most (e.g., more than 55%, 60%, 70%, 80%, 90%, 95%, etc.) nucleoside units whose sugar moiety comprises no 2'-$OR^1$ modification, wherein $R^1$ is not hydrogen (e.g., those having two 2'-H at the 2'-position, those having a 2'-H and a 2'-F at the 2'-position (2'-F modified), etc.).

In some embodiments, a region comprises one or more nucleoside units comprising sugar modifications, e.g., 2'-F, 2'-$OR^1$, LNA sugar modifications, etc. In some embodiments, each sugar in a region is independently modified. In some embodiments, each sugar moiety in a wing, a 5'-end region, and/or a 3'-end region is modified. In some embodiments, a modification is a 2'-modification. In some embodiments, a modification can increase stability, e.g., 2'-$OR^1$ where in $R^1$ is not —H (e.g., is optionally substituted $C_{1-6}$ aliphatic), LNA sugar modifications, etc. In some embodiments, a region, e.g., a core region or a middle region, comprise no sugar modifications (or no 2'-$OR^1$ sugar modifications/LNA modifications etc.). In some embodiments, such a core/middle region can form a duplex with a RNA for recognition/binding of a protein, e.g., RNase H, for the protein to perform one or more of its functions (e.g., in the case of RNase H, its binding and cleavage of DNA/RNA duplex).

A region and/or a provided oligonucleotide may have various patterns of backbone chiral centers. In some embodiments, each internucleotidic linkage in a region is a chirally controlled internucleotidic linkage and is Sp. In some embodiments, the 5'-end and/or the 3'-end internucleotidic linkage is a chirally controlled internucleotidic linkage and is Sp. In some embodiments, the pattern of backbone chiral centers of a wing region, a 5'-end region, and/or a 3'-end region is or comprises a 5'-end and/or a 3'-end internucleotidic linkage which is a chirally controlled internucleotidic linkage and is Sp, with the other internucleotidic linkages in the region independently being an natural phosphate linkage, a modified internucleotidic linkage, or a chirally controlled internucleotidic linkage (Sp or Rp). In some embodiments, such patterns provide stability. Many example patterns of backbone chiral centers are described in the present disclosure.

In some embodiments, the present disclosure provides a chirally controlled oligonucleotide composition comprising a plurality of oligonucleotides defined by having:

1) a common base sequence;
2) a common pattern of backbone linkages; and
3) a common pattern of backbone chiral centers, which composition is a substantially pure preparation of a single oligonucleotide in that a controlled level of the oligonucleotides in the composition have the common base sequence and length, the common pattern of backbone linkages, and the common pattern of backbone chiral centers.

In some embodiments, oligonucleotides having a common base sequence may have the same pattern of nucleoside modifications, e.g., sugar modifications, base modifications, etc. In some embodiments, a pattern of nucleoside modifications may be represented by a combination of locations and modifications. In some embodiments, all non-chiral linkages (e.g., PO) may be omitted. In some embodiments, oligonucleotides having the same base sequence have the same constitution.

As understood by a person having ordinary skill in the art, a stereorandom or racemic preparation of oligonucleotides is prepared by non-stereoselective and/or low-stereoselective coupling of nucleotide monomers, typically without using any chiral auxiliaries, chiral modification reagents, and/or chiral catalysts. In some embodiments, in a substantially racemic (or chirally uncontrolled) preparation of oligonucleotides, all or most coupling steps are not chirally controlled in that the coupling steps are not specifically conducted to provide enhanced stereoselectivity. An example substantially racemic preparation of oligonucleotides is the preparation of phosphorothioate oligonucleotides through sulfurizing phosphite triesters from commonly used phosphoramidite oligonucleotide synthesis with either tetraethylthiuram disulfide or (TETD) or 3H-1,2-bensodithiol-3-one 1,1-dioxide (BDTD), a well-known process in the art. In some embodiments, substantially racemic preparation of oligonucleotides provides substantially racemic oligonucleotide compositions (or chirally uncontrolled oligonucleotide compositions). In some embodiments, at least one coupling of a nucleotide monomer has a diastereoselectivity lower than about 60:40, 70:30, 80:20, 85:15, 90:10, 91:9, 92:8, 97:3, 98:2, or 99:1. In some embodiments, each internucleotidic linkage independently has a diastereoselectivity lower than about 60:40, 70:30, 80:20, 85:15, 90:10, 91:9, 92:8, 97:3, 98:2, or 99:1. In some embodiments, a diastereoselectivity is lower than about 60:40. In some embodiments, a diastereoselectivity is lower than about 70:30. In some embodiments, a diastereoselectivity is lower than about 80:20. In some embodiments, a diastereoselectivity is lower than about 90:10. In some embodiments, a diastereoselectivity is lower than about 91:9. In some embodiments, at least one internucleotidic linkage has a diastereoselectivity lower than about 90:10. In some embodiments, at least two internucleotidic linkages have a diastereoselectivity lower than about 90:10. In some embodiments, at least three internucleotidic linkages have a diastereoselectivity lower than about 90:10. In some embodiments, at least four internucleotidic linkages have a diastereoselectivity lower than about 90:10. In some embodiments, at least five internucleotidic linkages have a diastereoselectivity lower than about 90:10. In some embodiments, each internucleotidic linkage independently has a diastereoselectivity lower than about 90:10. In some embodiments, a non-chirally controlled internucleotidic linkage has a diastereomeric purity no more than 90%, 85%, 80%, 75%, 70%, 65%, 60%, or 55%. In some embodiments, the purity is no more than 90%. In some embodiments, the purity is no more than 85%. In some embodiments, the purity is no more than 80%.

In contrast, in chirally controlled oligonucleotide composition, at least one and typically each chirally controlled internucleotidic linkage, such as those of oligonucleotides of chirally controlled oligonucleotide compositions, independently has a diastereomeric purity of 90%, 91%, 92%, 93%, 94%, 95%, 96%, 97%, 98%, 99% or more with respect to the chiral linkage phosphorus. In some embodiments, a diastereomeric purity is 95% or more. In some embodiments, a diastereomeric purity is 96% or more. In some embodiments, a diastereomeric purity is 97% or more. In some embodiments, a diastereomeric purity is 98% or more. In some embodiments, a diastereomeric purity is 99% or more. Among other things, technologies of the present disclosure routinely provide chirally controlled internucleotidic linkages with high diastereomeric purity.

As appreciated by a person having ordinary skill in the art, diastereoselectivity of a coupling or diastereomeric purity (diastereopurity) of an internucleotidic linkage can be assessed through the diastereoselectivity of a dimer formation/diastereomeric purity of the internucleotidic linkage of a dimer formed under the same or comparable conditions, wherein the dimer has the same 5'- and 3'-nucleosides and internucleotidic linkage.

In some embodiments, the present disclosure provides chirally controlled (and/or stereochemically pure) oligonucleotide compositions comprising a plurality of oligonucleotides defined by having:

1) a common base sequence;
2) a common pattern of backbone linkages; and
3) a common pattern of backbone chiral centers, which composition is a substantially pure preparation of a single oligonucleotide in that at least about 10% of the oligonucleotides in the composition have the common base sequence and length, the common pattern of backbone linkages, and the common pattern of backbone chiral centers.

In some embodiments, the present disclosure provides chirally controlled oligonucleotide composition of a plurality of oligonucleotides, wherein the composition is enriched, relative to a substantially racemic preparation of the same oligonucleotides, for oligonucleotides of a single oligonucleotide type. In some embodiments, the present disclosure provides chirally controlled oligonucleotide composition of a plurality of oligonucleotides wherein the composition is enriched, relative to a substantially racemic preparation of the same oligonucleotides, for oligonucleotides of a single oligonucleotide type defined by:

1) base sequence;
2) pattern of backbone linkages;
3) pattern of backbone chiral centers; and
4) pattern of backbone phosphorus modifications.

In some embodiments, the present disclosure provides a chirally controlled oligonucleotide composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications.

wherein the composition is enriched, relative to a substantially racemic preparation of oligonucleotides having the same base sequence and length, for oligonucleotides of the particular oligonucleotide type.

In some embodiments, oligonucleotides having a common base sequence, a common pattern of backbone linkages, and a common pattern of backbone chiral centers have a common pattern of backbone phosphorus modifications and a common pattern of base modifications. In some embodiments, oligonucleotides having a common base sequence, a common pattern of backbone linkages, and a common pattern of backbone chiral centers have a common pattern of backbone phosphorus modifications and a common pattern of nucleoside modifications. In some embodiments, oligonucleotides having a common base sequence, a common pattern of backbone linkages, and a common pattern of backbone chiral centers have identical structures.

In some embodiments, oligonucleotides of an oligonucleotide type have a common pattern of backbone phosphorus modifications and a common pattern of sugar modifications. In some embodiments, oligonucleotides of an oligonucleotide type have a common pattern of backbone phosphorus modifications and a common pattern of base modifications. In some embodiments, oligonucleotides of an oligonucleotide type have a common pattern of backbone phosphorus modifications and a common pattern of nucleoside modifications. In some embodiments, oligonucleotides of a particular type have the same constitution. In some embodiments, oligonucleotides of an oligonucleotide type are identical.

In some embodiments, a chirally controlled oligonucleotide composition is a substantially pure preparation of an oligonucleotide type in that oligonucleotides in the composition that are not of the oligonucleotide type are impurities form the preparation process of said oligonucleotide type, in some case, after certain purification procedures.

In some embodiments, at least about 20%, 30%, 40%, 50%, 60%, 70%, 80%, 90%, or 95% of the oligonucleotides in the composition have a common base sequence, a common pattern of backbone linkages, and a common pattern of backbone chiral centers.

In some embodiments, oligonucleotides having a common base sequence, a common pattern of backbone linkages, and a common pattern of backbone chiral centers have a common pattern of backbone phosphorus modifications. In some embodiments, oligonucleotides having a common base sequence, a common pattern of backbone linkages, and a common pattern of backbone chiral centers have a common pattern of backbone phosphorus modifications and a common pattern of nucleoside modifications. In some embodiments, oligonucleotides having a common base sequence, a common pattern of backbone linkages, and a common pattern of backbone chiral centers have a common pattern of backbone phosphorus modifications and a common pattern of sugar modifications. In some embodiments, oligonucleotides having a common base sequence, a common pattern of backbone linkages, and a common pattern of backbone chiral centers have a common pattern of backbone phosphorus modifications and a common pattern of base modifications. In some embodiments, oligonucleotides having a common base sequence, a common pattern of backbone linkages, and a common pattern of backbone chiral centers are identical.

In some embodiments, purity of a chirally controlled oligonucleotide composition of an oligonucleotide type is expressed as the percentage of oligonucleotides in the composition that are of the oligonucleotide type. In some embodiments, at least about 10% of the oligonucleotides in a chirally controlled oligonucleotide composition are of the oligonucleotide type. In some embodiments, at least about 20% of the oligonucleotides in a chirally controlled oligonucleotide composition are of the oligonucleotide type. In some embodiments, at least about 30% of the oligonucleotides in a chirally controlled oligonucleotide composition are of the oligonucleotide type. In some embodiments, at least about 40% of the oligonucleotides in a chirally controlled oligonucleotide composition are of the oligonucleotide type. In some embodiments, at least about 50% of the oligonucleotides in a chirally controlled oligonucleotide composition are of the oligonucleotide type. In some embodiments, at least about 60% of the oligonucleotides in a chirally controlled oligonucleotide composition are of the oligonucleotide type. In some embodiments, at least about 70% of the oligonucleotides in a chirally controlled oligonucleotide composition are of the oligonucleotide type. In some embodiments, at least about 80% of the oligonucleotides in a chirally controlled oligonucleotide composition are of the oligonucleotide type. In some embodiments, at least about 90% of the oligonucleotides in a chirally controlled oligonucleotide composition are of the oligonucleotide type. In some embodiments, at least about 92% of the oligonucleotides in a chirally controlled oligonucleotide composition are of the oligonucleotide type. In some embodiments, at least about 94% of the oligonucleotides in a chirally controlled oligonucleotide composition are of the oligonucleotide type. In some embodiments, at least about 95% of the oligonucleotides in a chirally controlled oligonucleotide composition are of the oligonucleotide type. In some embodiments, at least about 96% of the oligonucleotides in a chirally controlled oligonucleotide composition are of the same oligonucleotide type. In some embodiments, at least about 97% of the oligonucleotides in a chirally controlled oligonucleotide composition are of the oligonucleotide type. In some embodiments, at least about 98% of the oligonucleotides in a chirally controlled oligonucleotide composition are of the oligonucleotide type. In some embodiments, at least about 99% of the oligonucleotides in a chirally controlled oligonucleotide composition are of the oligonucleotide type.

In some embodiments, purity of a chirally controlled oligonucleotide composition can be controlled by stereoselectivity of each coupling step in its preparation process. In some embodiments, a coupling step has a stereoselectivity (e.g., diastereoselectivity) of 60% (60% of the new internucleotidic linkage formed from the coupling step has the intended stereochemistry). After such a coupling step, the new internucleotidic linkage formed may be referred to have a 60% purity. In some embodiments, each coupling step has a stereoselectivity of at least 60%. In some embodiments, each coupling step has a stereoselectivity of at least 70%. In some embodiments, each coupling step has a stereoselectivity of at least 80%. In some embodiments, each coupling step has a stereoselectivity of at least 85%. In some embodiments, each coupling step has a stereoselectivity of at least 90%. In some embodiments, each coupling step has a stereoselectivity of at least 91%. In some embodiments, each coupling step has a stereoselectivity of at least 92%. In some embodiments, each coupling step has a stereoselectivity of at least 93%. In some embodiments, each coupling step has a stereoselectivity of at least 94%. In some embodiments, each coupling step has a stereoselectivity of at least 95%. In some embodiments, each coupling step has a stereoselectivity of at least 96%. In some embodiments, each coupling step has a stereoselectivity of at least 97%. In some embodiments, each coupling step has a stereoselectivity of at least 98%. In some embodiments, each coupling step has a stereoselectivity of at least 99%. In some embodiments, each coupling step has a stereoselectivity of at least 99.5%. In some embodiments, each coupling step has a stereoselectivity of virtually 100%. In some embodiments, a coupling step has a stereoselectivity of virtually 100% in that all detectable product from the coupling step by an analytical method (e.g., NMR, HPLC, use of a nuclease which stereoselectively cleaves phosphorothioates, etc) has the intended stereoselectivity. In some embodiments, stereoselectivity of a chiral internucleotidic linkage in an oligonucleotide may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage (e.g., for fU*SfU*SfC*SfU, through the dimer of fU*SfC). As appreciated by a person having ordinary skill in the art, percentage of oligonucleotides of a particular type having n chirally controlled internucleotidic linkages in a preparation may be calculated as $DP^1*DP^2*DP^3* \ldots DP^n$, wherein each of $DP^1$, $DP^2$, $DP^3$, . . . , and $DP^n$ is independently the diastereomeric purity of the 1$^{st}$, 2$^{nd}$, 3$^{rd}$, . . . , and n$^{th}$ chirally controlled internucleotidic linkage. In some embodiments, each of $DP^1$, $DP^2$, $DP^3$, . . . , and $DP^n$ is independently 90%, 91%, 92%, 93%, 94%, 95%, 96%, 97%, 97% or 99% or more. In some embodiments, each of $DP^1$, $DP^2$, $DP^3$, . . . , and $DP^n$ is independently 95% or more.

In some embodiments, in provided compositions, at least 0.5%, 1%, 2%, 3%, 4%, 5%, 6%, 7%, 8%, 9%, 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% of oligonucleotides that have the base sequence of a particular oligonucleotide type (defined by 1) base sequence; 2) pattern of backbone linkages; 3) pattern of backbone chiral centers; and 4) pattern of backbone phosphorus modifications) are oligonucleotides of the particular oligonucleotide type. In some embodiments, at least 0.5%, 1%, 2%, 3%, 4%, 5%, 6%, 7%, 8%, 9%, 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% of oligonucleotides that have the base sequence, the pattern of backbone linkages, and the pattern of backbone phosphorus modifications of a particular oligonucleotide type are oligonucleotides of the particular oligonucleotide type.

In some embodiments, oligonucleotides of a particular type in a chirally controlled oligonucleotide composition is enriched at least 5 fold (oligonucleotides of the particular type have a fraction of 5* ($\frac{1}{2}^n$) of oligonucleotides that have the base sequence, the pattern of backbone linkages, and the pattern of backbone phosphorus modifications of the particular oligonucleotide type, wherein n is the number of chiral internucleotidic linkages; or oligonucleotides that have the base sequence, the pattern of backbone linkages, and the pattern of backbone phosphorus modifications of the particular oligonucleotide type but are not of the particular oligonucleotide type are no more than [1-($\frac{1}{2}^n$)]/5 of oligonucleotides that have the base sequence, the pattern of backbone linkages, and the pattern of backbone phosphorus modifications of the particular oligonucleotide type) compared to a stereorandom preparation of the oligonucleotides (oligonucleotides of the particular type are typically considered to have a fraction of $\frac{1}{2}^n$ of oligonucleotides that have the base sequence, the pattern of backbone linkages, and the pattern of backbone phosphorus modifications of the particular oligonucleotide type, wherein n is the number of chiral internucleotidic linkages, and oligonucleotides that have the base sequence, the pattern of backbone linkages, and the pattern of backbone phosphorus modifications of the particular oligonucleotide type but are not of the particular oligonucleotide type are typically considered to have a fraction of [1-(½$^n$)] of oligonucleotides that have the base sequence, the pattern of backbone linkages, and the pattern of backbone phosphorus modifications of the particular oligonucleotide type). In some embodiments, the enrichment is at least 20 fold. In some embodiments, the enrichment is at least 30 fold. In some embodiments, the enrichment is at least 40 fold. In some embodiments, the enrichment is at least 50 fold. In some embodiments, the enrichment is at least 60 fold. In some embodiments, the enrichment is at least 70 fold. In some embodiments, the enrichment is at least 80 fold. In some embodiments, the enrichment is at least 90 fold. In some embodiments, the enrichment is at least 100 fold. In some embodiments, the enrichment is at least 20,000 fold. In some embodiments, the enrichment is at least $(1.5)^n$. In some embodiments, the enrichment is at least $(1.6)^n$. In some embodiments, the enrichment is at least $(1.7)^n$. In some embodiments, the enrichment is at least $(1.1)^n$. In some embodiments, the enrichment is at least $(1.8)^n$. In some embodiments, the enrichment is at least $(1.9)^n$. In some embodiments, the enrichment is at least $2^n$. In some embodiments, the enrichment is at least $3^n$. In some embodiments, the enrichment is at least $4^n$. In some embodiments, the enrichment is at least $5^n$. In some embodiments, the enrichment is at least $6^n$. In some embodiments, the enrichment is at least $7^n$. In some embodiments, the enrichment is at least $8^n$. In some embodiments, the enrichment is at least $9^n$. In some embodiments, the enrichment is at least $10^n$. In some embodiments, the enrichment is at least $15^n$. In some embodiments, the enrichment is at least $20^n$. In some embodiments, the enrichment is at least $25^n$. In some embodiments, the enrichment is at least $30^n$. In some embodiments, the enrichment is at least $40^n$. In some embodiments, the enrichment is at least $50^n$. In some embodiments, the enrichment is at least $100^n$. In some embodiments, enrichment is measured by increase of the fraction of oligonucleotides of the particular oligonucleotide type in oligonucleotides that have the base sequence, the pattern of backbone linkages, and the pattern of backbone phosphorus modifications of the particular oligonucleotide type. In some embodiments, an enrichment is measured by decrease of the fraction of oligonucleotides that have the base sequence, the pattern of backbone linkages, and the pattern of backbone phosphorus modifications of the particular oligonucleotide type but are not of the particular oligonucleotide type in oligonucleotides that have the base sequence, the pattern of backbone linkages, and the pattern of backbone phosphorus modifications of the particular oligonucleotide type.

In some embodiments, provided oligonucleotides are antisense oligonucleotides. In some embodiments, provided oligonucleotides are siRNA oligonucleotides. In some embodiments, a provided chirally controlled oligonucleotide composition is of oligonucleotides that can be antisense oligonucleotide, antagomir, microRNA, pre-microRNA, antimir, supermir, ribozyme, Ul adaptor, RNA activator, RNAi agent, decoy oligonucleotide, triplex forming oligonucleotide, aptamer or adjuvant. In some embodiments, a chirally controlled oligonucleotide composition is of antisense oligonucleotides. In some embodiments, a chirally controlled oligonucleotide composition is of siRNA oligonucleotides. In some embodiments, a chirally controlled oligonucleotide composition is of antagomir oligonucleotides. In some embodiments, a chirally controlled oligonucleotide composition is of microRNA oligonucleotides. In some embodiments, a chirally controlled oligonucleotide composition is of pre-microRNA oligonucleotides. In some embodiments, a chirally controlled oligonucleotide composition is of antimir oligonucleotides. In some embodiments, a chirally controlled oligonucleotide composition is of supermir oligonucleotides. In some embodiments, a chirally controlled oligonucleotide composition is of ribozyme oligonucleotides. In some embodiments, a chirally controlled oligonucleotide composition is of Ul adaptor oligonucleotides. In some embodiments, a chirally controlled oligonucleotide composition is of RNA activator oligonucleotides. In some embodiments, a chirally controlled oligonucleotide composition is of RNAi agent oligonucleotides. In some embodiments, a chirally controlled oligonucleotide composition is of decoy oligonucleotides. In some embodiments, a chirally controlled oligonucleotide composition is of triplex forming oligonucleotides. In some embodiments, a chirally controlled oligonucleotide composition is of aptamer oligonucleotides. In some embodiments, a chirally controlled oligonucleotide composition is of adjuvant oligonucleotides.

In some embodiments, a provided oligonucleotide comprises one or more chiral, modified phosphate linkages. In some embodiments, provided chirally controlled (and/or stereochemically pure) preparations are of oligonucleotides that include one or more modified backbone linkages, bases, and/or sugars.

In some embodiments, provided chirally controlled (and/or stereochemically pure) preparations are of a stereochemical purity of greater than about 80%. In some embodiments, provided chirally controlled (and/or stereochemically pure) preparations are of a stereochemical purity of greater than about 85%. In some embodiments, provided chirally controlled (and/or stereochemically pure) preparations are of a stereochemical purity of greater than about 90%. In some embodiments, provided chirally controlled (and/or stereochemically pure) preparations are of a stereochemical purity of greater than about 91%. In some embodiments, provided chirally controlled (and/or stereochemically pure) preparations are of a stereochemical purity of greater than about 92%. In some embodiments, provided chirally controlled (and/or stereochemically pure) preparations are of a stereochemical purity of greater than about 93%. In some embodiments, provided chirally controlled (and/or stereochemically pure) preparations are of a stereochemical purity of greater than about 94%. In some embodiments, provided chirally controlled (and/or stereochemically pure) preparations are of a stereochemical purity of greater than about 95%. In some embodiments, provided chirally controlled (and/or stereochemically pure) preparations are of a stereochemical purity of greater than about 96%. In some embodiments, provided chirally controlled (and/or stereochemically pure) preparations are of a stereochemical purity of greater than about 97%. In some embodiments, provided chirally controlled (and/or stereochemically pure) preparations are of a stereochemical purity of greater than about 98%. In some embodiments, provided chirally controlled (and/or stereochemically pure) preparations are of a stereochemical purity of greater than about 99%.

In some embodiments, at least 5%, 10%, 15%, 20%, 25%, 30%, 35%, 40%, 45%, 50%, 55%, 60%, 65%, 70%, 75%, 80%, 85%, 90%, 95%, or 100% of the internucleotidic linkages of an oligonucleotide are independently chiral internucleotidic linkages. In some embodiments, all chiral, modified internucleotidic linkages are chiral phosphorothioate internucleotidic linkages. In some embodiments, all chiral, modified internucleotidic linkages except non-negatively charged internucleotidic linkages are chiral phosphorothioate internucleotidic linkages. In some embodiments, each chiral internucleotidic linkage is chirally controlled. In some embodiments, at least about 10, 20, 30, 40, 50, 60, 70, 80, or 90% chiral internucleotidic linkages of an oligonucleotide are chirally controlled and are of the Sp conformation. In some embodiments, at least about 10, 20, 30, 40, 50, 60, 70, 80, or 90% phosphorothioate internucleotidic linkages of an oligonucleotide are chirally controlled and are of the Sp conformation. In some embodiments, the percentage is at least about 10%. In some embodiments, the percentage is at least about 20%. In some embodiments, the percentage is at least about 30%. In some embodiments, the percentage is at least about 40%. In some embodiments, the percentage is at least about 50%. In some embodiments, the percentage is at least about 60%. In some embodiments, the percentage is at least about 70%. In some embodiments, the percentage is at least about 80%. In some embodiments, the percentage is at least about 90%.

In some embodiments, at least about 10, 20, 30, 40, 50, 60, 70, 80, or 90% chiral internucleotidic linkages of an oligonucleotide are chirally controlled and are of the Rp conformation. In some embodiments, at least about 10, 20, 30, 40, 50, 60, 70, 80, or 90% chiral phosphorothioate internucleotidic linkages of an oligonucleotide are chirally controlled and are of the Rp conformation. In some embodiments, the percentage is at least about 10%. In some embodiments, the percentage is at least about 20%. In some embodiments, the percentage is at least about 30%. In some embodiments, no more than 10, 20, 30, 40, 50, 60, 70, 80, or 90% chiral internucleotidic linkages of an oligonucleotide are chirally controlled and are of the Rp conformation. In some embodiments, no more than 10, 20, 30, 40, 50, 60, 70, 80, or 90% phosphorothioate internucleotidic linkages of an oligonucleotide are of the Rp conformation. In some embodiments, the percentage is no more than 10%. In some embodiments, the percentage is no more than 20%. In some embodiments, the percentage is no more than 30%.

In some embodiments, provided chirally controlled (and/or stereochemically pure) compositions are of oligonucleotides that contain one or more modified bases. In some embodiments, provided chirally controlled (and/or stereochemically pure) compositions are of oligonucleotides that contain no modified bases. As appreciated by those skilled in the art, many types of modified bases can be utilized in accordance with the present disclosure. Example modified bases are described herein.

In some embodiments, oligonucleotides of provided compositions comprise at least 2, 3, 4, 5, 6, 7, 8, 9 or 10 natural phosphate linkages. In some embodiments, oligonucleotides of provided compositions comprise at least one natural phosphate linkage. In some embodiments, oligonucleotides of provided compositions comprise at least two natural phosphate linkages. In some embodiments, oligonucleotides of provided compositions comprise at least three natural phosphate linkages.

In some embodiments, oligonucleotides of provided compositions comprise 1, 2, 3, 4, 5, 6, 7, 8, 9 or 10 natural phosphate linkages. In some embodiments, oligonucleotides of provided compositions comprise one natural phosphate linkage. In some embodiments, oligonucleotides of provided compositions comprise two natural phosphate linkages. In some embodiments, oligonucleotides of provided compositions comprise three natural phosphate linkages. In some embodiments, oligonucleotides of provided compositions comprise four natural phosphate linkages. In some embodiments, oligonucleotides of provided compositions comprise five natural phosphate linkages. In some embodiments, oligonucleotides of provided compositions comprise six natural phosphate linkages. In some embodiments, oligonucleotides of provided compositions comprise seven natural phosphate linkages. In some embodiments, oligonucleotides of provided compositions comprise eight natural phosphate linkages. In some embodiments, oligonucleotides of provided compositions comprise nine natural phosphate linkages. In some embodiments, oligonucleotides of provided compositions comprise ten natural phosphate linkages.

In some embodiments, oligonucleotides of provided compositions comprise at least 2, 3, 4, 5, 6, 7, 8, 9 or 10 consecutive natural phosphate linkages. In some embodiments, oligonucleotides of provided compositions comprise at least two consecutive natural phosphate linkages. In some embodiments, oligonucleotides of provided compositions comprise at least three consecutive natural phosphate linkages.

In some embodiments, oligonucleotides of the present disclosure have at least 8, 9, 10, 11, 12, 13, 14, 15, 16, 17, 18, 19, 20, 21, 22, 23, 24, 25, 30, 35, 40, 45, 50, 55, 60, 65, 70, or 75 nucleobases in length. In some embodiments, oligonucleotides of the present disclosure comprises at least 8, 9, 10, 11, 12, 13, 14, 15, 16, 17, 18, 19, 20, 21, 22, 23, 24, 25, 30, 35, 40, 45, 50, 55, 60, 65, 70, or 75 nucleobases in length, wherein each nucleobase is independently optionally substituted A, T, C, G, U, or a tautomer thereof.

In some embodiments, provided compositions comprise oligonucleotides containing one or more residues which are modified at the sugar moiety. In some embodiments, provided compositions comprise oligonucleotides containing one or more residues which are modified at the 2' position of the sugar moiety (referred to herein as a "2'-modification"). Examples of such modifications are described herein and include, but are not limited to, 2'-OMe, 2'-MOE, 2'-LNA, 2'-F, FRNA, FANA, S-cEt, etc. In some embodiments, provided compositions comprise oligonucleotides containing one or more residues which are 2'-modified. For example, in some embodiments, provided oligonucleotides contain one or more residues which are 2'-O-methoxyethyl (2'-MOE)-modified residues. In some embodiments, provided compositions comprise oligonucleotides which do not contain any 2'-modifications. In some embodiments, provided compositions are oligonucleotides which do not contain any 2'-MOE residues. That is, in some embodiments, provided oligonucleotides are not MOE-modified. Additional example sugar modifications are described in the present disclosure.

In some embodiments, one or more is one. In some embodiments, one or more is two. In some embodiments, one or more is three. In some embodiments, one or more is four. In some embodiments, one or more is five. In some embodiments, one or more is six. In some embodiments, one or more is seven. In some embodiments, one or more is eight. In some embodiments, one or more is nine. In some embodiments, one or more is ten. In some embodiments, one or more is at least one. In some embodiments, one or more is at least two. In some embodiments, one or more is at least three. In some embodiments, one or more is at least four. In some embodiments, one or more is at least five. In some embodiments, one or more is at least six. In some embodiments, one or more is at least seven. In some embodiments, one or more is at least eight. In some embodiments, one or more is at least nine. In some embodiments, one or more is at least ten.

In some embodiments, a base sequence, e.g., a common base sequence of a plurality of oligonucleotide, a base sequence of a particular oligonucleotide type, etc., comprises or is a sequence complementary to a gene or transcript (e.g., of Dystrophin or DMD). In some embodiments, a common base sequence comprises or is a sequence 100% complementary to a gene. In some embodiments, a common base sequence comprises or is a sequence complementary to a characteristic sequence element of a gene, which characteristic sequences differentiate the gene from a similar sequence sharing homology with the gene. In some embodiments, a common base sequence comprises or is a sequence 100% complementary to a characteristic sequence element of a gene, which characteristic sequences differentiate the gene from another allele of the gene. In some embodiments, a common base sequence comprises or is a sequence 100% complementary to a characteristic sequence element of a gene, which characteristic sequences differentiate the gene from a similar sequence sharing homology with the gene. In some embodiments, a common base sequence comprises or is a sequence complementary to characteristic sequence element of a target gene, which characteristic sequences comprises a mutation that is not found in other copies of the gene, e.g., the wild-type copy of the gene, another mutant copy the gene, etc. In some embodiments, a common base sequence comprises or is a sequence 100% complementary to characteristic sequence element of a target gene, which characteristic sequences comprises a mutation that is not found in other copies of the gene, e.g., the wild-type copy of the gene, another mutant copy the gene, etc. In some embodiments, a common base sequence comprises or is a sequence 100% complementary to a characteristic sequence element of a gene, which characteristic sequences differentiate the gene from another allele of the gene. In some embodiments, a characteristic sequence element is a mutation. In some embodiments, a characteristic sequence element is a SNP.

In some embodiments, a chiral internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, etc., or a salt form thereof. In some embodiments, linkage phosphorus of chiral internucleotidic linkages are chirally controlled. In some embodiments, a chiral internucleotidic linkage is phosphorothioate internucleotidic linkage. In some embodiments, each chiral internucleotidic linkage in an oligonucleotide of a provided composition independently has the structure of formula I. In some embodiments, each chiral internucleotidic linkage in an oligonucleotide of a provided composition independently has the structure of formula II. In some embodiments, each chiral internucleotidic linkage in an oligonucleotide of a provided composition independently has the structure of formula III. In some embodiments, each chiral internucleotidic linkage in an oligonucleotide of a provided composition is a phosphorothioate internucleotidic linkage.

As appreciated by those skilled in the art, internucleotidic linkages, e.g., those of formula I, natural phosphate linkages, phosphorothioate internucleotidic linkages, etc. may exist in their salt forms depending on pH of their environment. Unless otherwise indicated, such salt forms are included in the present application when such internucleotidic linkages are referred to.

In some embodiments, oligonucleotides of the present disclosure comprise one or more modified sugar moieties. In some embodiments, oligonucleotides of the present disclosure comprise one or more modified base moieties. As known by a person of ordinary skill in the art and described in the disclosure, various modifications can be introduced to sugar and base moieties. For example, in some embodiments, a modification is a modification described in U.S. Pat. No. 9,006,198, WO2014/012081, WO/2015/107425, and WO/2017/062862, the sugar and base modifications of each of which are incorporated herein by reference.

In some embodiments, a sugar modification is a 2'-modification. Commonly used 2'-modifications include but are not limited to 2'-$OR^1$, wherein $R^1$ is not hydrogen. In some embodiments, a modification is 2'-OR, wherein R is optionally substituted aliphatic. In some embodiments, a modification is 2'-OMe. In some embodiments, a modification is 2'-O-MOE. In some embodiments, the present disclosure demonstrates that inclusion and/or location of particular chirally pure internucleotidic linkages can provide stability improvements comparable to or better than those achieved through use of modified backbone linkages, bases, and/or sugars. In some embodiments, a provided single oligonucleotide of a provided composition has no modifications on the sugars. In some embodiments, a provided single oligonucleotide of a provided composition has no modifications on 2'-positions of the sugars (i.e., the two groups at the 2'-position are either —H/—H or —H/—OH). In some embodiments, a provided single oligonucleotide of a provided composition does not have any 2'-MOE modifications.

In some embodiments, a 2'-modification is —O-L- or -L- which connects the 2'-carbon of a sugar moiety to another carbon of a sugar moiety. In some embodiments, a 2'-modification is —O-L- or -L- which connects the 2'-carbon of a sugar moiety to the 4'-carbon of a sugar moiety. In some embodiments, a 2'-modification is S-cEt. In some embodiments, a modified sugar moiety is an LNA sugar moiety.

In some embodiments, a 2'-modification is —F. In some embodiments, a 2'-modification is FANA. In some embodiments, a 2'-modification is FRNA.

In some embodiments, a sugar modification is a 5'-modification. In some embodiments, a modification is 5'-$R^1$, wherein $R^1$ is not hydrogen. In some embodiments, a sugar modification is 5'-R, wherein R is not hydrogen and is otherwise as described in the present disclosure. In some embodiments, a sugar modification is 5'-R, wherein R is optionally substituted $C_{1-6}$ aliphatic. In some embodiments, a sugar modification is 5'-R, wherein R is optionally substituted $C_{1-6}$ alkyl. In some embodiments, a sugar modification is 5'-R, wherein R is optionally substituted methyl. In some embodiments, a sugar modification is 5'-R, wherein R is optionally substituted methyl, wherein no substituents of the methyl group comprises a carbon atom. In some embodiments, a 5'-modification is methyl. In some embodiments, each substituent is independently halogen. In some embodiments, a substituted 5'-carbon is diastereomerically pure. In some embodiments, a substituted 5'-carbon has the R configuration. In some embodiments, a substituted 5'-carbon has the S configuration. In some embodiments, a 5'-modification is 5'-(R)-Me. In some embodiments, a 5'-modification is 5'-(S)-Me.

In some embodiments, a sugar moiety has one and no more than one modification at a position, e.g., a 2'-position, 5'-position, etc. In some embodiments, a 2'-modification takes the position corresponding to the position of the 2'-OH in a natural RNA sugar moiety. In some embodiments, a 2'-modification takes the position corresponding to the position of the 2'-H in a natural RNA sugar moiety.

In some embodiments, a sugar modification changes the size of the sugar ring. In some embodiments, a sugar modification changes the conformation of the sugar ring. In some embodiments, a sugar modification is the sugar moiety in FHNA.

In some embodiments, a sugar modification replaces a sugar moiety with another cyclic or acyclic moiety. Examples of such moieties are widely known in the art, including but not limited to those used in Morpholino, glycol nucleic acids, etc.

Certain Embodiments of Internucleotidic Linkages, Chirally Controlled Oligonucleotides and Chirally Controlled Oligonucleotide Compositions Among other things, the present disclosure provides chirally controlled oligonucleotides and chirally controlled oligonucleotide compositions. In some embodiments, the present disclosure provides chirally controlled oligonucleotides and chirally controlled oligonucleotide compositions which are of high crude purity. In some embodiments, the present disclosure provides chirally controlled oligonucleotides, and chirally controlled oligonucleotide compositions which are of high diastereomeric purity. Chirally controlled oligonucleotides are oligonucleotides comprise one or more chirally controlled internucleotidic linkages, such as oligonucleotides of a plurality in chirally controlled oligonucleotide compositions. In some embodiments, chirally controlled oligonucleotides comprise 1, 2, 3, 4, 5, 6, 7, 8, 9, 10, 11, 12, 13, 14, 15, 16, 17, 18, 19, 20, 21, 22, 23, 24, 25 or more chirally controlled internucleotidic linkages. In some embodiments, 5%, 10%, 20%, 30%, 40%, 50%, 60%, 70%, 80%, 90%, 95% or more chiral internucleotidic linkages of a chirally controlled oligonucleotide are independently chirally controlled internucleotidic linkages. In some embodiments, each chiral internucleotidic linkage in a chirally controlled oligonucleotide is a chirally controlled internucleotidic linkage, and a chirally controlled oligonucleotide is diastereomerically pure.

In some embodiments, a chirally controlled oligonucleotide composition is a substantially pure composition of an oligonucleotide type in that oligonucleotides in the composition that are not of the oligonucleotide type are impurities. In some embodiments, such impurities are formed during the preparation process of oligonucleotides of said oligonucleotide type, in some case, after certain purification procedures.

In some embodiments, the present disclosure provides oligonucleotides comprising one or more diastereomerically pure internucleotidic linkages with respect to the chiral linkage phosphorus (e.g., linkage phosphorus of chirally controlled internucleotidic linkages). In some embodiments, the present disclosure provides oligonucleotides comprising one or more diastereomerically pure internucleotidic linkages having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, etc., or a salt form thereof. In some embodiments, the present disclosure provides oligonucleotides comprising one or more diastereomerically pure internucleotidic linkages with respect to the chiral linkage phosphorus, and one or more natural phosphate linkages (unless otherwise indicated, reference in the present application to internucleotidic linkages, such as natural phosphate linkages and other types of internucleotidic linkages when applicable, includes salt forms of such linkages). Thus, diastereomerically pure internucleotidic linkages here include salt forms of diastereomerically pure internucleotidic linkages; natural phosphate linkages here include salt forms of natural phosphate linkages. A person having ordinary skill in the art appreciates that many internucleotidic linkages, such as natural phosphate linkages, exist as salt forms when at physiological pH, in many buffers (e.g., PBS buffers having a pH around 7, e.g., PH 7.4), etc.). In some embodiments, the present disclosure provides oligonucleotides comprising one or more diastereomerically pure internucleotidic linkages having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, etc., or a salt form thereof, and one or more natural phosphate linkages. In some embodiments, the present disclosure provides oligonucleotides comprising one or more diastereomerically pure internucleotidic linkages having the structure of formula I-c, and one or more phosphate diester linkages. In some embodiments, such oligonucleotides are prepared by using stereoselective oligonucleotide synthesis, as described in this application, to form designed diastereomerically pure internucleotidic linkages with respect to the chiral linkage phosphorus.

In some embodiments, an oligonucleotide of the present disclosure comprises at least one internucleotidic linkage, e.g., a modified (non-natural) internucleotidic linkage (e.g., non-negatively charged internucleotidic linkage) within or at the terminus (e.g. 5' or 3') of the oligonucleotide. In some embodiments, an oligonucleotide comprises a P-modification moiety within or at the terminus (e.g. 5' or 3') of the oligonucleotide.

In some embodiments, an oligonucleotide of the present disclosure comprises at least one chirally controlled internucleotidic linkage within the oligonucleotide. In some embodiments, an oligonucleotide of the present disclosure comprises at least one chirally controlled internucleotidic linkage within the oligonucleotide, and at least one natural phosphate linkage. In some embodiments, an oligonucleotide of the present disclosure comprises at least one chirally controlled internucleotidic linkage within the oligonucleotide, at least one natural phosphate linkage, and at least one phosphorothioate internucleotidic linkage. In some embodiments, an oligonucleotide of the present disclosure comprises at least one chirally controlled internucleotidic linkage within the oligonucleotide, and at least one phosphorothioate triester internucleotidic linkage. In some embodiments, an oligonucleotide of the present disclosure comprises at least one chirally controlled internucleotidic linkage within the oligonucleotide, at least one natural phosphate linkage, and at least one phosphorothioate triester internucleotidic linkage.

In some embodiments, an oligonucleotide of the present disclosure comprises at least two chirally controlled internucleotidic linkages within the oligonucleotide that have different stereochemistry and/or different P-modifications relative to one another. In some embodiments, such at least two internucleotidic linkages have different stereochemistry. In some embodiments, such at least two internucleotidic linkages have different P-modifications. In some embodiments, an oligonucleotide of the present disclosure comprises at least two chirally controlled internucleotidic linkages within the oligonucleotide that have different P-modifications relative to one another, and at least one natural phosphate linkage. In some embodiments, an oligonucleotide of the present disclosure comprises at least two chirally controlled internucleotidic linkages within the oligonucleotide that have different P-modifications relative to one another, at least one natural phosphate linkage, and at least one phosphorothioate internucleotidic linkage. In some embodiments, an oligonucleotide of the present disclosure comprises at least two chirally controlled internucleotidic linkages within the oligonucleotide that have different P-modifications relative to one another, and at least one phosphorothioate triester internucleotidic linkage. In some embodiments, an oligonucleotide of the present disclosure comprises at least two chirally controlled internucleotidic linkages within the oligonucleotide that have different P-modifications relative to one another, at least one natural phosphate linkage, and at least one phosphorothioate triester internucleotidic linkage.

In certain embodiments, an internucleotidic linkage (e.g., a modified (non-natural) internucleotidic linkage when formula I is not a natural phosphate linkage) has the structure of formula I:

I

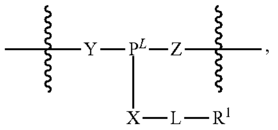

or a salt form thereof, wherein:

$P^L$ is P(=W), P, or P→$B(R')_3$;

W is O, N(-L-$R^5$), S or Se;

each of $R^1$ and $R^5$ is independently —H, -L-R', halogen, —CN, —$NO_2$, -L-Si$(R')_3$, OR', —SR', or —$N(R')_2$;

each of X, Y and Z is independently —O—, —S—, —N(-L-$R^5$)—, or L;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —$C(R')_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —$S(O)_2$—, —$S(O)_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B$(R')_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B$(R')_3$]O—, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each R' is independently —R, —C(O)R, —C(O)OR, or —$S(O)_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

In some embodiments, a linkage of formula I is chiral at the linkage phosphorus (P in $P^L$). In some embodiments, the present disclosure provides a chirally controlled oligonucleotide comprising one or more modified internucleotidic linkages of formula I. In some embodiments, the present disclosure provides a chirally controlled oligonucleotide comprising one or more modified internucleotidic linkages of formula I, and wherein individual internucleotidic linkages of formula I within the oligonucleotide have different P-modifications relative to one another. In some embodiments, the present disclosure provides a chirally controlled oligonucleotide comprising one or more modified internucleotidic linkages of formula I, and wherein individual internucleotidic linkages of formula I within the oligonucleotide have different —X-L-$R^1$ relative to one another. In some embodiments, the present disclosure provides a chirally controlled oligonucleotide comprising one or more modified internucleotidic linkages of formula I, and wherein individual internucleotidic linkages of formula I within the oligonucleotide have different X relative to one another. In some embodiments, the present disclosure provides a chirally controlled oligonucleotide comprising one or more modified internucleotidic linkages of formula I, and wherein individual internucleotidic linkages of formula I within the oligonucleotide have different -L-$R^1$ relative to one another. In some embodiments, a chirally controlled oligonucleotide is an oligonucleotide in a provided composition that is of the particular oligonucleotide type. In some embodiments, a chirally controlled oligonucleotide is an oligonucleotide in a provided composition that has the common base sequence and length, the common pattern of backbone linkages, and the common pattern of backbone chiral centers.

As extensively described herein, in some embodiments, —X-L-$R^1$ is a moiety useful for oligonucleotide preparation. For example, in some embodiments, —X-L-$R^1$ is —$OCH_2CH_2CN$ (e.g., in non-chirally controlled internucleotidic linkages); in some embodiments, —X-L-$R^1$ is of such a structure that H—X-L-$R^1$ is a chiral auxiliary, optionally capped, as described herein (e.g., DPSE, PSM, etc.; particularly in chirally controlled internucleotidic linkages, although may also in non-chirally controlled internucleotidic linkages (e.g., precursors of natural phosphate linkages)).

In some embodiments, a chirally controlled oligonucleotide is an oligonucleotide in a chirally controlled composition that is of a particular oligonucleotide type, and the chirally controlled oligonucleotide is of the type. In some embodiments, a chirally controlled oligonucleotide is an oligonucleotide in a provided composition that comprises a controlled level of a plurality of oligonucleotides that share a common base sequence, a common pattern of backbone linkages, a common pattern of backbone chiral centers, and a common pattern of backbone phosphorus modifications, and the chirally controlled oligonucleotide shares the common base sequence, the common pattern of backbone linkages, the common pattern of backbone chiral centers, and the common pattern of backbone phosphorus modifications.

In some embodiments, the present disclosure provides a chirally controlled oligonucleotide, wherein at least two chirally controlled internucleotidic linkages within the oligonucleotide have different P-modifications relative to one another, in that they have different X atoms in their —$XLR^1$ moieties, and/or in that they have different L groups in their —$XLR^1$ moieties, and/or that they have different $R^1$ atoms in their —$XLR^1$ moieties, and/or in that they have different —$XLR^1$ moieties.

In some embodiments, the present disclosure provides a chirally controlled oligonucleotide, wherein at least two of the individual internucleotidic linkages within the oligonucleotide have different stereochemistry and/or different P-modifications relative to one another and the oligonucleotide has a structure represented by the following formula:

$$[S^B n1 R^B n2 S^B n3 R^B n4 \ldots S^B nx R^B ny]$$

wherein:

each $R^B$ independently represents a block of nucleotide units having the R configuration at the linkage phosphorus;

each $S^B$ independently represents a block of nucleotide units having the S configuration at the linkage phosphorus;

each of n1-ny is zero or an integer, with the requirement that at least one odd n and at least one even n must be non-zero so that the oligonucleotide includes at least two individual internucleotidic linkages with different stereochemistry relative to one another; and wherein the sum of n1-ny is between 2 and 200, and in some embodiments is between a lower limit selected from the group consisting of 2, 3, 4, 5, 6, 7, 8, 9, 10, 11, 12, 13, 14, 15, 16, 17, 18, 19, 20, 21, 22, 23, 24, 25 or more and an upper limit selected from the group consisting of 5, 10, 15, 20, 25, 30, 35, 40, 45, 50, 55, 60, 65, 70, 75, 80, 85, 90, 95, 100, 110, 120, 130, 140, 150, 160, 170, 180, 190, and 200, the upper limit being larger than the lower limit.

In some such embodiments, each n has the same value; in some embodiments, each even n has the same value as each other even n; in some embodiments, each odd n has the same value each other odd n; in some embodiments, at least two even ns have different values from one another; in some embodiments, at least two odd ns have different values from one another.

In some embodiments, at least two adjacent ns are equal to one another, so that a provided oligonucleotide includes adjacent blocks of S stereochemistry linkages and R stereochemistry linkages of equal lengths. In some embodiments, provided oligonucleotides include repeating blocks of S and R stereochemistry linkages of equal lengths. In some embodiments, provided oligonucleotides include repeating blocks of S and R stereochemistry linkages, where at least two such blocks are of different lengths from one another; in some such embodiments each S stereochemistry block is of the same length, and is of a different length from each R stereochemistry length, which may optionally be of the same length as one another.

In some embodiments, at least two skip-adjacent ns are equal to one another, so that a provided oligonucleotide includes at least two blocks of linkages of a first stereochemistry that are equal in length to one another and are separated by a block of linkages of the other stereochemistry, which separating block may be of the same length or a different length from the blocks of first stereochemistry.

In some embodiments, ns associated with linkage blocks at the ends of a provided oligonucleotide are of the same length. In some embodiments, provided oligonucleotides have terminal blocks of the same linkage stereochemistry. In some such embodiments, the terminal blocks are separated from one another by a middle block of the other linkage stereochemistry.

In some embodiments, a provided oligonucleotide of formula $[S^B n1 R^B n2 S^B n3 R^B n4 \ldots S^B nx R^B ny]$ is a stereoblockmer. In some embodiments, a provided oligonucleotide of formula $[S^B n1 R^B n2 S^B n3 R^B n4 \ldots S^B nx R^B ny]$ is a stereoskipmer. In some embodiments, a provided oligonucleotide of formula $[S^B n1 R^B n2 S^B n3 R^B n4 \ldots S^B nx R^B ny]$ is a stereoaltmer. In some embodiments, a provided oligonucleotide of formula $[S^B n1 R^B n2 S^B n3 R^B n4 \ldots S^B nx R^B ny]$ is a gapmer.

In some embodiments, a provided oligonucleotide of formula $[S^B n1 R^B n2 S^B n3 R^B n4 \ldots S^B nx R^B ny]$ is of any of the above described patterns and further comprises patterns of P-modifications. For instance, in some embodiments, a provided oligonucleotide of formula $[S^B n1 R^B n2 S^B n3 R^B n4 \ldots S^B nx R^B ny]$ and is a stereoskipmer and P-modification skipmer. In some embodiments, a provided oligonucleotide of formula $[S^B n1 R^B n2 S^B n3 R^B n4 \ldots S^B nx R^B ny]$ and is a stereoblockmer and P-modification altmer. In some embodiments, a provided oligonucleotide of formula $[S^B n1 R^B n2 S^B n3 R^B n4 \ldots S^B nx R^B ny]$ and is a stereoaltmer and P-modification blockmer.

In some embodiments, an internucleotidic linkage of formula I has the structure of:

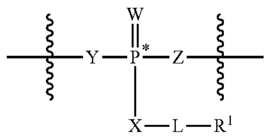

wherein:

P* is an asymmetric phosphorus atom and is either Rp or Sp;

W is O, S or Se;

each of X, Y and Z is independently —O—, —S—, —N(-L-$R^1$)—, or L;

L is a covalent bond or an optionally substituted, linear or branched $C_1$-$C_{10}$ alkylene, wherein one or more methylene units of L are optionally and independently replaced by $C_1$-$C_6$ alkylene, $C_1$-$C_6$ alkenylene, —C≡C—, a $C_1$-$C_6$ heteroaliphatic moiety, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$ N(R')—, —N(R')S(O)$_2$— —SC(O)—, —C(O)S—, —OC(O)—, and —C(O)O—;

$R^1$ is halogen, R, or an optionally substituted $C_1$-$C_{50}$ aliphatic wherein one or more methylene units are optionally and independently replaced by $C_1$-$C_6$ alkylene, $C_1$-$C_6$ alkenylene, —C≡C—, a $C_1$-$C_6$ heteroaliphatic moiety, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —$S(O)_2$—, —$S(O)_2N(R')$—, —N(R')S$(O)_2$— —SC(O)—, —C(O)S—, —OC(O)—, and —C(O)O—;

each R' is independently —R, —C(O)R, —$CO_2R$, or —$SO_2R$, or:

two R' are taken together with their intervening atoms to form an optionally substituted aryl, carbocyclic, heterocyclic, or heteroaryl ring;

—Cy— is an optionally substituted bivalent ring selected from phenylene, carbocyclylene, arylene, heteroarylene, and heterocyclylene;

each R is independently hydrogen, or an optionally substituted group selected from $C_1$-$C_6$ aliphatic, carbocyclyl, aryl, heteroaryl, and heterocyclyl; and each

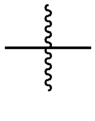

independently represents a connection to a nucleoside.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —$C(R')_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —$S(O)_2$—, —$S(O)_2N(R')$—, —N(R')S$(O)_2$—, —SC(O)—, —C(O)S—, —OC(O)—, or —C(O)O—;

$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —$C(R')_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —$S(O)_2$—, —$S(O)_2N(R')$—, —N(R')$S(O)_2$—, —SC(O)—, —C(O)S—, —OC(O)—, or —C(O)O—;

each R' is independently —R, —C(O)R, —$CO_2R$, or —$SO_2R$, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring;

—Cy— is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl; and each

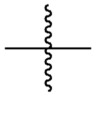

independently represents a connection to a nucleoside.

In some embodiments, a chirally controlled oligonucleotide comprises one or more modified internucleotidic linkages. In some embodiments, a chirally controlled oligonucleotide comprises, e.g., a phosphorothioate or a phosphorothioate triester internucleotidic linkage. In some embodiments, a chirally controlled oligonucleotide comprises a chirally controlled phosphorothioate triester linkage. In some embodiments, a chirally controlled oligonucleotide comprises at least 2, 3, 4, 5, 6, 7, 8, 9, 10, 11, 12, 13, 14, 15, 16, 17, 18, 19, 20, 21, 22, 23, 24, or 25 chirally controlled phosphorothioate triester internucleotidic linkages. In some embodiments, a chirally controlled oligonucleotide comprises at least 2, 3, 4, 5, 6, 7, 8, 9, 10, 11, 12, 13, 14, 15, 16, 17, 18, 19, 20, 21, 22, 23, 24, or 25 chirally controlled phosphorothioate internucleotidic linkages (—O—P(O)(SH)—O— or salt forms thereof).

In some embodiments, an oligonucleotide comprises different types of internucleotidic phosphorus linkages. In some embodiments, a chirally controlled oligonucleotide comprises at least one natural phosphate linkage and at least one modified (non-natural) internucleotidic linkage. In some embodiments, an oligonucleotide comprises at least one natural phosphate linkage and at least one phosphorothioate. In some embodiments, an oligonucleotide comprises at least one non-negatively charged internucleotidic linkage. In some embodiments, an oligonucleotide comprises at least one natural phosphate linkage and at least one non-negatively charged internucleotidic linkage. In some embodiments, an oligonucleotide comprises at least one phosphorothioate internucleotidic linkage and at least one non-negatively charged internucleotidic linkage. In some embodiments, an oligonucleotide comprises at least one phosphorothioate internucleotidic linkage, at least one natural phosphate linkage, and at least one non-negatively charged internucleotidic linkage.

In some embodiments, an internucleotidic linkage comprises a chiral auxiliary. In some embodiments, an internucleotidic linkage of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, etc., comprises a chiral auxiliary, wherein $P^L$ is P═S. In some embodiments, an internucleotidic linkage of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, etc., comprises a chiral auxiliary, wherein $P^L$ is P═O. In some embodiments, a phosphorothioate triester linkage comprises a chiral auxiliary, which, for example, is used to control the stereoselectivity of a reaction. In some embodiments, a phosphorothioate triester linkage does not comprise a chiral auxiliary. Example chiral auxiliaries that can be utilized in accordance with the present disclosure include those described in U.S. Pat. Nos. 9,394,333, 9,744,183, 9,605,019, US20130178612, US20150211006, U.S. Pat. No. 9,598,458, US20170037399, WO 2017/015555, WO 2017/062862, WO 2018/237194, WO 2019/055951, the chiral auxiliaries of each of which is incorporated herein by reference. In some embodiments, one or more —X-L-$R^1$ independently comprise or are an optionally substituted chiral auxiliary. In some embodiments, one or more —X-L-$R^1$ are each independently of such a structure that H—X-L-$R^1$ is a chiral reagent/chiral auxiliary described herein (e.g., one having the structure of formula 3-I, formula 3-AA, etc.). In some embodiments, H—X-L-$R^1$ is a capped chiral reagent/chiral auxiliary described herein (e.g., one having the structure of formula 3-I, formula 3-AA, etc.), which is capped in that an amino group of the chiral reagent/chiral auxiliary (e.g., H—$W^1$ and H—$W^2$ is or comprises H—$NG^5$-) is capped (e.g., forming $R^1$—$NG^5$-(e.g., R'C(O)—$NG^5$-, $RS(O)_2$—$NG^5$-, etc.)). In some embodiments, R' is optionally substituted $C_{1-6}$ alkyl. In some embodiments, R' is methyl. In some embodiments, one or more —X-L-$R^1$ are each independently of such a structure that H—X-L-$R^1$ is

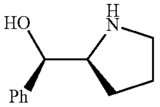,
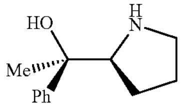,
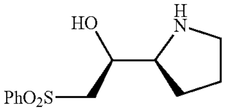,
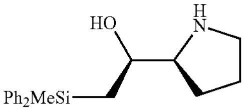,
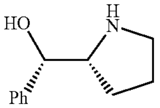,
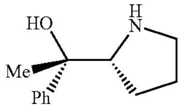,
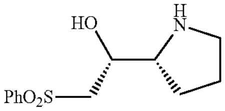, or
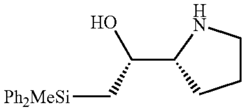.

In some embodiments, one or more —X-L-$R^1$ are each independently of such a structure that H—X-L-$R^1$ is

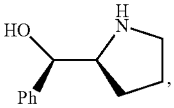,
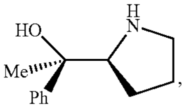,
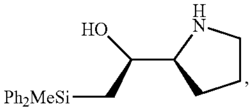,
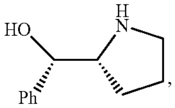,
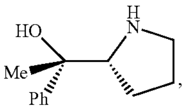, or
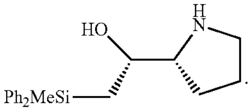.

In some embodiments, one or more —X-L-$R^1$ are each independently of such a structure that H—X-L-$R^1$ is

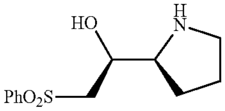,
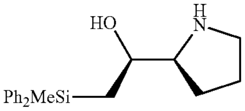,
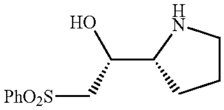, or

-continued

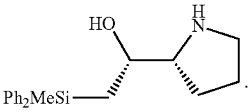.

In some embodiments, one or more —X-L-$R^1$ are each independently of such a structure that H—X-L-$R^1$ is a compound selected from Tables CA-1, CA-2, CA-3, CA-4, CA-5, CA-6, CA-7, CA-8, CA-9, CA-10, CA-11, CA-12, or CA-13, or a related (having the same constitution) diastereomer or enantiomer thereof. In some embodiments, one or more —X-L-$R^1$ are each independently of such a structure that H—X-L-$R^1$ is

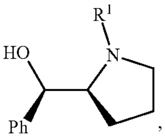,
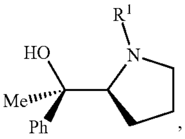,
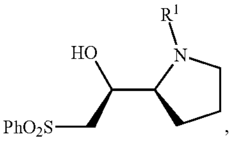,
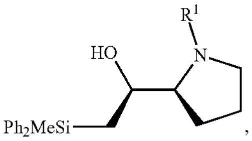,
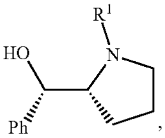,
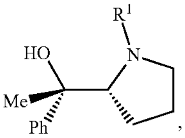,
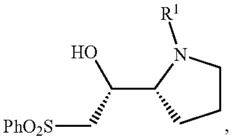, or
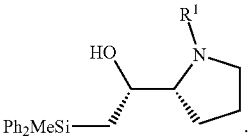.

In some embodiments, one or more —X-L-$R^1$ are each independently of such a structure that H—X-L-$R^1$ is

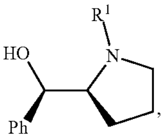,
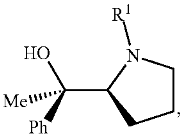,
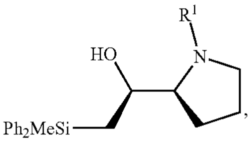,
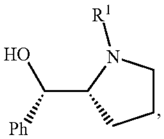,
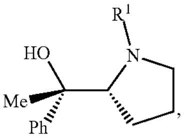, or
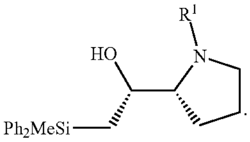.

In some embodiments, one or more —X-L-$R^1$ are each independently of such a structure that H—X-L-$R^1$ is

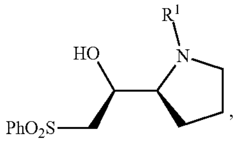
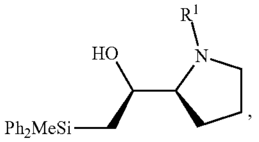
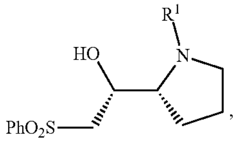
or
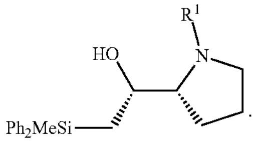

In some embodiments, one or more —X-L-$R^1$ are each independently of such a structure that H—X-L-$R^1$ is a compound selected from Tables CA-1, CA-2, CA-3, CA-4, CA-5, CA-6, CA-7, CA-8, CA-9, CA-10, CA-11, CA-12, or CA-13, or a related (having the same constitution) diastereomer or enantiomer thereof, wherein the —NH— of the 5-membered pyrrolidinyl is replaced with —N($R^1$)—. In some embodiments, one or more —X-L-$R^1$ are independently

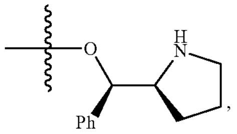
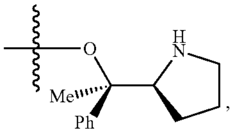
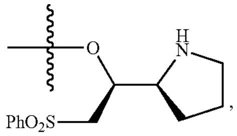
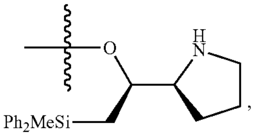
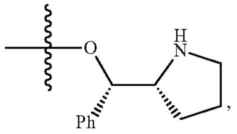
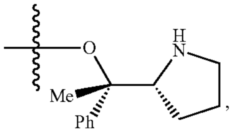
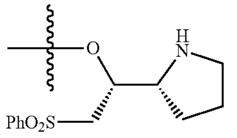
or
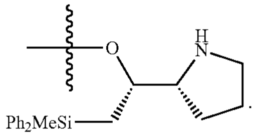

In some embodiments, one or more —X-L-$R^1$ are independently

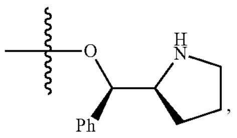
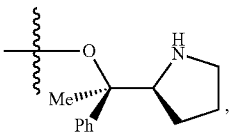

-continued

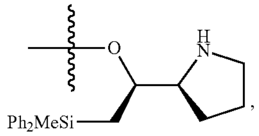
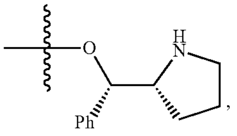
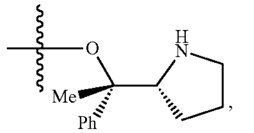
or
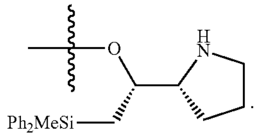

In some embodiments, one or more —X-L-$R^1$ are independently

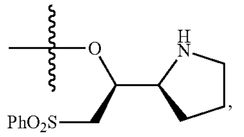
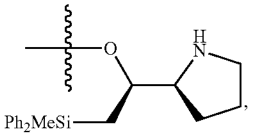
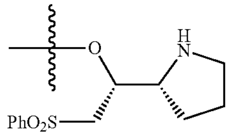
or
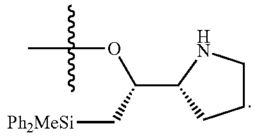

In some embodiments, one or more —X-L-$R^1$ are each independently of such a structure that H—X-L-$R^1$ is a compound selected from Tables CA-1, CA-2, CA-3, CA-4, CA-5, CA-6, CA-7, CA-8, CA-9, CA-10, CA-11, CA-12, or CA-13, or a related (having the same constitution) diastereomer or enantiomer thereof, wherein the connection to the linkage phosphorus is through the alcohol hydroxyl group. In some embodiments, one or more —X-L-$R^1$ are independently

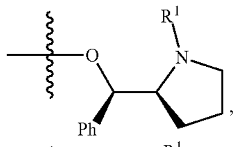
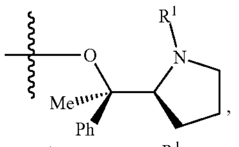
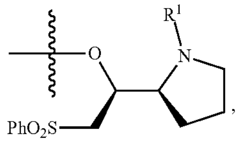
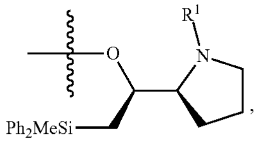
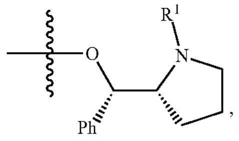
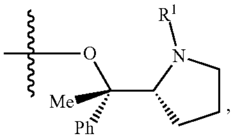

-continued

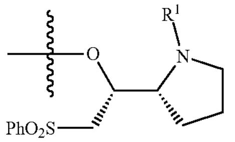

or

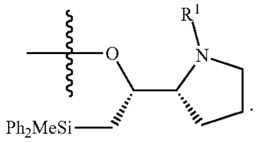

In some embodiments, one or more —X-L-$R^1$ are independently

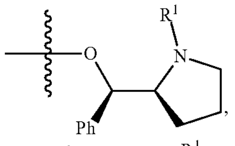
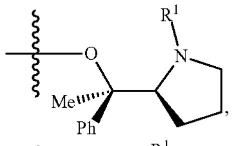
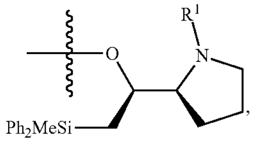
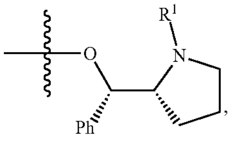
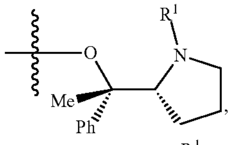

or

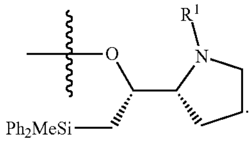

In some embodiments, one or more —X-L-$R^1$ are independently

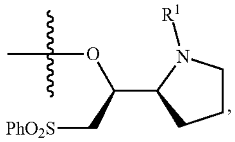
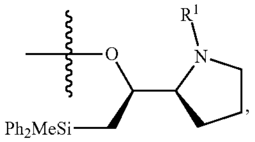
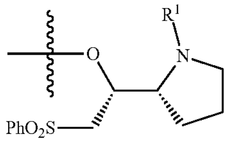

or

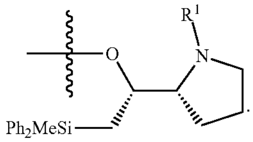

In some embodiments, one or more —X-L-$R^1$ are each independently of such a structure that H—X-L-$R^1$ is a compound selected from Tables CA-1, CA-2, CA-3, CA-4, CA-5, CA-6, CA-7, CA-8, CA-9, CA-10, CA-11, CA-12, or CA-13, or a related (having the same constitution) diastereomer or enantiomer thereof, wherein the —NH— of the 5-membered pyrrolidinyl is replaced with —N($R^1$)—, and wherein the connection to the linkage phosphorus is through the alcohol hydroxyl group. In some embodiments, one or more —X-L-$R^1$ are independently

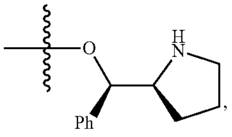
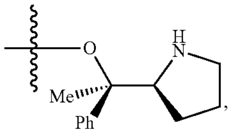
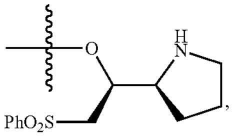
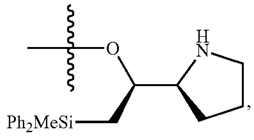
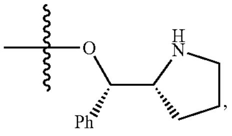
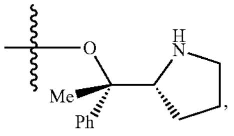
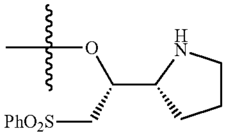

or

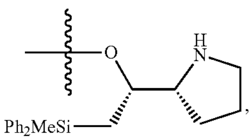

and one or more —X-L-$R^1$ are independently

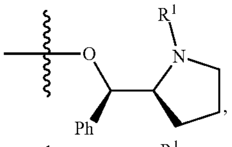
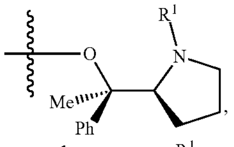
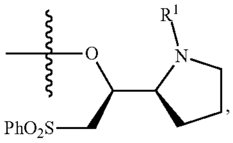
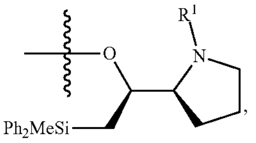
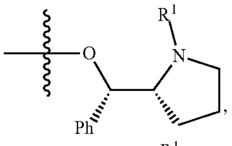
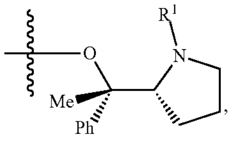
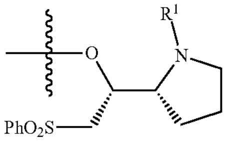

or

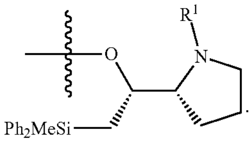

In some embodiments, one or more —X-L-$R^1$ are independently

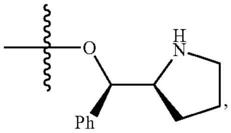,
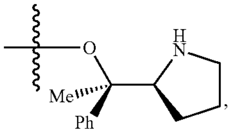,
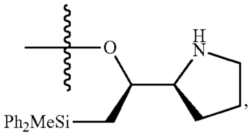,
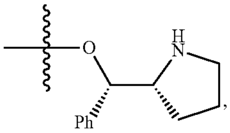,
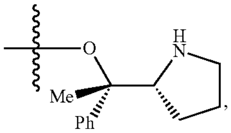, or
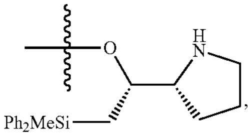, and one or more —X-L-$R^1$ are independently

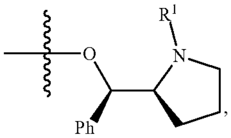,
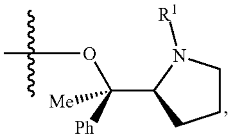,
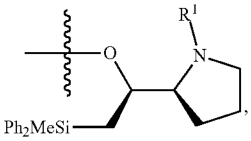,
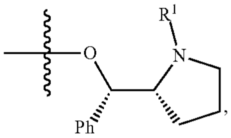,
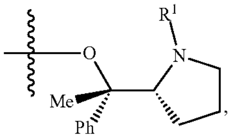, or
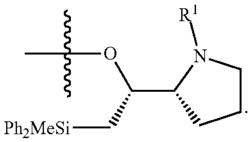.

In some embodiments, one or more —X-L-$R^1$ are independently

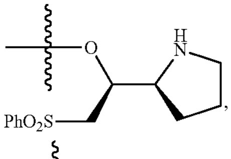,
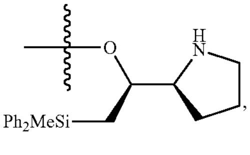,
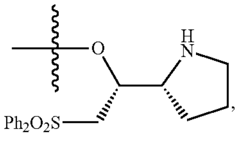, or

-continued

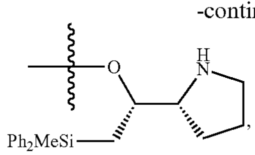, and one or more —X-L-$R^1$ are independently

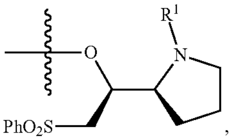,
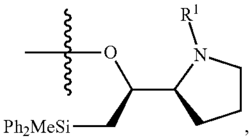,
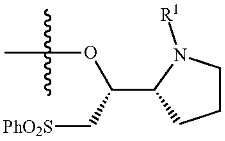 or
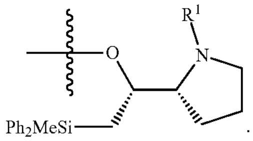.

In some embodiments, $R^1$ is a capping group utilized in oligonucleotide synthesis. In some embodiments, $R^1$ is —C(O)—R'. In some embodiments, $R^1$ is —C(O)—R', wherein R' is optionally substituted $C_{1-6}$ aliphatic. In some embodiments, $R^1$ is —$C(O)CH_3$.

In some embodiments, an oligonucleotide, e.g., a chirally controlled oligonucleotide, an oligonucleotide of a plurality, etc. is linked to a solid support. In some embodiments, an oligonucleotide is not linked to a solid support.

In some embodiments, an oligonucleotide comprises at least one natural phosphate linkage and at least two consecutive chirally controlled modified internucleotidic linkages. In some embodiments, a chirally controlled oligonucleotide comprises at least one natural phosphate linkage and at least two consecutive chirally controlled phosphorothioate internucleotidic linkages.

In some embodiments, a chirally controlled oligonucleotide is a blockmer. In some embodiments, a chirally controlled oligonucleotide is a stereoblockmer. In some embodiments, a chirally controlled oligonucleotide is a P-modification blockmer. In some embodiments, a chirally controlled oligonucleotide is a linkage blockmer.

In some embodiments, a chirally controlled oligonucleotide is an altmer. In some embodiments, a chirally controlled oligonucleotide is a stereoaltmer. In some embodiments, a chirally controlled oligonucleotide is a P-modification altmer. In some embodiments, a chirally controlled oligonucleotide is a linkage altmer.

In some embodiments, a chirally controlled oligonucleotide is a unimer.

In some embodiments, in a unimer, all nucleotide units within a strand share at least one common structural feature at the internucleotidic phosphorus linkage. In some embodiments, a common structural feature is a common stereochemistry at the linkage phosphorus or a common modification at the linkage phosphorus. In some embodiments, a chirally controlled oligonucleotide is a stereounimer. In some embodiments, a chirally controlled oligonucleotide is a P-modification unimer. In some embodiments, a chirally controlled oligonucleotide is a linkage unimer.

In some embodiments, a chirally controlled oligonucleotide is a gapmer.

In some embodiments, a chirally controlled oligonucleotide is a skipmer.

In some embodiments, the present disclosure provides oligonucleotides comprising one or more modified internucleotidic linkages independently having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —$CO_2$R, or —$SO_2$R, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring;

—Cy— is an optionally substituted bivalent ring selected from phenylene, carbocyclylene, arylene, heteroarylene, or heterocyclylene;

each R is independently hydrogen, or an optionally substituted group selected from $C_1$-$C_6$ aliphatic, phenyl, carbocyclyl, aryl, heteroaryl, or heterocyclyl; and each

independently represents a connection to a nucleoside.

In some embodiments, a chirally controlled oligonucleotide comprises one or more modified internucleotidic phosphorus linkages. In some embodiments, a chirally controlled oligonucleotide comprises, e.g., a phosphorothioate or a phosphorothioate triester linkage. In some embodiments, a chirally controlled oligonucleotide comprises a phosphorothioate triester linkage. In some embodiments, a chirally controlled oligonucleotide comprises at least two phosphorothioate triester linkages. In some embodiments, a chirally controlled oligonucleotide comprises at least three phosphorothioate triester linkages. Example modified internucleotidic phosphorus linkages are described further herein. In some embodiments, a chirally controlled oligonucleotide comprises different internucleotidic phosphorus linkages. In some embodiments, a chirally controlled oligonucleotide comprises at least one phosphate diester internucleotidic linkage and at least one modified internucleotidic linkage. In some embodiments, a chirally controlled oligonucleotide comprises at least one phosphate diester internucleotidic linkage and at least one phosphorothioate triester linkage. In some embodiments, a chirally controlled oligonucleotide comprises at least one phosphate diester internucleotidic linkage and at least two phosphorothioate triester linkages. In some embodiments, a chirally controlled oligonucleotide comprises at least one phosphate diester internucleotidic linkage and at least three phosphorothioate triester linkages.

In some embodiments, P* is an asymmetric phosphorus atom and is either Rp or Sp. In some embodiments, P* is Rp. In other embodiments, P* is Sp. In some embodiments, an oligonucleotide comprises one or more internucleotidic linkages of formula I wherein each P* is independently Rp or Sp. In some embodiments, an oligonucleotide comprises one or more internucleotidic linkages of formula I wherein each P* is Rp. In some embodiments, an oligonucleotide comprises one or more internucleotidic linkages of formula I wherein each P* is Sp. In some embodiments, an oligonucleotide comprises at least one internucleotidic linkage of formula I wherein P* is Rp. In some embodiments, an oligonucleotide comprises at least one internucleotidic linkage of formula I wherein P* is Sp. In some embodiments, an oligonucleotide comprises at least one internucleotidic linkage of formula I wherein P* is Rp, and at least one internucleotidic linkage of formula I wherein P* is Sp.

In some embodiments, W is O, S, or Se. In some embodiments, W is O. In some embodiments, W is S. In some embodiments, W is Se. In some embodiments, an oligonucleotide comprises at least one internucleotidic linkage of formula I wherein W is O. In some embodiments, an oligonucleotide comprises at least one internucleotidic linkage of formula I wherein W is S. In some embodiments, an oligonucleotide comprises at least one internucleotidic linkage of formula I wherein W is Se.

In some embodiments, an oligonucleotide comprises at least one internucleotidic linkage of formula I wherein W is O. In some embodiments, an oligonucleotide comprises at least one internucleotidic linkage of formula I wherein W is S.

In some embodiments, X is —O—. In some embodiments, X is —S—. In some embodiments, X is —O— or —S—. In some embodiments, an oligonucleotide comprises at least one internucleotidic linkage of formula I wherein X is —O—. In some embodiments, an oligonucleotide comprises at least one internucleotidic linkage of formula I wherein X is —S—. In some embodiments, an oligonucleotide comprises at least one internucleotidic linkage of formula I wherein X is —O—, and at least one internucleotidic linkage of formula I wherein X is —S—. In some embodiments, an oligonucleotide comprises at least one internucleotidic linkage of formula I wherein X is —O—, and at least one internucleotidic linkage of formula I wherein X is —S—, and at least one internucleotidic linkage of formula I wherein L is an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, X is —N(-L-$R^1$)—. In some embodiments, X is —N($R^1$)—. In some embodiments, X is —N(R')—. In some embodiments, X is —N(R)—. In some embodiments, X is —NH—.

In some embodiments, X is L. In some embodiments, X is a covalent bond. In some embodiments, X is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, X is an optionally substituted $C_1$-$C_{10}$ alkylene or $C_1$-$C_{10}$ alkenylene. In some embodiments, X is methylene.

In some embodiments, Y is —O—. In some embodiments, Y is —S—.

In some embodiments, Y is —N(-L-$R^1$)—. In some embodiments, Y is —N($R^1$)—. In some embodiments, Y is —N(R')—. In some embodiments, Y is —N(R)—. In some embodiments, Y is —NH—.

In some embodiments, Y is L. In some embodiments, Y is a covalent bond. In some embodiments, Y is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Y is an optionally substituted $C_1$-$C_{10}$ alkylene or $C_1$-$C_{10}$ alkenylene. In some embodiments, Y is methylene.

In some embodiments, Z is —O—. In some embodiments, Z is —S—.

In some embodiments, Z is —N(-L-$R^1$)—. In some embodiments, Z is —N($R^1$)—. In some embodiments, Z is —N(R')—. In some embodiments, Z is —N(R)—. In some embodiments, Z is —NH—.

In some embodiments, Z is L. In some embodiments, Z is a covalent bond. In some embodiments, Z is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Z is an optionally substituted $C_1$-$C_{10}$ alkylene or $C_1$-$C_{10}$ alkenylene. In some embodiments, Z is methylene.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L is a covalent bond. In some embodiments, L is an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L has the structure of -$L^1$-V—, wherein:

L' is an optionally substituted group selected from

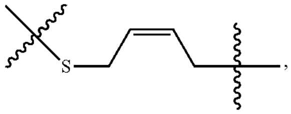
,
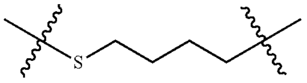
,
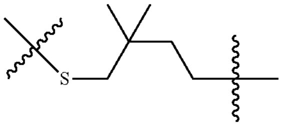
,
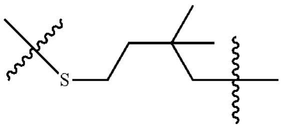
,
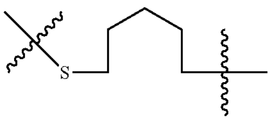
,
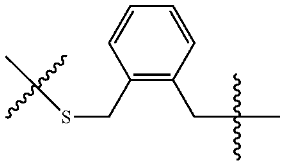
,
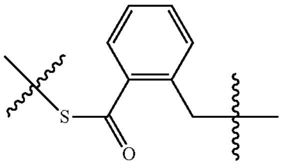
,
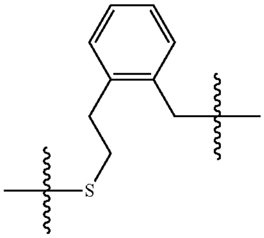
, -continued

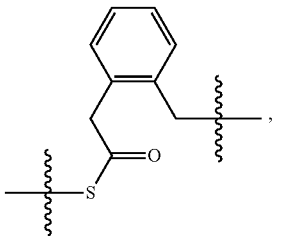

$C_1$-$C_6$ alkylene, $C_1$-$C_6$ alkenylene, carbocyclylene, arylene, $C_1$-$C_6$ heteroalkylene, heterocyclylene, and heteroarylene;

V is selected from —O—, —S—, —NR'—, $C(R')_2$, —S—S—, —B—S—S—C—,

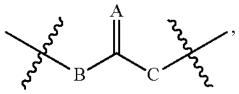

or an optionally substituted group selected from $C_1$-$C_6$ alkylene, arylene, $C_1$-$C_6$ heteroalkylene, heterocyclylene, and heteroarylene;

A is =O, =S, =NR', or =$C(R')_2$;

each of B and C is independently —O—, —S—, —NR'—, —$C(R')_2$—, or an optionally substituted group selected from $C_1$-$C_6$ alkylene, carbocyclylene, arylene, heterocyclylene, or heteroarylene; and each R' is independently as defined above and described herein.

In some embodiments, $L^1$ is

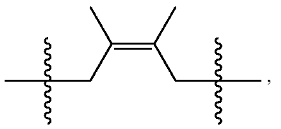

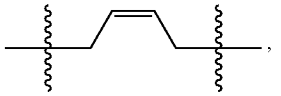

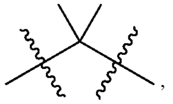

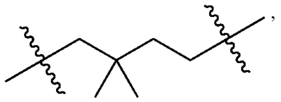

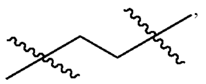

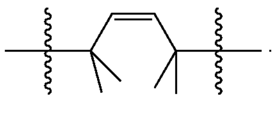

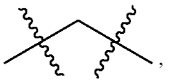

In some embodiments, $L^1$ is

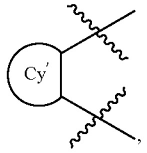 [SMILES: *CC*]

wherein Ring Cy' is an optionally substituted arylene, carbocyclylene, heteroarylene, or heterocyclylene. In some embodiments, $L^1$ is optionally substituted

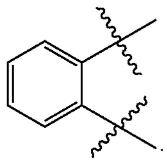 [SMILES: *c1ccccc1*]

In some embodiments, $L^1$ is

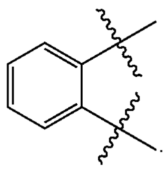 [SMILES: *c1ccccc1*]

In some embodiments, $L^1$ is connected to X. In some embodiments, $L^1$ is an optionally substituted group selected from

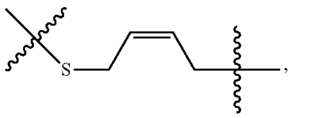

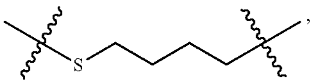

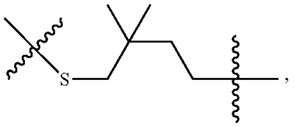

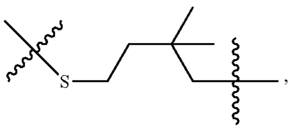

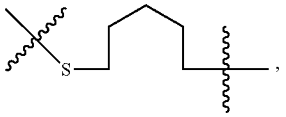

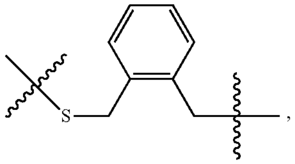

-continued

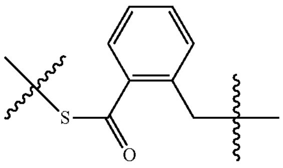

,

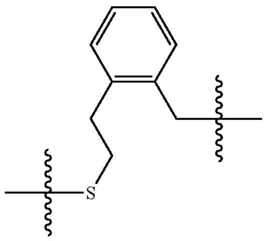

, and

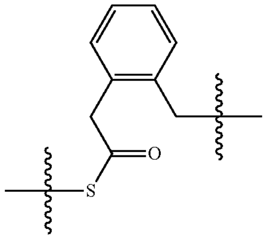

, and the sulfur atom is connect to V. In some embodiments, $L^1$ is an optionally substituted group selected from

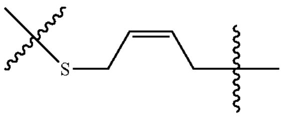

,

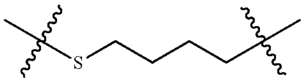

,

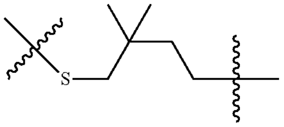

,

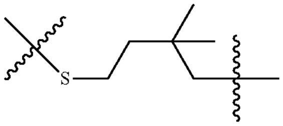

,

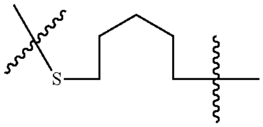

,

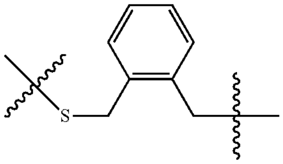

,

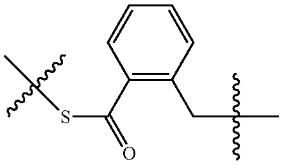

,

-continued

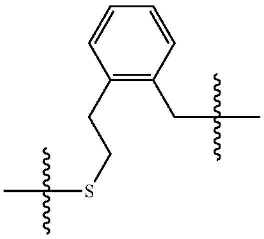

, and

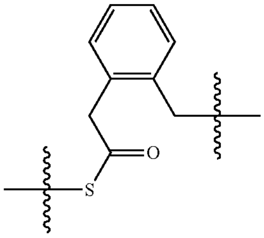

, and the carbon atom is connect to X.

In some embodiments, L has the structure of:

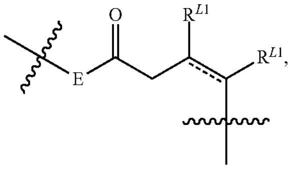

wherein:

E is —O—, —S—, —NR'— or —C(R')$_2$—;

⎓ is a single or double bond;

the two $R^{L1}$ are taken together with the two carbon atoms to which they are bound to form an optionally substituted aryl, carbocyclic, heteroaryl or heterocyclic ring; and each R' is independently as defined above and described herein.

In some embodiments, L has the structure of:

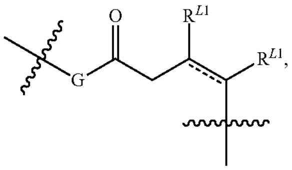

wherein:

G is —O—, —S—, or —NR';

⎓ is a single or double bond; and the two $R^{L1}$ are taken together with the two carbon atoms to which they are bound to form an optionally substituted aryl, $C_3$-$C_{10}$ carbocyclic, heteroaryl or heterocyclic ring.

In some embodiments, L has the structure of:

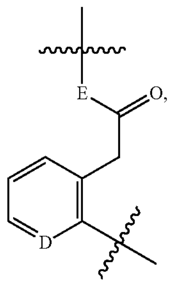

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, —C(CO$_2$—(C$_1$-C$_6$ aliphatic))—, or =C(CF$_3$)—; and each R' is independently as defined above and described herein.

In some embodiments, L has the structure of:

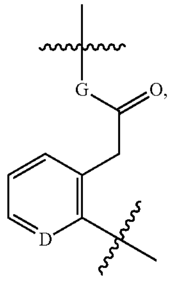

wherein:

G is —O—, —S—, or —NR';

D is =N—, =C(F)—, =C(Cl)—, —C(Br)—, =C(I)—, =C(CN)—, =C(NO$_2$)—, —C(CO$_2$—(C$_1$-C$_6$ aliphatic))—, or =C(CF$_3$)—.

In some embodiments, L has the structure of:

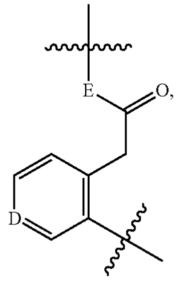

wherein:

E is —O—, —S—, —NR'— or —C(R')$_2$—;

D is =N—, =C(F)—, =C(Cl)—, —C(Br)—, =C(I)—, =C(CN)—, =C(NO$_2$)—, =C(CO$_2$—(C$_1$-C$_6$ aliphatic))—, or =C(CF$_3$)—; and each R' is independently as defined above and described herein.

In some embodiments, L has the structure of:

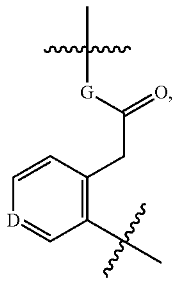

wherein:

G is —O—, —S—, or —NR';

D is =N—, =C(F)—, =C(Cl)—, —C(Br)—, =C(I)—, =C(CN)—, —C(NO$_2$)—, =C(CO$_2$—(C$_1$-C$_6$ aliphatic))—, or =C(CF$_3$)—.

In some embodiments, L has the structure of:

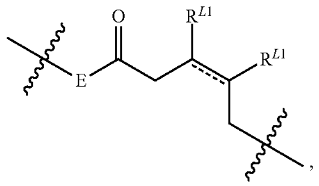

wherein:

E is —O—, —S—, —NR'— or —C(R')$_2$—;

----- is a single or double bond;

the two $R^{L1}$ are taken together with the two carbon atoms to which they are bound to form an optionally substituted aryl, C$_3$-C$_{10}$ carbocyclic, heteroaryl or heterocyclic ring;

and each R' is independently as defined above and described herein.

In some embodiments, L has the structure of:

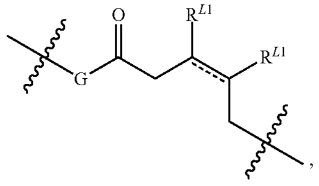

wherein:

G is —O—, —S—, or —NR';

----- is a single or double bond;

the two $R^{L1}$ are taken together with the two carbon atoms to which they are bound to form an optionally substituted aryl, C$_3$-C$_{10}$ carbocyclic, heteroaryl or heterocyclic ring;

and each R' is independently as defined above and described herein.

In some embodiments, L has the structure of:

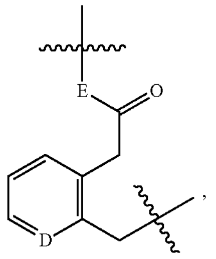

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))—, or =C(CF$_3$)—; and each R' is independently as defined above and described herein.

In some embodiments, L has the structure of:

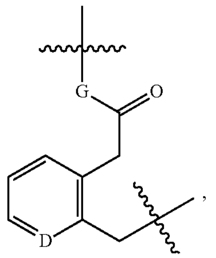

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))—, or =C(CF$_3$)—; and each R' is independently as defined above and described herein.

In some embodiments, L has the structure of:

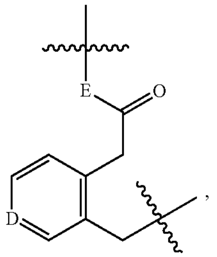

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))—, or =C(CF$_3$)—; and each R' is independently as defined above and described herein.

In some embodiments, L has the structure of:

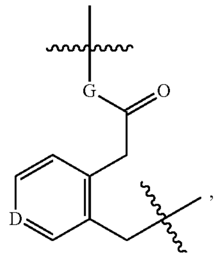

wherein:

G is —O—, —S—, or —NR';

D is =N—, =C(F)—, =C(Cl)—, —C(Br)—, =C(I)—, =C(CN)—, =C(NO$_2$)—, =C(CO$_2$—(C$_1$-C$_6$ aliphatic))—, or =C(CF$_3$)—; and each R' is independently as defined above and described herein.

In some embodiments, L has the structure of:

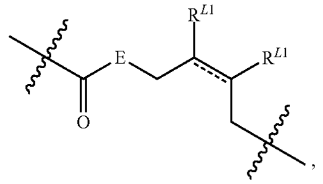

wherein:

E is —O—, —S—, —NR'— or —C(R')$_2$—;

⎓ is a single or double bond;

the two $R^{L1}$ are taken together with the two carbon atoms to which they are bound to form an optionally substituted aryl, $C_3$-$C_{10}$ carbocyclic, heteroaryl or heterocyclic ring; and each R' is independently as defined above and described herein.

In some embodiments, L has the structure of:

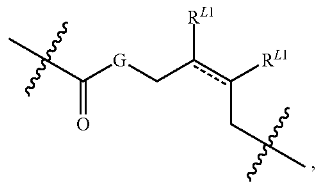

wherein:

G is —O—, —S—, or —NR';

⎓ is a single or double bond;

the two $R^{L1}$ are taken together with the two carbon atoms to which they are bound to form an optionally substituted aryl, $C_3$-$C_{10}$ carbocyclic, heteroaryl or heterocyclic ring; and each R' is independently as defined above and described herein.

In some embodiments, L has the structure of:

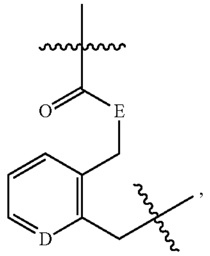

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))—, or =C(CF$_3$)—; and each R' is independently as defined above and described herein.

In some embodiments, L has the structure of:

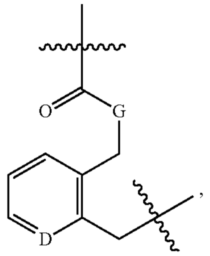

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))—, or =C(CF$_3$)—; and R' is as defined above and described herein.

In some embodiments, L has the structure of:

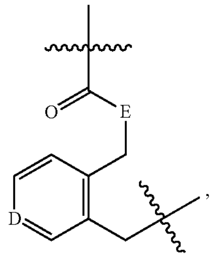

wherein:

E is —O—, —S—, —NR'— or —C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))—, or =C(CF$_3$)—; and each R' is independently as defined above and described herein.

In some embodiments, L has the structure of:

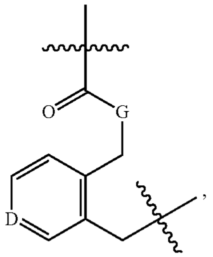

wherein:

G is —O—, —S—, or —NR';

D is =N—, =C(F)—, =C(Cl)—, =C(Br)—, =C(I)—, =C(CN)—, =C(NO$_2$)—, —C(CO$_2$—(C$_1$-C$_6$ aliphatic))—, or =C(CF$_3$)—; and R' is as defined above and described herein.

In some embodiments, L has the structure of:

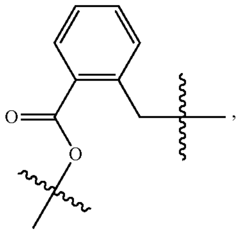 [SMILES: *Cc1ccccc1C(=O)O*]

wherein the phenyl ring is optionally substituted. In some embodiments, the phenyl ring is not substituted. In some embodiments, the phenyl ring is substituted.

In some embodiments, L has the structure of:

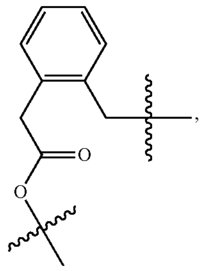 [SMILES: *Cc1ccccc1CC(=O)O*]

wherein the phenyl ring is optionally substituted. In some embodiments, the phenyl ring is not substituted. In some embodiments, the phenyl ring is substituted.

In some embodiments, L has the structure of:

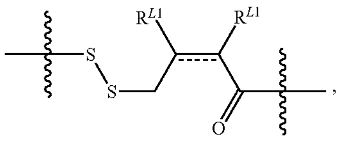

wherein:

- - - - is a single or double bond; and the two $R^{L1}$ are taken together with the two carbon atoms to which they are bound to form an optionally substituted aryl, $C_3$-$C_{10}$ carbocyclic, heteroaryl or heterocyclic ring.

In some embodiments, L has the structure of:

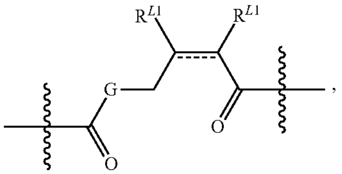

wherein:

G is —O—, —S—, or —NR';

----- is a single or double bond; and the two $R^{L1}$ are taken together with the two carbon atoms to which they are bound to form an optionally substituted aryl, $C_3$-$C_{10}$ carbocyclic, heteroaryl or heterocyclic ring.

In some embodiments, E is —O—, —S—, —NR'— or —C(R')$_2$—, wherein each R' independently as defined above and described herein. In some embodiments, E is —O—, —S—, or —NR'—. In some embodiments, E is —O—, —S—, or —NH—. In some embodiments, E is —O—. In some embodiments, E is —S—. In some embodiments, E is —NH—.

In some embodiments, G is —O—, —S—, or —NR', wherein each R' independently as defined above and described herein. In some embodiments, G is —O—, —S—, or —NH—. In some embodiments, G is —O—. In some embodiments, G is —S—. In some embodiments, G is —NH—.

In some embodiments, L is -$L^3$-G—, wherein:

$L^3$ is an optionally substituted $C_1$-$C_5$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

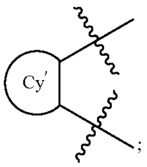 [SMILES: *CC*]

and wherein each of G, R' and Ring Cy' is independently as defined above and described herein.

In some embodiments, L is -$L^3$-S—, wherein $L^3$ is as defined above and described herein. In some embodiments, L is -$L^3$-O—, wherein $L^3$ is as defined above and described herein. In some embodiments, L is -$L^3$-N(R')—, wherein each of $L^3$ and R' is independently as defined above and described herein. In some embodiments, L is -$L^3$-NH—, wherein each of $L^3$ and R' is independently as defined above and described herein.

In some embodiments, $L^3$ is an optionally substituted $C_5$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

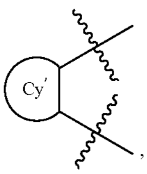 [SMILES: *CC*]

and each of R' and Ring Cy' is independently as defined above and described herein. In some embodiments, $L^3$ is an optionally substituted $C_5$ alkylene. In some embodiments, -$L^3$-G— is

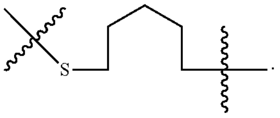 [SMILES: *CCCCCS*]

In some embodiments, $L^3$ is an optionally substituted $C_4$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

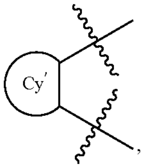 [SMILES: *CC*]

and each of R' and Cy' is independently as defined above and described herein.

In some embodiments, -$L^3$-G— is

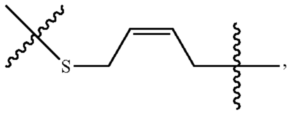

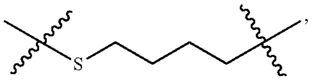

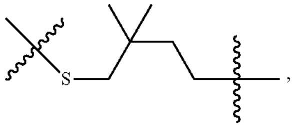

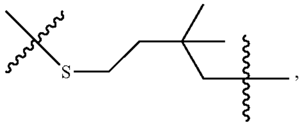

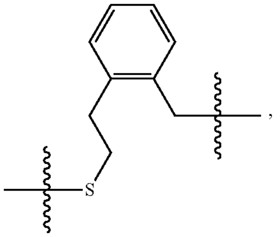

-continued

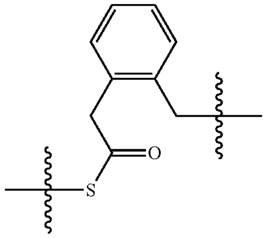

, or

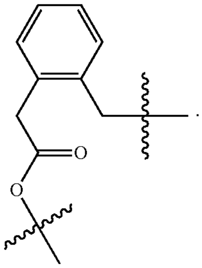

In some embodiments, $L^3$ is an optionally substituted $C_3$ alkylene or alkenylene, wherein one or more methylene units are optionally and independently replaced by —O—, —S—, —N(R')—, —C(O)—, —C(S)—, —C(NR')—, —S(O)—, —$S(O)_2$—, or

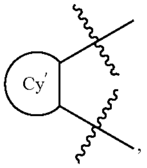 [SMILES: *CC*]

and each of R' and Cy' is independently as defined above and described herein.

In some embodiments, -$L^3$-G— is

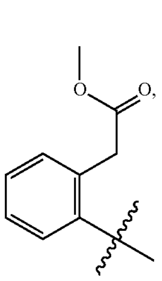

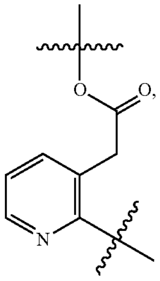

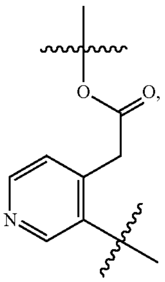

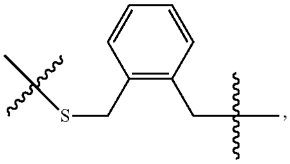

-continued

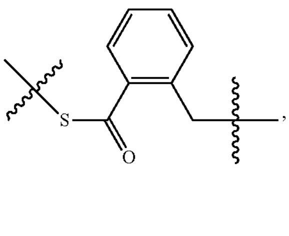

,

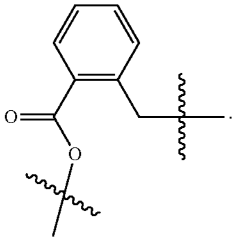

In some embodiments, L is

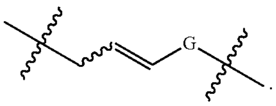

In some embodiments, L is

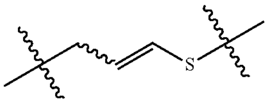

or

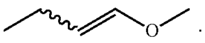

In some embodiments, L is

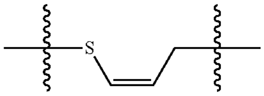

or

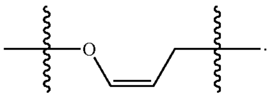

In some embodiments, $L^3$ is an optionally substituted $C_2$ alkylene or alkenylene, wherein one or more methylene units are optionally and independently replaced by —O—, —S—, —N(R')—, —C(O)—, —C(S)—, —C(NR')—, —S(O)—, —$S(O)_2$—, or

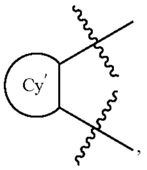 [SMILES: *CC*]

and each of R' and Cy' is independently as defined above and described herein.

In some embodiments, $-L^3-G—$ is

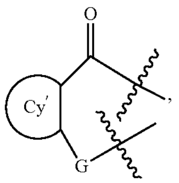

wherein each of G and Cy' is independently as defined above and described herein. In some embodiments, L is

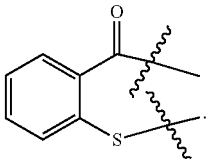 [SMILES: *Sc1ccccc1C(*)=O]

In some embodiments, L is $-L^4-G—$, wherein $L^4$ is an optionally substituted $C_1-C_2$ alkylene; and G is as defined above and described herein. In some embodiments, L is $-L^4-G—$, wherein $L^4$ is an optionally substituted $C_1-C_2$ alkylene; G is as defined above and described herein; and G is connected to $R^1$. In some embodiments, L is $-L^4-G—$, wherein $L^4$ is an optionally substituted methylene; G is as defined above and described herein; and G is connected to $R^1$. In some embodiments, L is $-L^4-G—$, wherein $L^4$ is methylene; G is as defined above and described herein; and G is connected to $R^1$. In some embodiments, L is $-L^4-G—$, wherein $L^4$ is an optionally substituted $—(CH_2)_2—$; G is as defined above and described herein; and G is connected to $R^1$. In some embodiments, L is $-L^4-G—$, wherein $L^4$ is $—(CH_2)_2—$; G is as defined above and described herein; and G is connected to $R^1$.

In some embodiments, L is

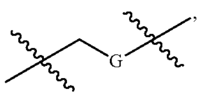

, or

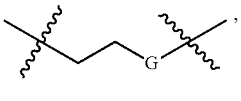

, wherein G is as defined above and described herein, and G is connected to $R^1$. In some embodiments, L is

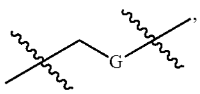

, wherein G is as defined above and described herein, and G is connected to $R^1$. In some embodiments, L is

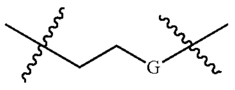

, wherein G is as defined above and described herein, and G is connected to $R^1$. In some embodiments, L is

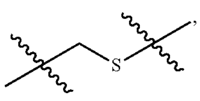

, or

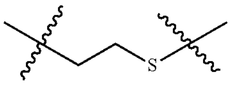

, wherein the sulfur atom is connected to $R^1$. In some embodiments, L is

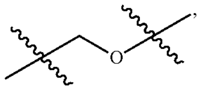

, or

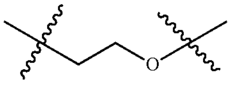

, wherein the oxygen atom is connected to $R^1$.

In some embodiments, L is

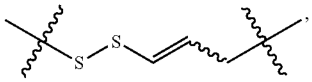

,

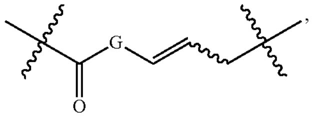

, or

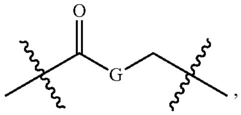

, wherein G is as defined above and described herein.

In some embodiments, L is $—S—R^{L3}—$ or $—S—C(O)—R^{L3}—$, wherein $R^{L3}$ is an optionally substituted, linear or branched, $C_1-C_9$ alkylene, wherein one or more methylene units are optionally and independently replaced by an optionally substituted $C_1-C_6$ alkylene, $C_1-C_6$ alkenylene, —C≡C—, $—C(R')_2—$, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, $—S(O)_2—$, $—S(O)_2N(R')—$, $—N(R')S(O)_2—$, —SC(O)—, —C(O)S—, —OC(O)—, or —C(O)O—, wherein each of R' and —Cy— is independently as defined above and described herein. In some embodiments, L is $—S—R^{L3}—$ or $—S—C(O)—R^{L3}—$, wherein $R^{L3}$ is an optionally substituted $C_1-C_6$ alkylene. In some embodiments, L is $—S—R^{L3}—$ or $—S—C(O)—R^{L3}—$, wherein $R^{L3}$ is an optionally substituted $C_1-C_6$ alkenylene. In some embodiments, L is $—S—R^{L3}—$ or $—S—C(O)—R^{L3}—$, wherein $R^{L3}$ is an optionally substituted $C_1-C_6$ alkylene wherein one or more methylene units are optionally and independently replaced by an optionally substituted $C_1-C_6$ alkenylene, arylene, or heteroarylene. In some embodiments, In some embodiments, $R^{L3}$ is an optionally substituted $—S—(C_1-C_6$ alkenylene)-, $—S—(C_1-C_6$ alkylene)-, $—S—(C_1-C_6$ alkylene)-arylene-$(C_1-C_6$ alkylene)-, $—S—CO$-arylene-$(C_1-C_6$ alkylene)-, or $—S—CO—(C_1-C_6$ alkylene)-arylene-$(C_1-C_6$ alkylene)-.

In some embodiments, L is

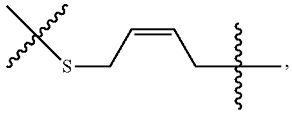,

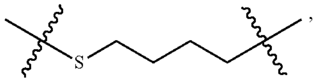,

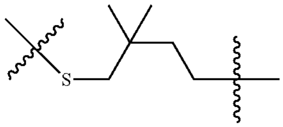,

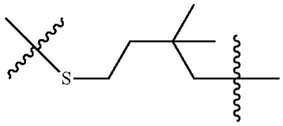,

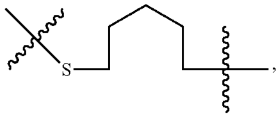,

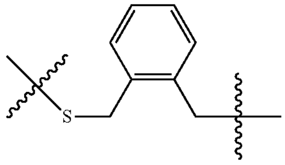,

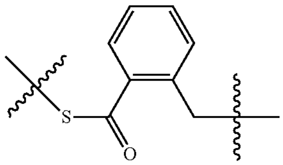,

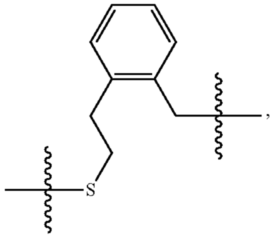, or

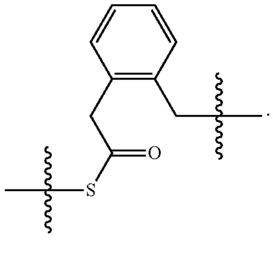.

In some embodiments, L is

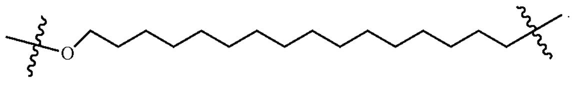 [SMILES: *CCCCCCCCCCCCCCCCO*].

In some embodiments, L is

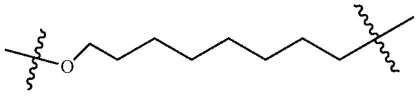.

In some embodiments,

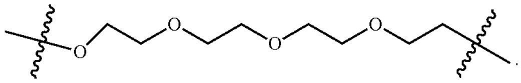 [SMILES: *CCOCCOCCOCCO*].

In some embodiments, the sulfur atom in the L embodiments described above and herein is connected to X. In some embodiments, the sulfur atom in the L embodiments described above and herein is connected to $R^1$.

In some embodiments, $R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein.

In some embodiments, $R^1$ is hydrogen. In some embodiments, $R^1$ is halogen. In some embodiments, $R^1$ is —F. In some embodiments, $R^1$ is —Cl. In some embodiments, $R^1$ is —Br. In some embodiments, $R^1$ is —I.

In some embodiments, $R^1$ is R wherein R is as defined above and described herein.

In some embodiments, $R^1$ is hydrogen. In some embodiments, $R^1$ is an optionally substituted group selected from $C_1$-$C_{50}$ aliphatic, phenyl, carbocyclyl, aryl, heteroaryl, or heterocyclyl.

In some embodiments, $R^1$ is an optionally substituted $C_1$-$C_{50}$ aliphatic. In some embodiments, $R^1$ is an optionally substituted $C_1$-$C_{10}$ aliphatic. In some embodiments, $R^1$ is an optionally substituted $C_1$-$C_6$ aliphatic. In some embodiments, $R^1$ is an optionally substituted $C_1$-$C_6$ alkyl. In some embodiments, $R^1$ is optionally substituted, linear or branched hexyl. In some embodiments, $R^1$ is optionally substituted, linear or branched pentyl. In some embodiments, $R^1$ is optionally substituted, linear or branched butyl. In some embodiments, $R^1$ is optionally substituted, linear or branched propyl. In some embodiments, $R^1$ is optionally substituted ethyl. In some embodiments, $R^1$ is optionally substituted methyl.

In some embodiments, $R^1$ is optionally substituted phenyl. In some embodiments, $R^1$ is substituted phenyl. In some embodiments, $R^1$ is phenyl.

In some embodiments, $R^1$ is optionally substituted carbocyclyl. In some embodiments, $R^1$ is optionally substituted $C_3$-$C_{10}$ carbocyclyl. In some embodiments, $R^1$ is optionally substituted monocyclic carbocyclyl. In some embodiments, $R^1$ is optionally substituted cycloheptyl. In some embodiments, $R^1$ is optionally substituted cyclohexyl. In some embodiments, $R^1$ is optionally substituted cyclopentyl. In some embodiments, $R^1$ is optionally substituted cyclobutyl. In some embodiments, $R^1$ is an optionally substituted cyclopropyl. In some embodiments, $R^1$ is optionally substituted bicyclic carbocyclyl.

In some embodiments, $R^1$ is an optionally substituted $C_1$-$C_{50}$ polycyclic hydrocarbon. In some embodiments, $R^1$ is an optionally substituted $C_1$-$C_{50}$ polycyclic hydrocarbon wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is optionally substituted

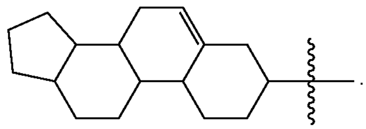

.

In some embodiments, $R^1$ is

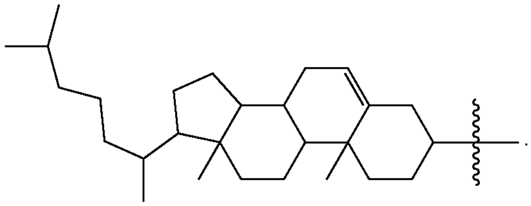 [SMILES: *C1CCC2(C)C(=CCC3C2CCC2(C)C(C(C)CCCC(C)C)CCC32)C1]

.

In some embodiments, $R^1$ is optionally substituted

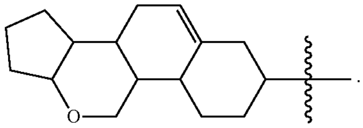

.

In some embodiments, $R^1$ is an optionally substituted $C_1$-$C_{50}$ aliphatic comprising one or more optionally substituted polycyclic hydrocarbon moieties. In some embodiments, $R^1$ is an optionally substituted $C_1$-$C_{50}$ aliphatic comprising one or more optionally substituted polycyclic hydrocarbon moieties, wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{50}$ aliphatic comprising one or more optionally substituted

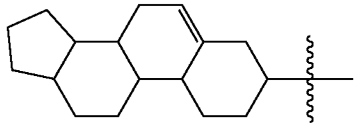

,

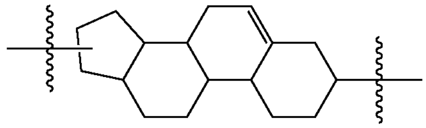

,

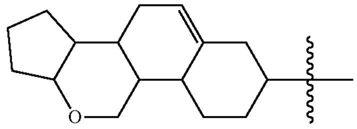

, or

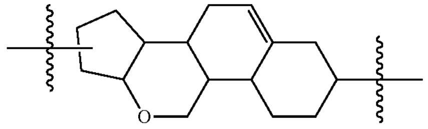

.

In some embodiments, $R^1$ is

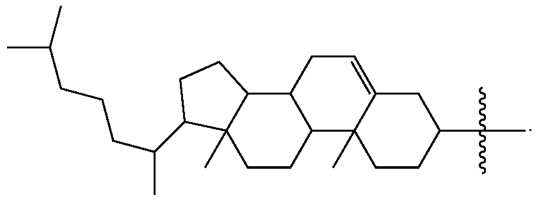 [SMILES: *C1CCC2(C)C(=CCC3C2CCC2(C)C(C(C)CCCC(C)C)CCC32)C1]

.

In some embodiments, $R^1$ is

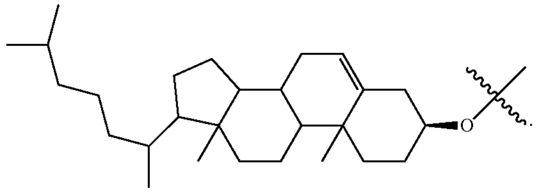 [SMILES: *O[C@H]1CCC2(C)C(=CCC3C2CCC2(C)C(C(C)CCCC(C)C)CCC32)C1]

.

In some embodiments, $R^1$ is

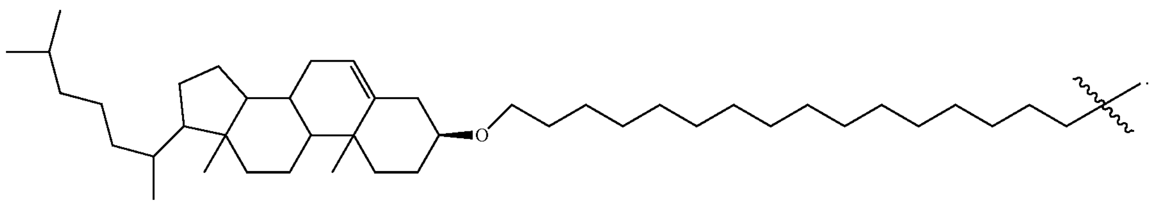 [SMILES: *CCCCCCCCCCCCCCCCO[C@H]1CCC2(C)C(=CCC3C2CCC2(C)C(C(C)CCCC(C)C)CCC32)C1]

.

In some embodiments, $R^1$ is

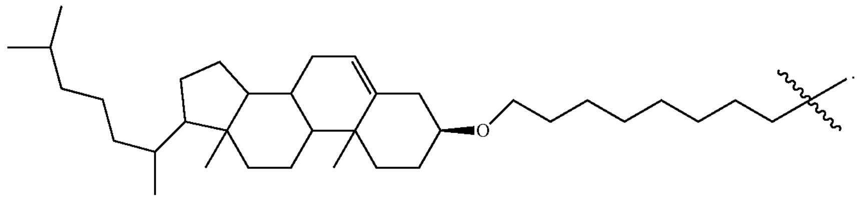 [SMILES: *CCCCCCCCO[C@H]1CCC2(C)C(=CCC3C2CCC2(C)C(C(C)CCCC(C)C)CCC32)C1]

In some embodiments, $R^1$ is

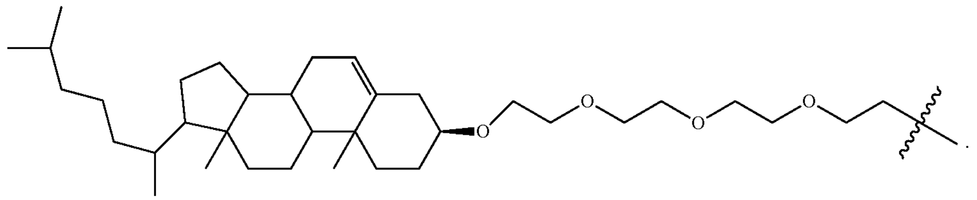 [SMILES: *CCOCCOCCOCCO[C@H]1CCC2(C)C(=CCC3C2CCC2(C)C(C(C)CCCC(C)C)CCC32)C1]

In some embodiments, $R^1$ is an optionally substituted aryl. In some embodiments, $R^1$ is an optionally substituted bicyclic aryl ring.

In some embodiments, $R^1$ is an optionally substituted heteroaryl. In some embodiments, $R^1$ is an optionally substituted 5-6 membered monocyclic heteroaryl ring having 1-3 heteroatoms independently selected from nitrogen, sulfur, or oxygen. In some embodiments, $R^1$ is a substituted 5-6 membered monocyclic heteroaryl ring having 1-3 heteroatoms independently selected from nitrogen, oxygen, or sulfur. In some embodiments, $R^1$ is an unsubstituted 5-6 membered monocyclic heteroaryl ring having 1-3 heteroatoms independently selected from nitrogen, sulfur, or oxygen.

In some embodiments, $R^1$ is an optionally substituted 5 membered monocyclic heteroaryl ring having 1-3 heteroatoms independently selected from nitrogen, oxygen or sulfur. In some embodiments, $R^1$ is an optionally substituted 6 membered monocyclic heteroaryl ring having 1-3 heteroatoms independently selected from nitrogen, oxygen, or sulfur.

In some embodiments, $R^1$ is an optionally substituted 5-membered monocyclic heteroaryl ring having 1 heteroatom selected from nitrogen, oxygen, or sulfur. In some embodiments, $R^1$ is selected from pyrrolyl, furanyl, or thienyl.

In some embodiments, $R^1$ is an optionally substituted 5-membered heteroaryl ring having 2 heteroatoms independently selected from nitrogen, oxygen, or sulfur. In certain embodiments, $R^1$ is an optionally substituted 5-membered heteroaryl ring having 1 nitrogen atom, and an additional heteroatom selected from sulfur or oxygen. Example $R^1$ groups include optionally substituted pyrazolyl, imidazolyl, thiazolyl, isothiazolyl, oxazolyl or isoxazolyl.

In some embodiments, $R^1$ is a 6-membered heteroaryl ring having 1-3 nitrogen atoms. In other embodiments, $R^1$ is an optionally substituted 6-membered heteroaryl ring having 1-2 nitrogen atoms. In some embodiments, $R^1$ is an optionally substituted 6-membered heteroaryl ring having 2 nitrogen atoms. In certain embodiments, $R^1$ is an optionally substituted 6-membered heteroaryl ring having 1 nitrogen. Example $R^1$ groups include optionally substituted pyridinyl, pyrimidinyl, pyrazinyl, pyridazinyl, triazinyl, or tetrazinyl.

In certain embodiments, $R^1$ is an optionally substituted 8-10 membered bicyclic heteroaryl ring having 1-4 heteroatoms independently selected from nitrogen, oxygen, or sulfur. In some embodiments, $R^1$ is an optionally substituted 5,6-fused heteroaryl ring having 1-4 heteroatoms independently selected from nitrogen, oxygen, or sulfur. In other embodiments, $R^1$ is an optionally substituted 5,6-fused heteroaryl ring having 1-2 heteroatoms independently selected from nitrogen, oxygen, or sulfur. In certain embodiments, $R^1$ is an optionally substituted 5,6-fused heteroaryl ring having 1 heteroatom independently selected from nitrogen, oxygen, or sulfur. In some embodiments, $R^1$ is an optionally substituted indolyl. In some embodiments, $R^1$ is an optionally substituted azabicyclo[3.2.1]octanyl. In certain embodiments, $R^1$ is an optionally substituted 5,6-fused heteroaryl ring having 2 heteroatoms independently selected from nitrogen, oxygen, or sulfur. In some embodiments, $R^1$ is an optionally substituted azaindolyl. In some embodiments, $R^1$ is an optionally substituted benzimidazolyl. In some embodiments, $R^1$ is an optionally substituted benzothiazolyl. In some embodiments, $R^1$ is an optionally substituted benzoxazolyl. In some embodiments, $R^1$ is an optionally substituted indazolyl. In certain embodiments, $R^1$ is an optionally substituted 5,6-fused heteroaryl ring having 3 heteroatoms independently selected from nitrogen, oxygen, or sulfur.

In certain embodiments, $R^1$ is an optionally substituted 6,6-fused heteroaryl ring having 1-4 heteroatoms independently selected from nitrogen, oxygen, or sulfur. In some embodiments, $R^1$ is an optionally substituted 6,6-fused heteroaryl ring having 1-2 heteroatoms independently selected from nitrogen, oxygen, or sulfur. In other embodiments, $R^1$ is an optionally substituted 6,6-fused heteroaryl ring having 1 heteroatom independently selected from nitrogen, oxygen, or sulfur. In some embodiments, $R^1$ is an optionally substituted quinolinyl. In some embodiments, $R^1$ is an optionally substituted isoquinolinyl. According to one aspect, $R^1$ is an optionally substituted 6,6-fused heteroaryl ring having 2 heteroatoms independently selected from nitrogen, oxygen, or sulfur. In some embodiments, $R^1$ is a quinazoline or a quinoxaline.

In some embodiments, $R^1$ is an optionally substituted heterocyclyl. In some embodiments, $R^1$ is an optionally substituted 3-7 membered saturated or partially unsaturated heterocyclic ring having 1-2 heteroatoms independently selected from nitrogen, oxygen, or sulfur. In some embodiments, $R^1$ is a substituted 3-7 membered saturated or partially unsaturated heterocyclic ring having 1-2 heteroatoms independently selected from nitrogen, oxygen, or sulfur. In some embodiments, $R^1$ is an unsubstituted 3-7 membered saturated or partially unsaturated heterocyclic ring having 1-2 heteroatoms independently selected from nitrogen, oxygen, or sulfur.

In some embodiments, $R^1$ is an optionally substituted heterocyclyl. In some embodiments, $R^1$ is an optionally substituted 6 membered saturated or partially unsaturated heterocyclic ring having 1-2 heteroatoms independently selected from nitrogen, oxygen, or sulfur. In some embodiments, $R^1$ is an optionally substituted 6 membered partially unsaturated heterocyclic ring having 2 heteroatoms independently selected from nitrogen, oxygen, or sulfur. In some embodiments, $R^1$ is an optionally substituted 6 membered partially unsaturated heterocyclic ring having 2 oxygen atoms.

In certain embodiments, $R^1$ is a 3-7 membered saturated or partially unsaturated heterocyclic ring having 1-2 heteroatoms independently selected from nitrogen, oxygen, or sulfur. In certain embodiments, R' is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, $R^1$ is an optionally substituted 5 membered saturated or partially unsaturated heterocyclic ring having 1-2 heteroatoms independently selected from nitrogen, oxygen, or sulfur.

In certain embodiments, $R^1$ is an optionally substituted 5-6 membered partially unsaturated monocyclic ring having 1-2 heteroatoms independently selected from nitrogen, oxygen, or sulfur. In certain embodiments, $R^1$ is an optionally substituted tetrahydropyridinyl, dihydrothiazolyl, dihydrooxazolyl, or oxazolinyl group.

In some embodiments, $R^1$ is an optionally substituted 8-10 membered bicyclic saturated or partially unsaturated heterocyclic ring having 1-4 heteroatoms independently selected from nitrogen, oxygen, or sulfur. In some embodiments, $R^1$ is an optionally substituted indolinyl. In some embodiments, $R^1$ is an optionally substituted isoindolinyl. In some embodiments, $R^1$ is an optionally substituted 1, 2, 3, 4-tetrahydroquinoline. In some embodiments, $R^1$ is an optionally substituted 1, 2, 3, 4-tetrahydroisoquinoline.

In some embodiments, $R^1$ is an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{10}$ aliphatic wherein one or more methylene units are optionally and independently replaced by an optionally —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —OC(O)—, or —C(O)O—, wherein each R' is independently as defined above and described herein. In some embodiments, $R^1$ is an optionally substituted $C_1$-$C_{10}$ aliphatic wherein one or more methylene units are optionally and independently replaced by an optionally —Cy—, —O—, —S—, —S—S—, —N(R')—, —C(O)—, —OC(O)—, or —C(O)O—, wherein each R' is independently as defined above and described herein.

In some embodiments, $R^1$ is

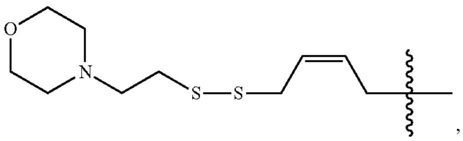
,

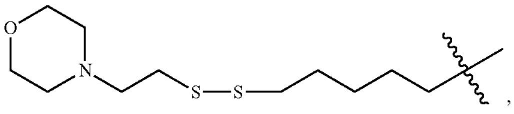
,

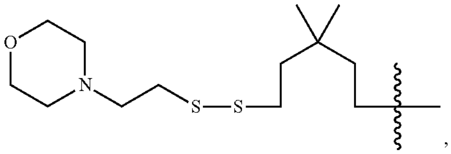
,

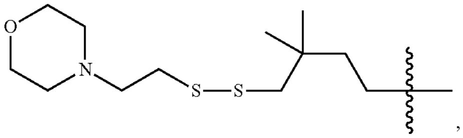
,

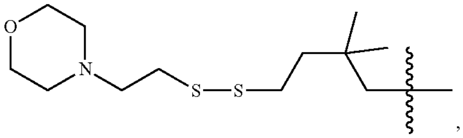
,

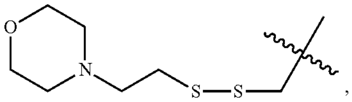
,

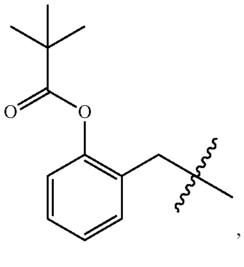
,

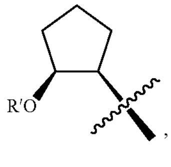
,

-continued
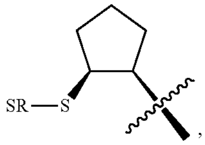,
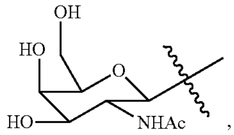,
(GalNAc)
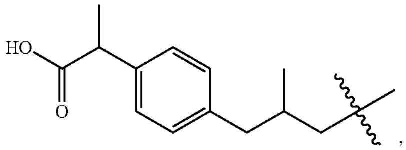,
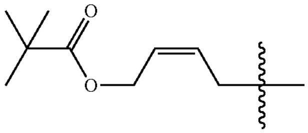,
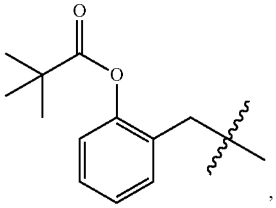, 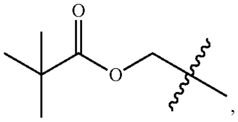,
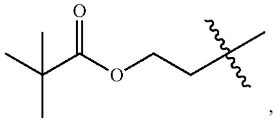,
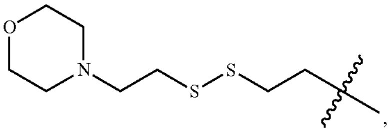,
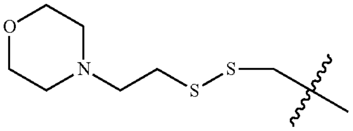
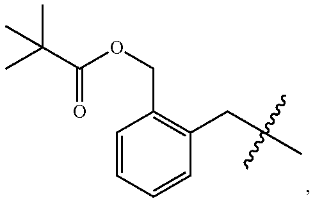,
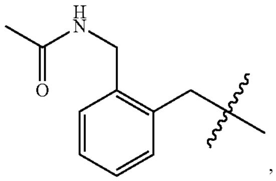, 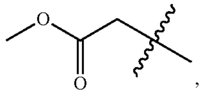,
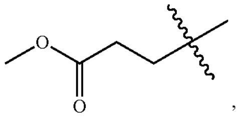,
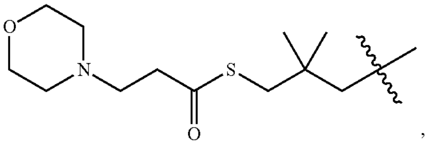,
-continued
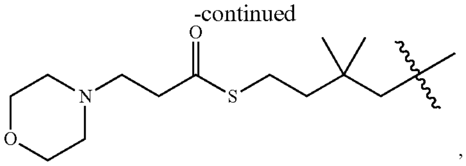,
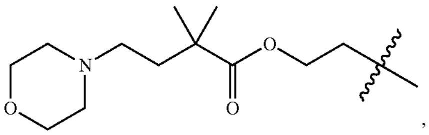,
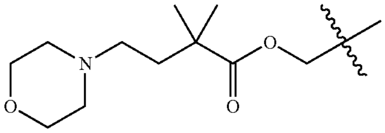,
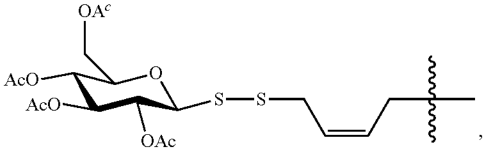,
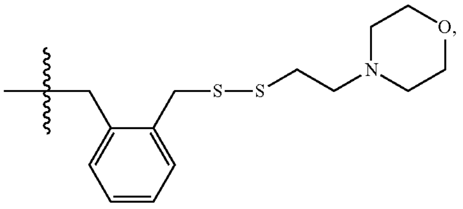
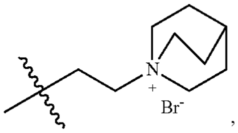, 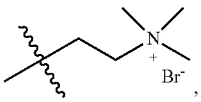,
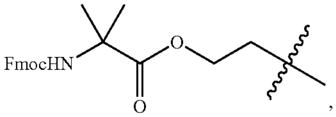,
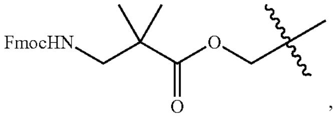,
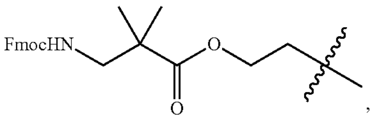,
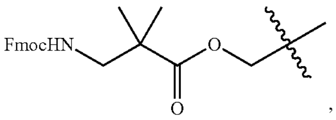,
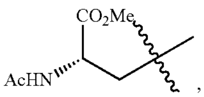,
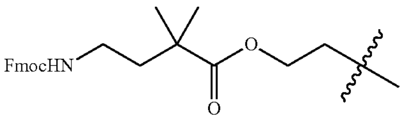,
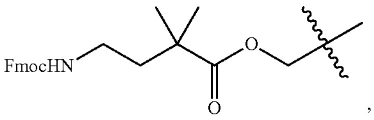, -continued

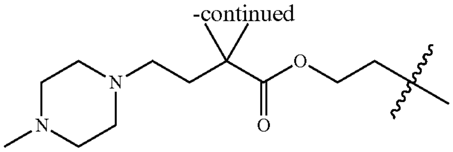
,
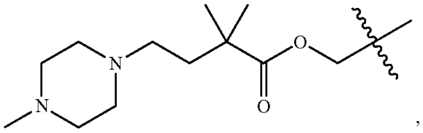
,
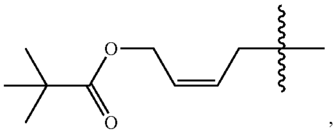
,
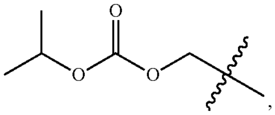
, $CH_3$—,
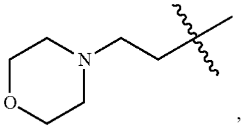
,
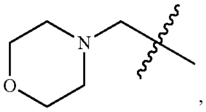
,
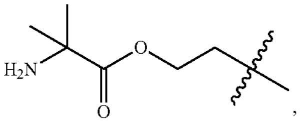
,
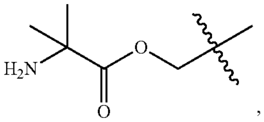
,
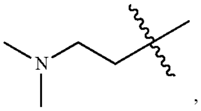
,
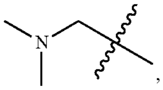
,
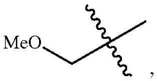
, or
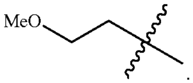
.

In some embodiments, $R^1$ is $CH_3$—,

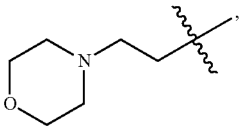
,
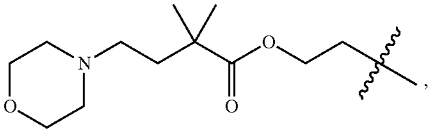
,
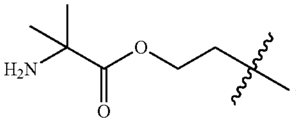
,
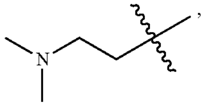
,
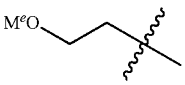
, or

-continued

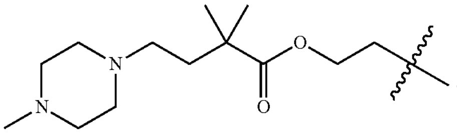
.

In some embodiments, $R^1$ comprises a terminal optionally substituted —$(CH_2)_2$— moiety which is connected to L. Examples of such $R^1$ groups are depicted below:

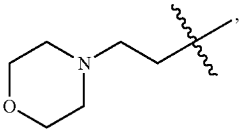
,
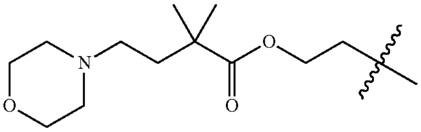
,
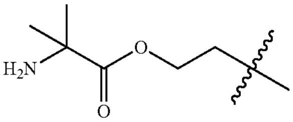
,
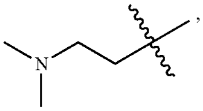
,
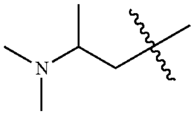
,
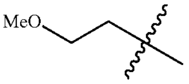
, and
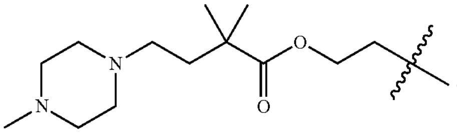
.

In some embodiments, $R^1$ comprises a terminal optionally substituted —$(CH_2)$— moiety which is connected to L. Example such $R^1$ groups are depicted below:

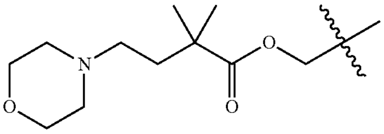
,
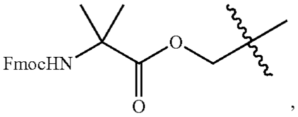
,
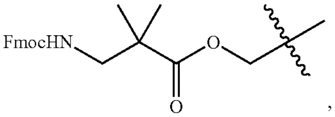
,
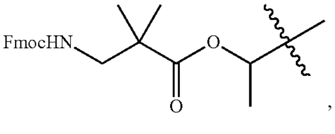
,

-continued

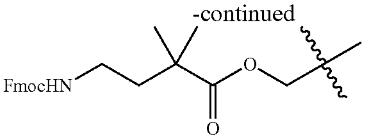,

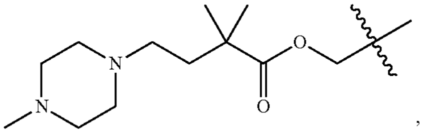,

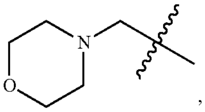, 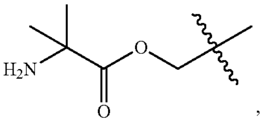,

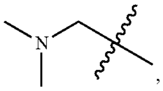, and 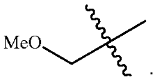.

In some embodiments, $R^1$ is —S—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each of R' and —Cy— is independently as defined above and described herein. In some embodiments, $R^1$ is —S—$R^{L2}$, wherein the sulfur atom is connected with the sulfur atom in L group.

In some embodiments, $R^1$ is —C(O)—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each of R' and —Cy— is independently as defined above and described herein. In some embodiments, $R^1$ is —C(O)—$R^{L2}$, wherein the carbonyl group is connected with G in L group. In some embodiments, $R^1$ is —C(O)—$R^{L2}$, wherein the carbonyl group is connected with the sulfur atom in L group.

In some embodiments, $R^{L2}$ is optionally substituted $C_1$-$C_9$ aliphatic. In some embodiments, $R^{L2}$ is optionally substituted $C_1$-$C_9$ alkyl. In some embodiments, $R^{L2}$ is optionally substituted $C_1$-$C_9$ alkenyl. In some embodiments, $R^{L2}$ is optionally substituted $C_1$-$C_9$ alkynyl. In some embodiments, $R^{L2}$ is an optionally substituted $C_1$-$C_9$ aliphatic wherein one or more methylene units are optionally and independently replaced by —Cy— or —C(O)—. In some embodiments, $R^{L2}$ is an optionally substituted $C_1$-$C_9$ aliphatic wherein one or more methylene units are optionally and independently replaced by —Cy—. In some embodiments, $R^{L2}$ is an optionally substituted $C_1$-$C_9$ aliphatic wherein one or more methylene units are optionally and independently replaced by an optionally substituted heterocyclene. In some embodiments, $R^{L2}$ is an optionally substituted $C_1$-$C_9$ aliphatic wherein one or more methylene units are optionally and independently replaced by an optionally substituted arylene. In some embodiments, $R^{L2}$ is an optionally substituted $C_1$-$C_9$ aliphatic wherein one or more methylene units are optionally and independently replaced by an optionally substituted heteroarylene. In some embodiments, $R^{L2}$ is an optionally substituted $C_1$-$C_9$ aliphatic wherein one or more methylene units are optionally and independently replaced by an optionally substituted $C_3$-$C_{10}$ carbocyclylene. In some embodiments, $R^{L2}$ is an optionally substituted $C_1$-$C_9$ aliphatic wherein two methylene units are optionally and independently replaced by —Cy— or —C(O)—. In some embodiments, $R^{L2}$ is an optionally substituted $C_1$-$C_9$ aliphatic wherein two methylene units are optionally and independently replaced by —Cy— or —C(O)—. Example $R^{L2}$ groups are depicted below:

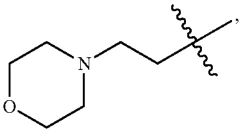,

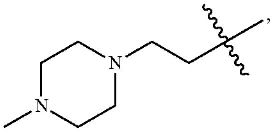, 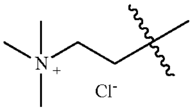,

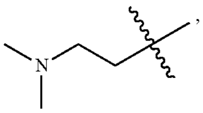, 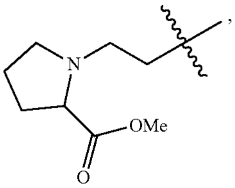,

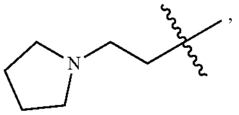, and 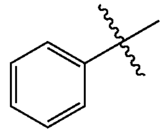.

In some embodiments, $R^1$ is hydrogen, or an optionally substituted group selected from

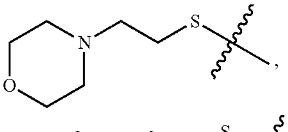,

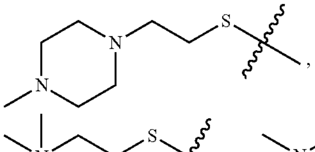,

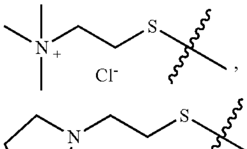, 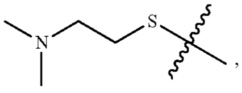,

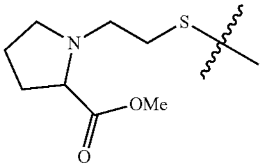,

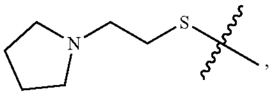, 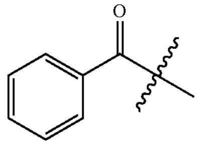,

—S—($C_1$-$C_{10}$ aliphatic), $C_1$-$C_{10}$ aliphatic, aryl, $C_1$-$C_6$ heteroalkyl, heteroaryl and heterocyclyl. In some embodiments, $R^1$ is

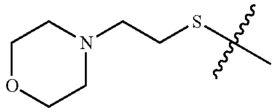,

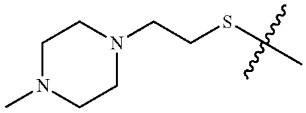,

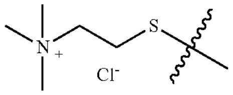,

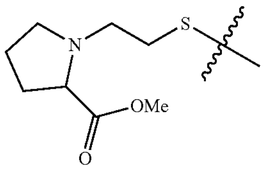,

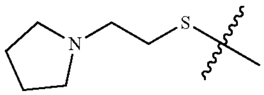, 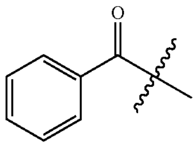, or —S—($C_1$-$C_{10}$ aliphatic). In some embodiments, $R^1$ is

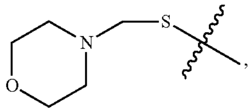,

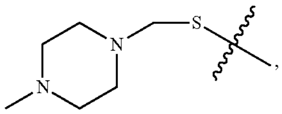, 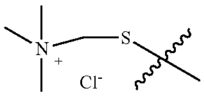,

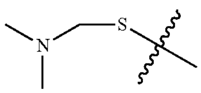, 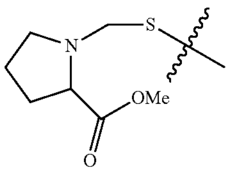, or

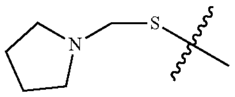.

In some embodiments, $R^1$ is an optionally substituted group selected from —S—($C_1$-$C_6$ aliphatic), $C_1$-$C_{10}$ aliphatic, $C_1$-$C_6$ heteroaliphatic, aryl, heterocyclyl and heteroaryl. In some embodiments, $R^1$ is

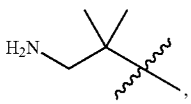, 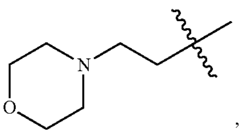,

-continued

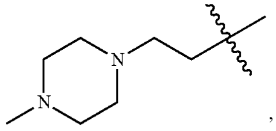, 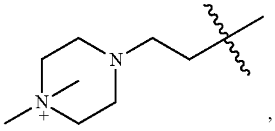,

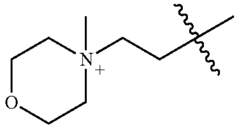, 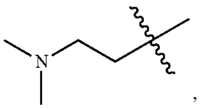,

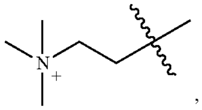, 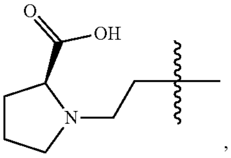,

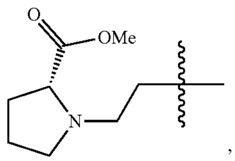, 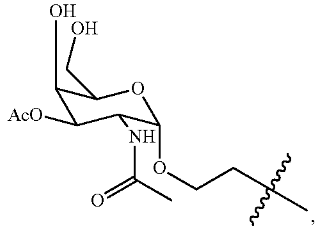,

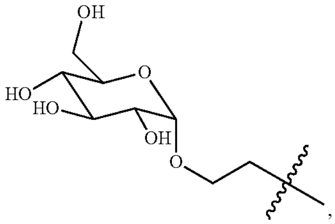, or

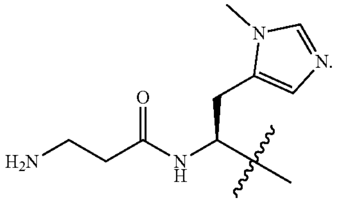

In some embodiments, the sulfur atom in the $R^1$ embodiments described above and herein is connected with the sulfur atom, G, E, or —C(O)— moiety in the L embodiments described above and herein. In some embodiments, the —C(O)— moiety in the $R^1$ embodiments described above and herein is connected with the sulfur atom, G, E, or —C(O)— moiety in the L embodiments described above and herein.

In some embodiments, -L-$R^1$ is any combination of the L embodiments and $R^1$ embodiments described above and herein.

In some embodiments, -L-$R^1$ is -$L^3$-G—$R^1$ wherein each variable is independently as defined above and described herein.

In some embodiments, -L-$R^1$ is -$L^4$-G—$R^1$ wherein each variable is independently as defined above and described herein.

In some embodiments, -L-$R^1$ is -$L^3$-G—S—$R^{L2}$, wherein each variable is independently as defined above and described herein.

In some embodiments, -L-$R^1$ is -$L^3$-G—C(O)—$R^{L2}$, wherein each variable is independently as defined above and described herein.

In some embodiments, $-L-R^1$ is

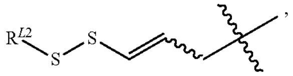

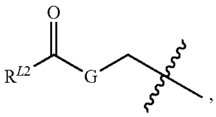

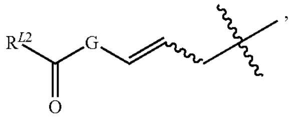

or 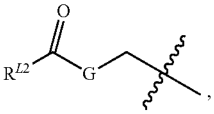

wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, and each G is independently as defined above and described herein.

In some embodiments, $-L-R^1$ is $—R^{L3}—S—S—R^{L2}$, wherein each variable is independently as defined above and described herein. In some embodiments, $-L-R^1$ is $—R^{L3}—C(O)—S—S—R^{L2}$, wherein each variable is independently as defined above and described herein.

In some embodiments, $-L-R^1$ has the structure of:

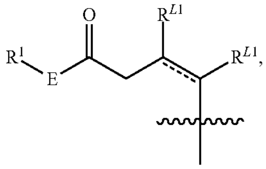

wherein each variable is independently as defined above and described herein.

In some embodiments, $-L-R^1$ has the structure of:

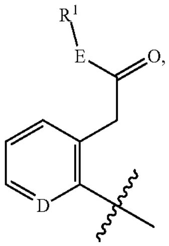

wherein each variable is independently as defined above and described herein.

In some embodiments, $-L-R^1$ has the structure of:

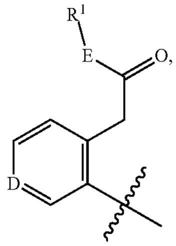

wherein each variable is independently as defined above and described herein.

In some embodiments, $-L-R^1$ has the structure of:

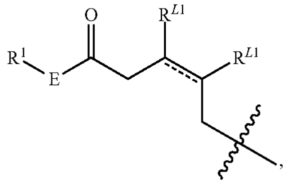

wherein each variable is independently as defined above and described herein.

In some embodiments, $-L-R^1$ has the structure of:

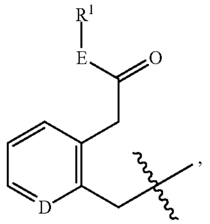

wherein each variable is independently as defined above and described herein.

In some embodiments, $-L-R^1$ has the structure of:

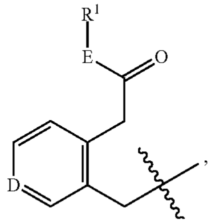

wherein each variable is independently as defined above and described herein.

In some embodiments, -L-$R^1$ has the structure of:

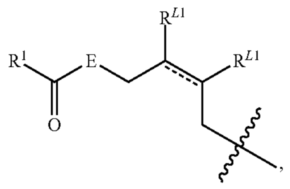

wherein each variable is independently as defined above and described herein.

In some embodiments, -L-$R^1$ has the structure of:

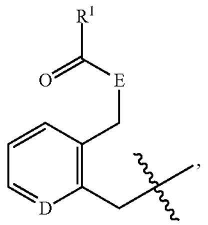

wherein each variable is independently as defined above and described herein.

In some embodiments, -L-$R^1$ has the structure of:

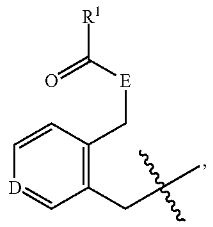

wherein each variable is independently as defined above and described herein.

In some embodiments, -L-$R^1$ has the structure of:

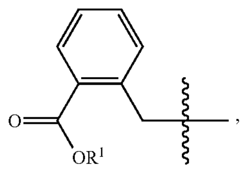

wherein each variable is independently as defined above and described herein.

In some embodiments, -L-$R^1$ has the structure of:

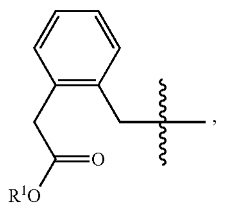

wherein each variable is independently as defined above and described herein.

In some embodiments, -L-$R^1$ has the structure of:

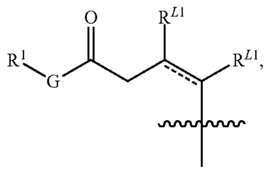

wherein each variable is independently as defined above and described herein.

In some embodiments, -L-$R^1$ has the structure of:

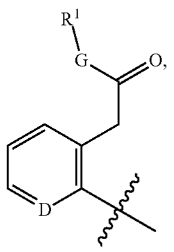

wherein each variable is independently as defined above and described herein.

In some embodiments, -L-$R^1$ has the structure of:

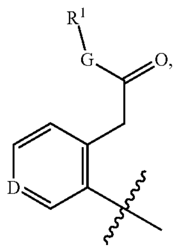

wherein each variable is independently as defined above and described herein.

In some embodiments, -L-$R^1$ has the structure of:

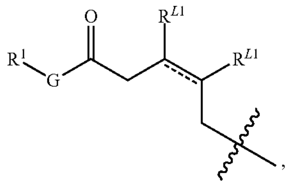

wherein each variable is independently as defined above and described herein.

In some embodiments, -L-$R^1$ has the structure of:

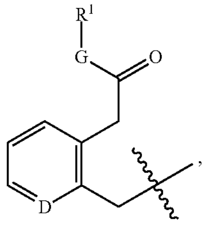

wherein each variable is independently as defined above and described herein.

In some embodiments, -L-$R^1$ has the structure of:

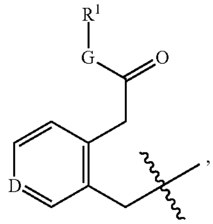

wherein each variable is independently as defined above and described herein.

In some embodiments, -L-$R^1$ has the structure of:

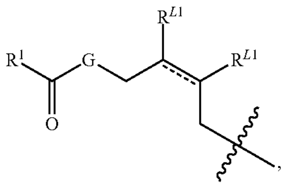

wherein each variable is independently as defined above and described herein.

In some embodiments, -L-$R^1$ has the structure of:

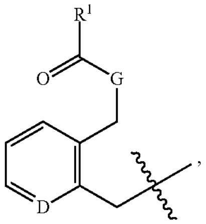

wherein each variable is independently as defined above and described herein.

In some embodiments, -L-$R^1$ has the structure of:

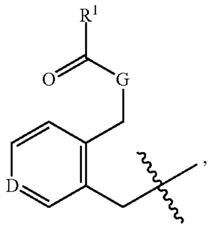

wherein each variable is independently as defined above and described herein.

In some embodiments, -L-$R^1$ has the structure of:

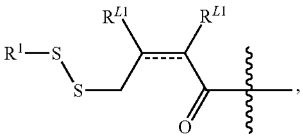

wherein each variable is independently as defined above and described herein.

In some embodiments, L has the structure of:

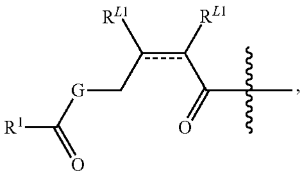

wherein each variable is independently as defined above and described herein.

In some embodiments, —X-L-$R^1$ has the structure of:

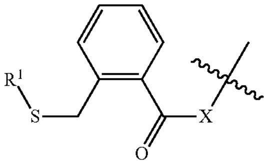

wherein:

the phenyl ring is optionally substituted, and each of $R^1$ and X is independently as defined above and described herein.

In some embodiments, -L-$R^1$ is

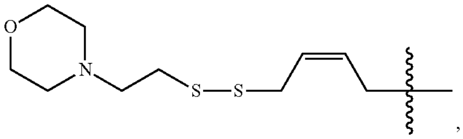
,
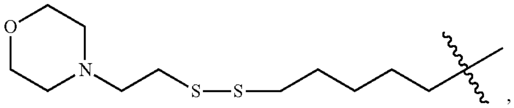
,
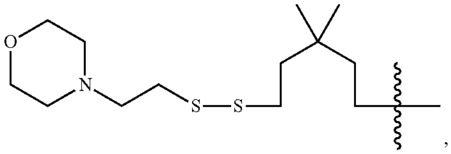
,
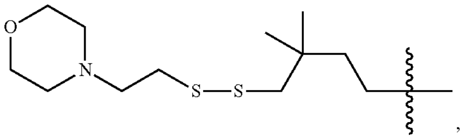
,
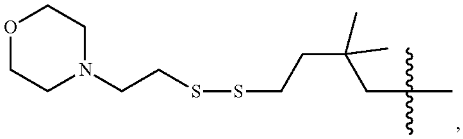
,

-continued
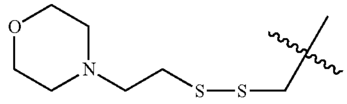,
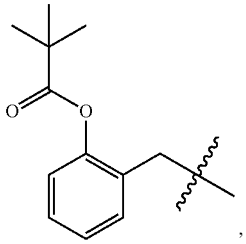, 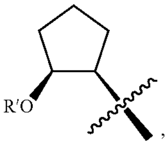,
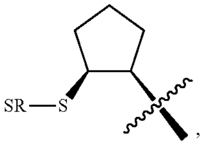, 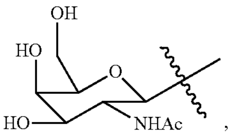,
(GalNAc)
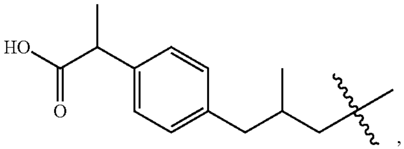,
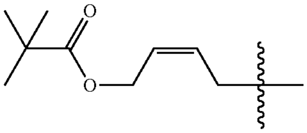,
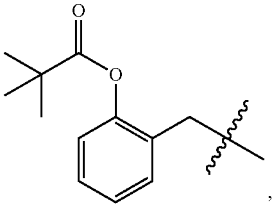, 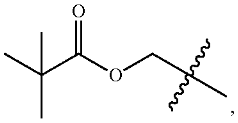,
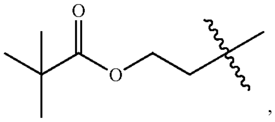,
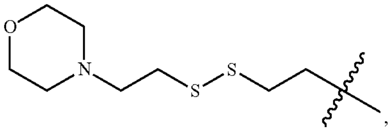,
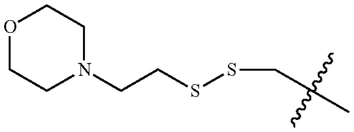
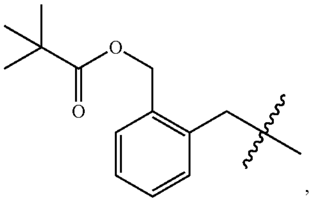,
-continued
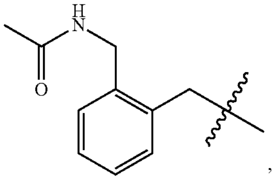, 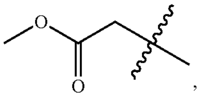,
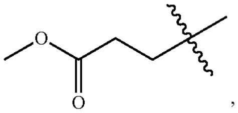,
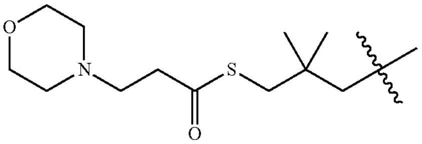,
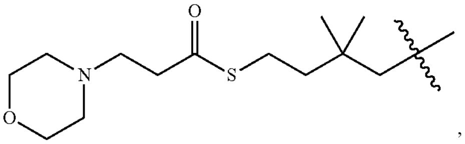,
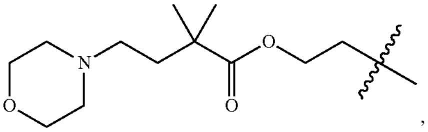,
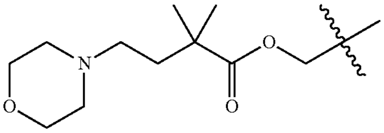,
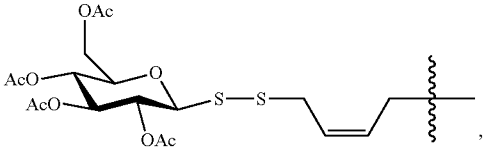,
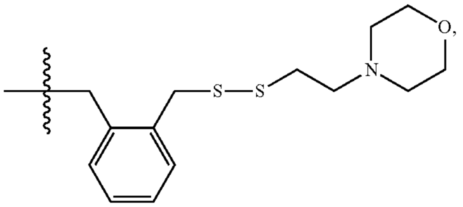
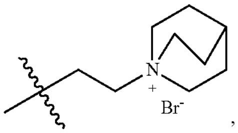, 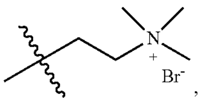,
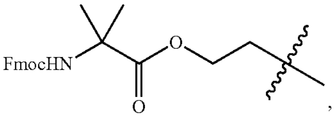,
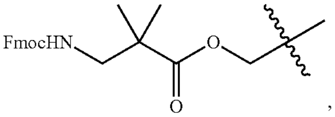,
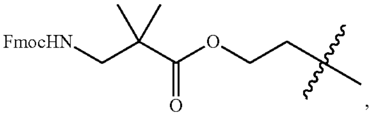, -continued
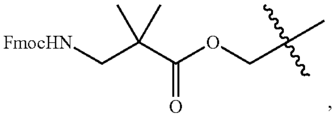
,
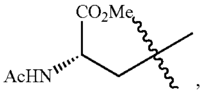
,
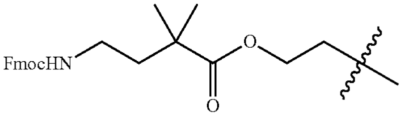
,
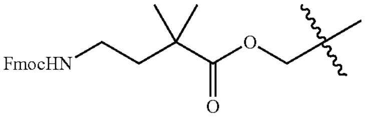
,
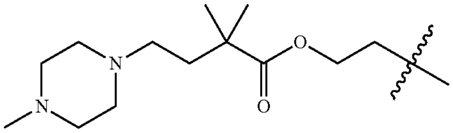
,
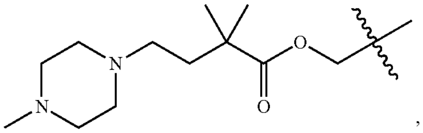
,
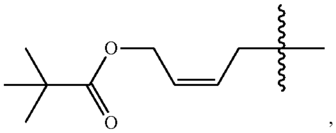
,
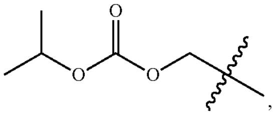
, $CH_3$—,
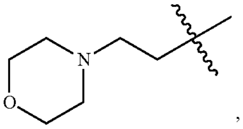
,
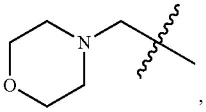
,
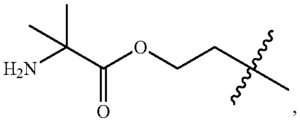
,
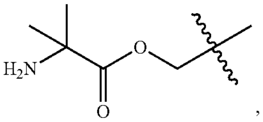
,
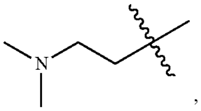
,
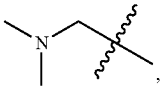
,
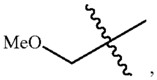
, or
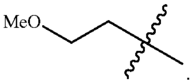
.
In some embodiments, -L-R[1] is:
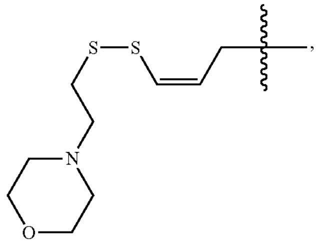
,
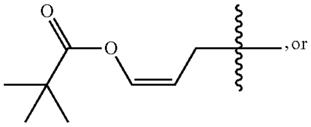
, or
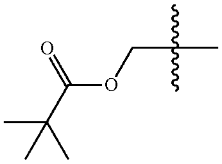
.
In some embodiments, -L-R[1] is $CH_3$—,
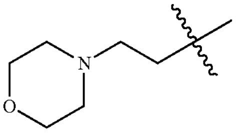
,
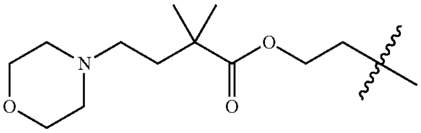
,
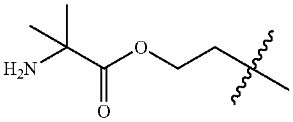
,
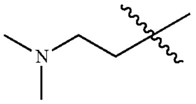
,
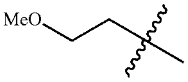
, or
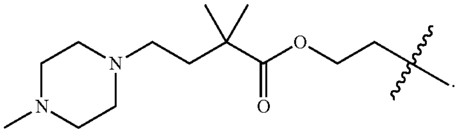
.
In some embodiments, -L-R[1] is
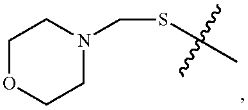
,
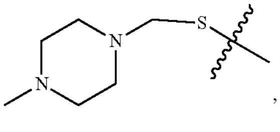
,
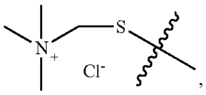
, -continued

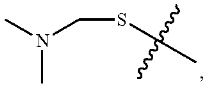
,
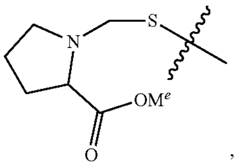
, or
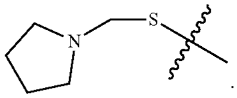
.

In some embodiments, -L-R[1] comprises a terminal optionally substituted —$(CH_2)_2$— moiety which is connected to X. In some embodiments, -L-R[1] comprises a terminal —$(CH_2)_2$— moiety which is connected to X. Examples of such-L-R[1] moieties are depicted below:

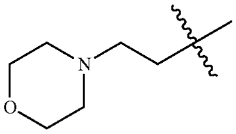
,
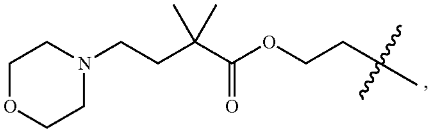
,
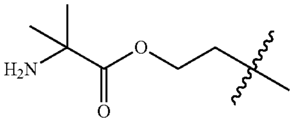
,
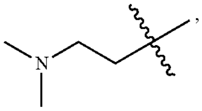
,
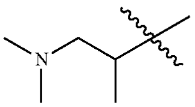
,
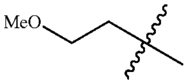
, and
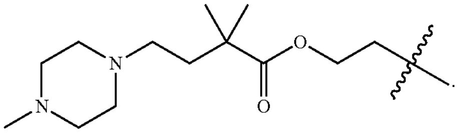
.

In some embodiments, -L-R[1] comprises a terminal optionally substituted —$(CH_2)$— moiety which is connected to X. In some embodiments, -L-R[1] comprises a terminal —$(CH_2)$— moiety which is connected to X. Examples of such -L-R[1] moieties are depicted below:

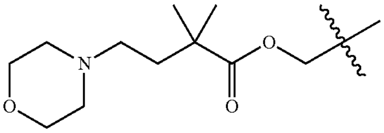
,
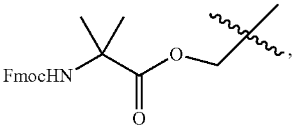
,
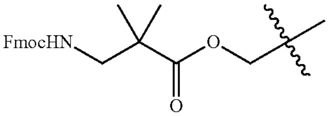
,
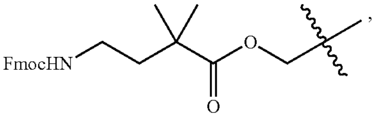
,
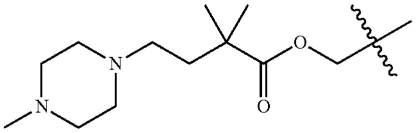
,
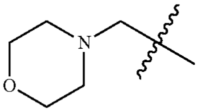
,
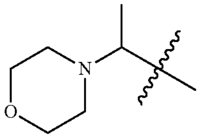
,
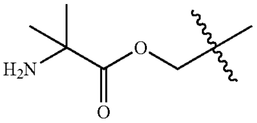
,
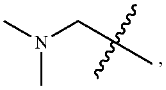
, and
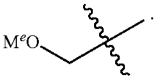
.

In some embodiments, -L-R[1] is

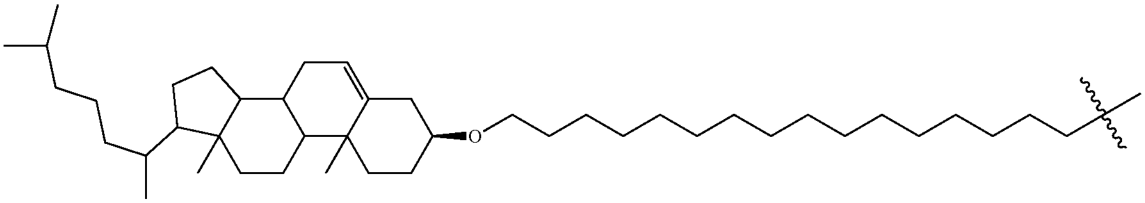
,
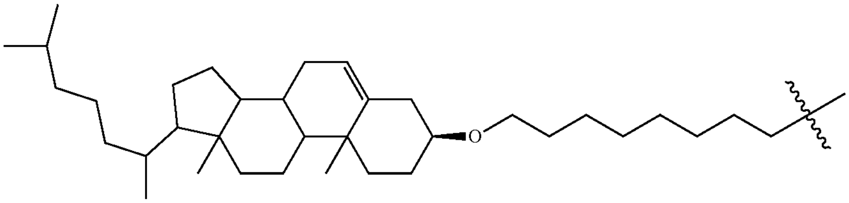
, or

-continued
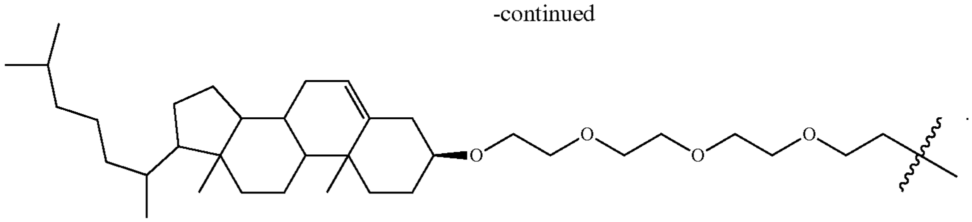
In some embodiments, -L-$R^1$ is $CH_3$—,
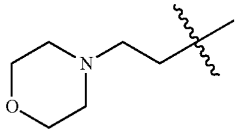,
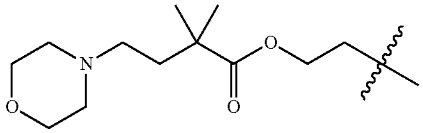,
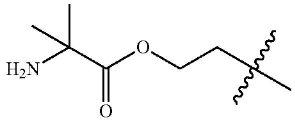, 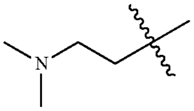,
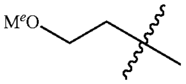, 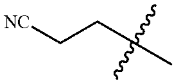, or
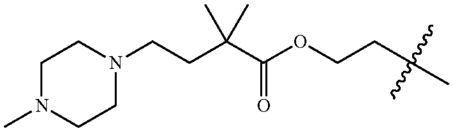;
and X is —S—.
In some embodiments, -L-$R^1$ is $CH_3$—,
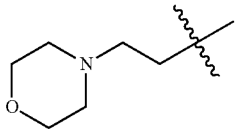,
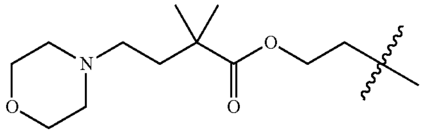,
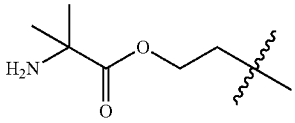, 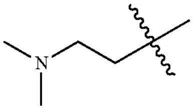,
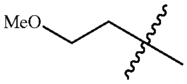, or
-continued
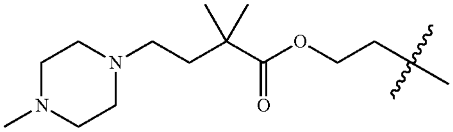,
X is —S—, Wis O, Y is —O—, and Z is —O—.
In some embodiments, $R^1$ is
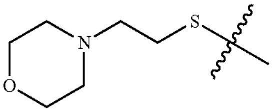,
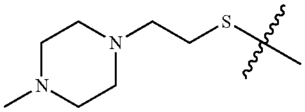,
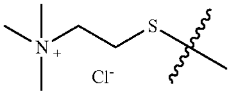, 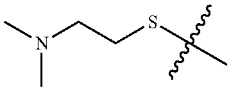,
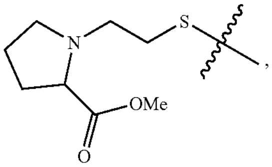,
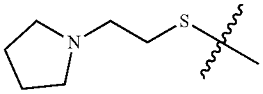, 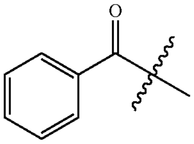,
or —S—($C_1$-$C_{10}$ aliphatic).
In some embodiments, $R^1$ is
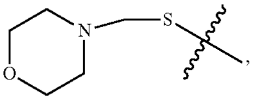,
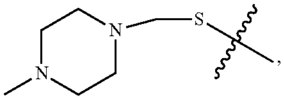,
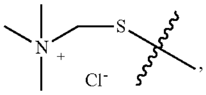, 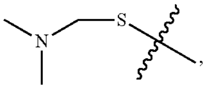, -continued
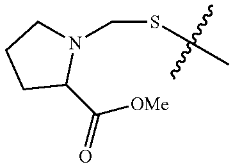
, or
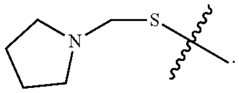
.
In some embodiments, X is —O— or —S—, and $R^1$ is
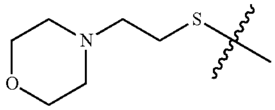
,
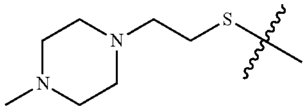
,
-continued
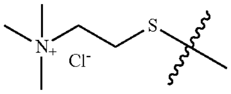
,
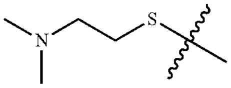
,
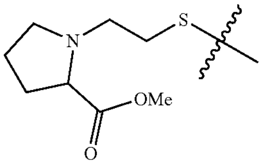
,
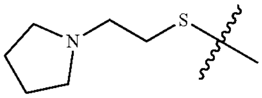
,
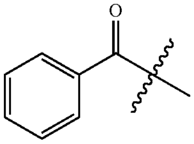
,
or —S—($C_1$-$C_{10}$ aliphatic).
In some embodiments, X is —O— or —S—, and $R^1$ is
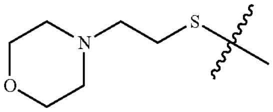
,
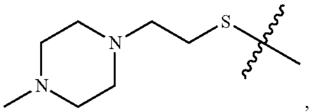
,
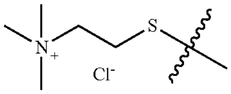
,
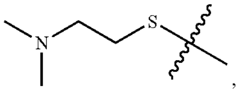
,
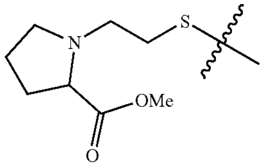
,
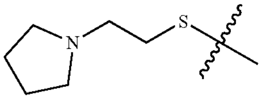
,
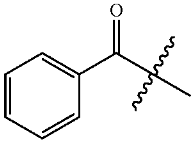
,
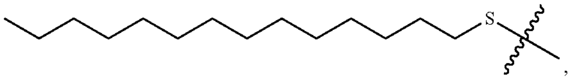
,
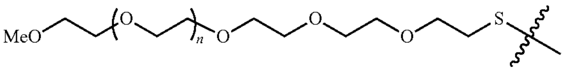
,
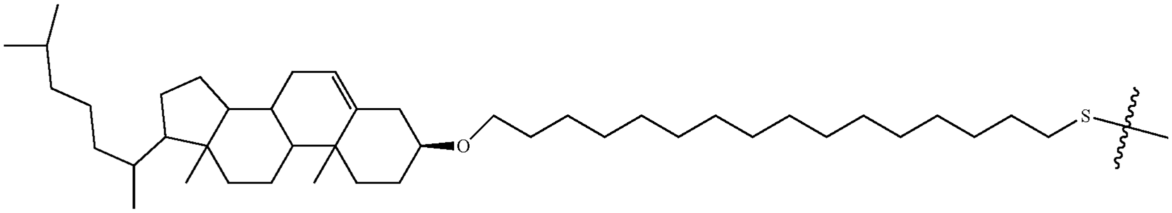
,
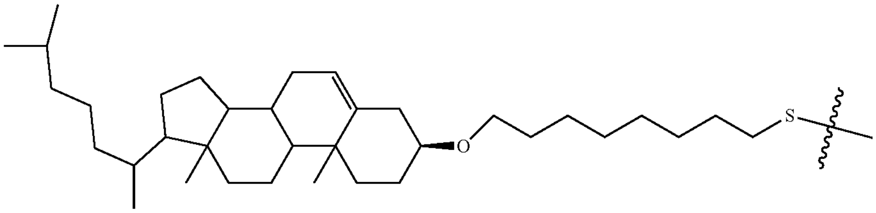
.

-continued
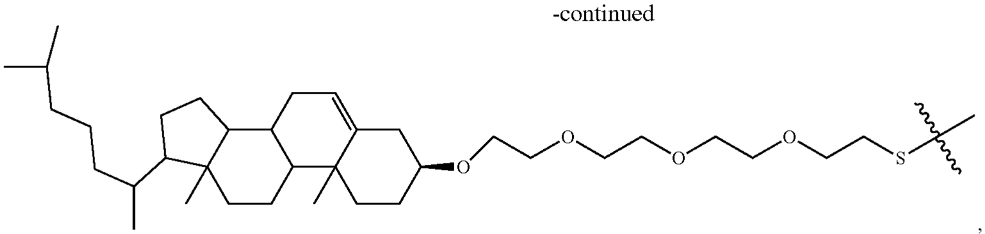
,
—S—($C_1$-$C_{10}$ aliphatic) or —S—($C_1$-$C_{50}$ aliphatic).
In some embodiments, L is a covalent bond and -L-$R^1$ is $R^1$.
In some embodiments, -L-$R^1$ is not hydrogen.
In some embodiments, —X-L-$R^1$ is $R^1$ is
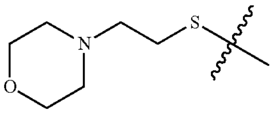
,
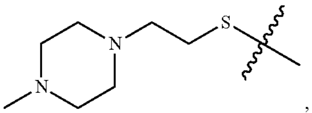
,
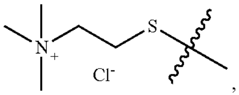
,
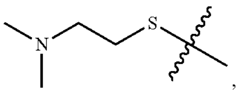
,
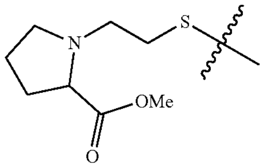
,
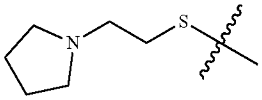
,
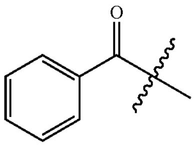
,
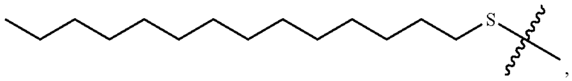
,
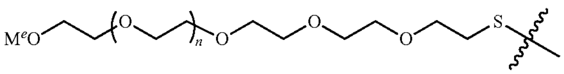
,
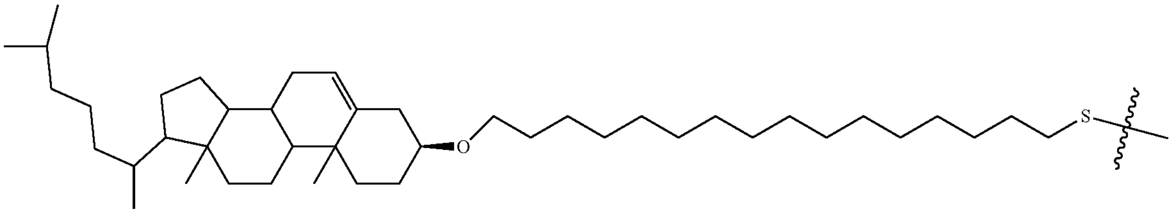
,
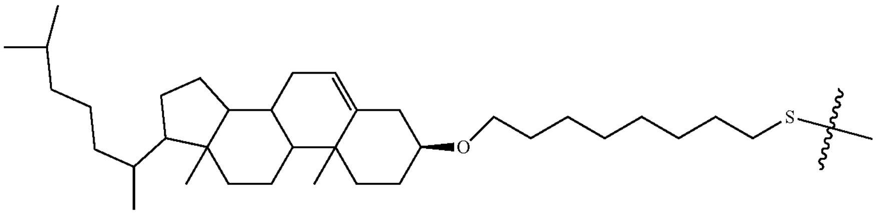
.
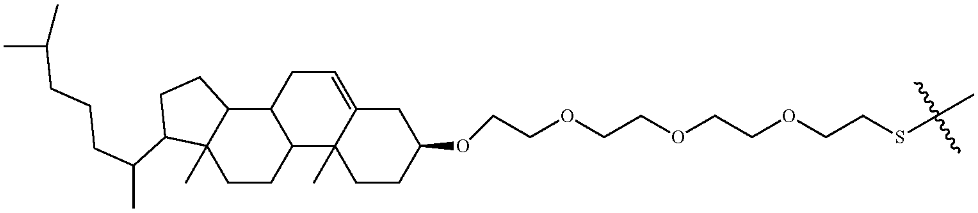
,
—S—($C_1$-$C_{10}$ aliphatic) or —S—($C_1$-$C_{50}$ aliphatic).

In some embodiments, —X-L-$R^1$ has the structure of

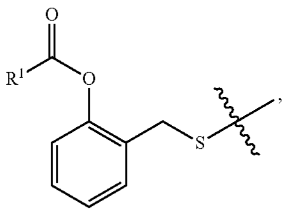

wherein the

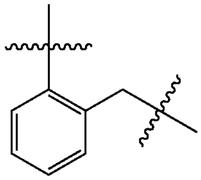 [SMILES: *Cc1ccccc1*]

moiety is optionally substituted. In some embodiments, —X-L-$R^1$ is

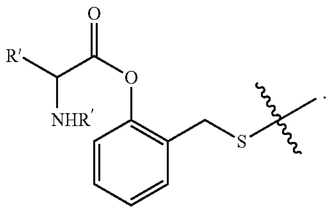

In some embodiments, —X-L-$R^1$ is

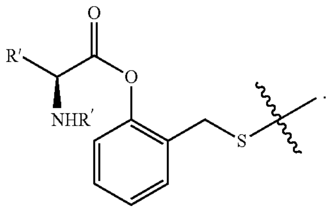

In some embodiments, —X-L-$R^1$ is

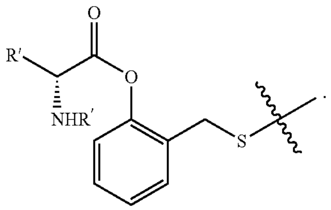

In some embodiments, —X-L-$R^1$ has the structure of

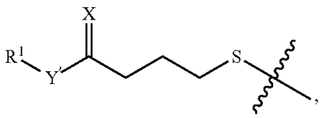

wherein X' is O or S, Y' is —O—, —S— or —NR'—, and the

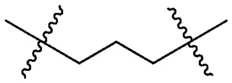 [SMILES: *CCC*]

moiety is optionally substituted. In some embodiments, Y' is —O—, —S— or —NH—. In some embodiments,

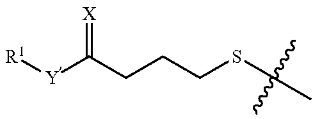

is

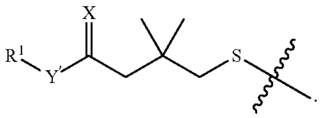

In some embodiments,

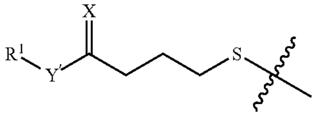

is

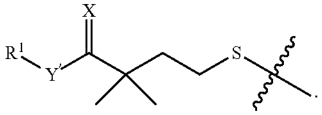

In some embodiments,

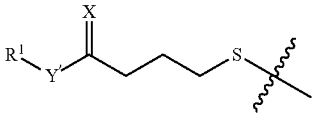

is

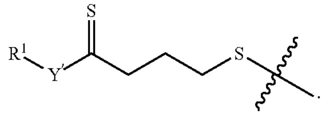.

In some embodiments, —X-L-$R^1$ has the structure of

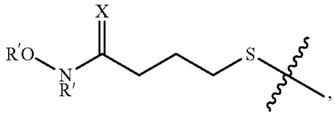, wherein X' is O or S, and the

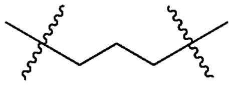 [SMILES: *CCC*]

moiety is optionally substituted. In some embodiments,

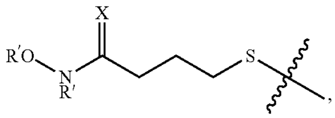, is

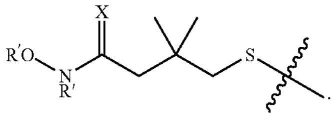.

In some embodiments, —X-L-$R^1$ is

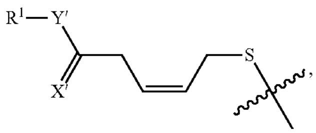, wherein the

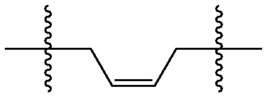 [SMILES: *C/C=C\C*]

is optionally substituted. In some embodiments, —X-L-$R^1$ is

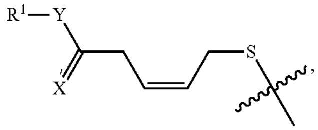, wherein the

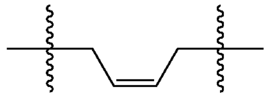 [SMILES: *C/C=C\C*]

is substituted. In some embodiments, —X-L-$R^1$ is

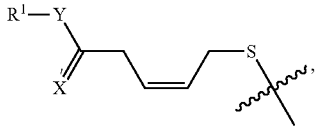, wherein the

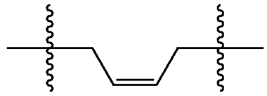

is unsubstituted.

In some embodiments, —X-L-$R^1$ is $R^1$—C(O)—S-$L^x$-S—, wherein $L^x$ is an optionally substituted group selected from

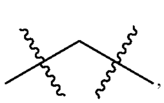, 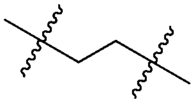,

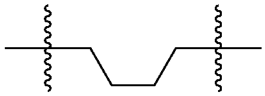,

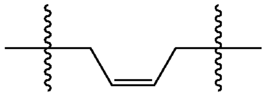 [SMILES: *C/C=C\C*], and

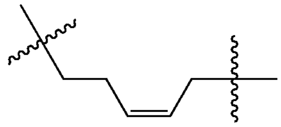.

In some embodiments, $L^x$ is

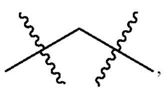, 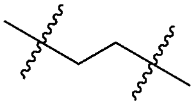,

-continued

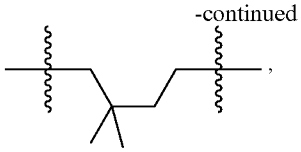

,

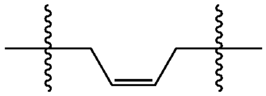

, and

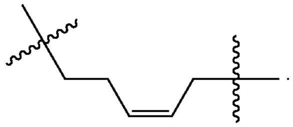

In some embodiments, —X-L-$R^1$ is $(CH_3)_3C$—S—S-$L^x$-S—. In some embodiments, —X-L-$R^1$ is $R^1$—C(═X')—Y'—$C(R)_2$—S-$L^x$-S—. In some embodiments, —X-L-$R^1$ is R—C(═X')—Y'—$CH_2$—S-$L^x$-S—. In some embodiments, —X-L-$R^1$ is

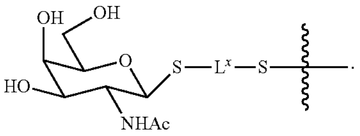

As will be appreciated by a person skilled in the art, many of the —X-L-$R^1$ groups described herein are cleavable and can be converted to —$X^-$ after administration to a subject. In some embodiments, —X-L-$R^1$ is cleavable. In some embodiments, —X-L-$R^1$ is —S-L-$R^1$, and is converted to —$S^-$ after administration to a subject. In some embodiments, the conversion is promoted by an enzyme of a subject. As appreciated by a person skilled in the art, methods of determining whether the —S-L-$R^1$ group is converted to —$S^-$ after administration is widely known and practiced in the art, including those used for studying drug metabolism and pharmacokinetics.

In some embodiments, the internucleotidic linkage having the structure of formula I is

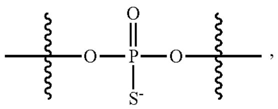

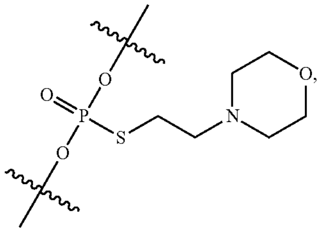

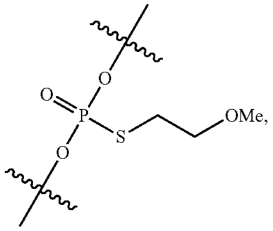

-continued

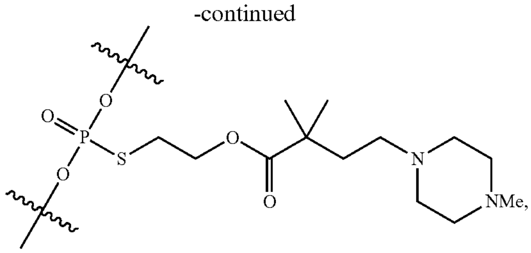

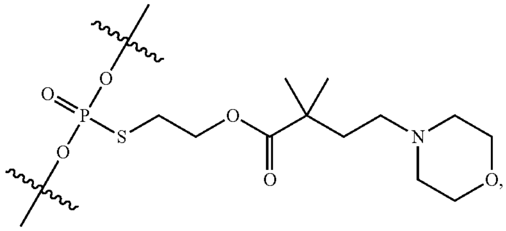

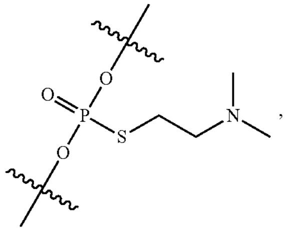

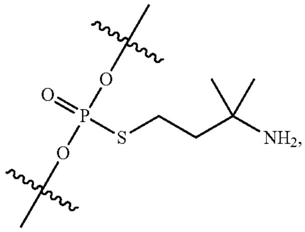

or

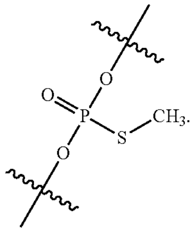

In some embodiments, the internucleotidic linkage of formula I has the structure of formula I-a:

(I-a)

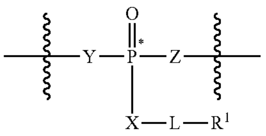

wherein each variable is independently as defined above and described herein.

In some embodiments, the internucleotidic linkage of formula I has the structure of formula I-b:

(I-b)

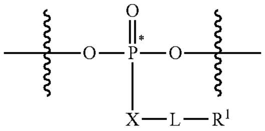

wherein each variable is independently as defined above and described herein.

In some embodiments, the internucleotidic linkage of formula I is an phosphorothioate triester linkage having the structure of formula I-c:

(I-c)

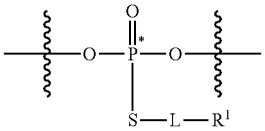

wherein $R^1$ is not —H when L is a covalent bond.

In some embodiments, the internucleotidic linkage having the structure of formula I is

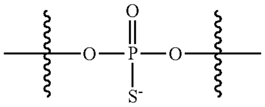
,

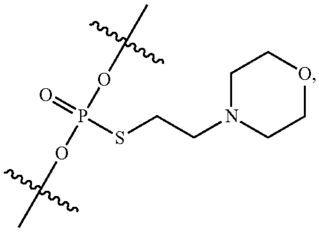

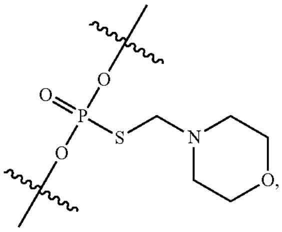

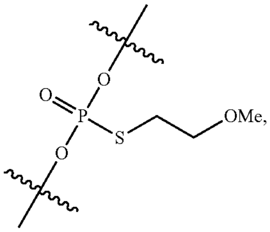

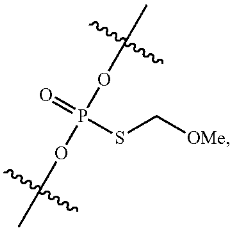

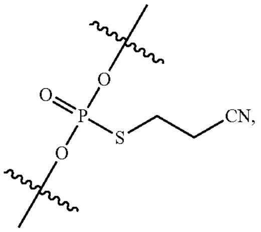

-continued

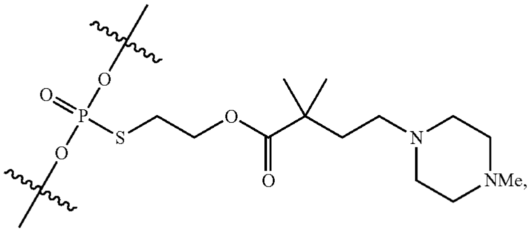

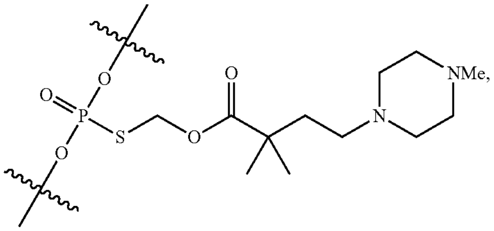

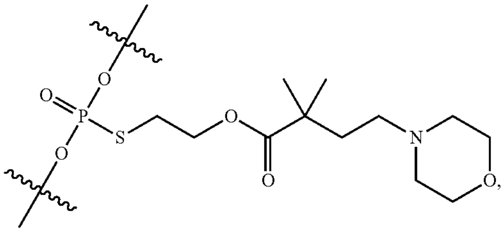

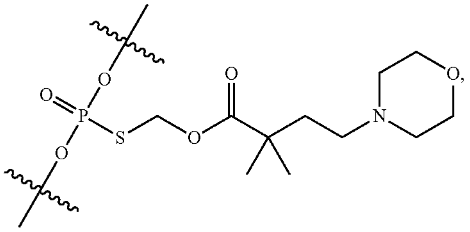

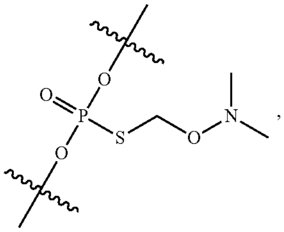

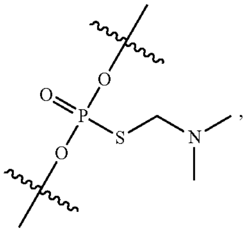

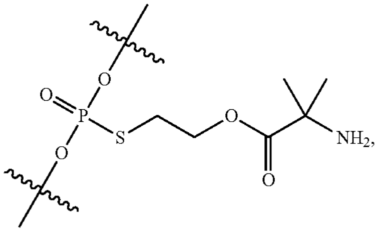

-continued
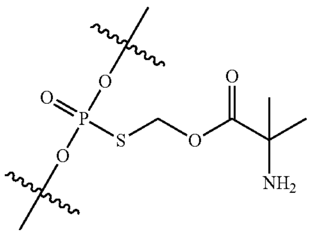
, or
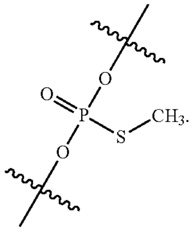
In some embodiments, the internucleotidic linkage having the structure of formula I-c is
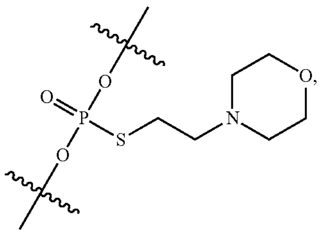
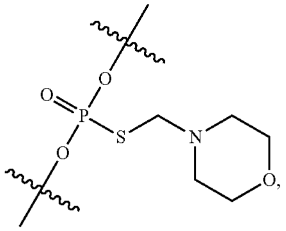
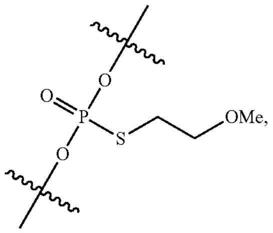
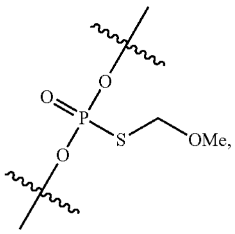
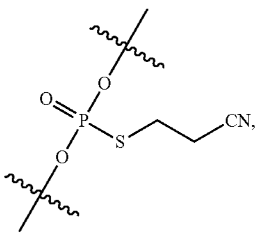
-continued
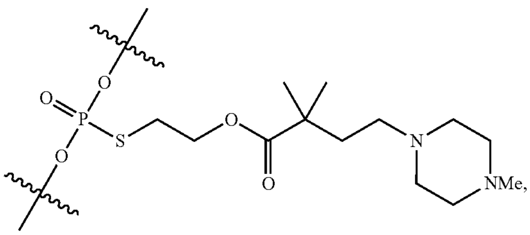
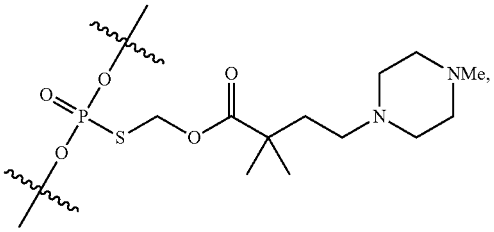
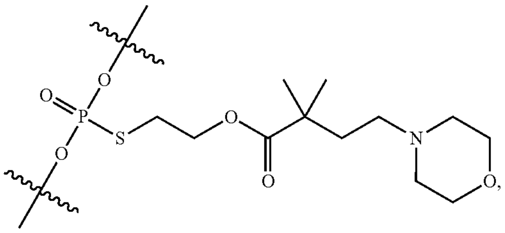
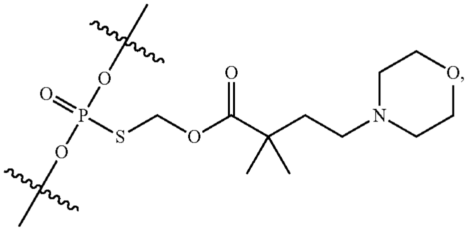
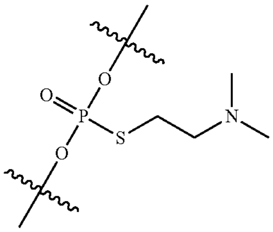
,
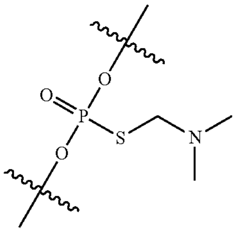
,
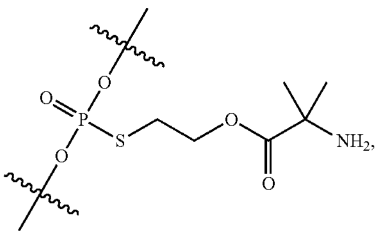
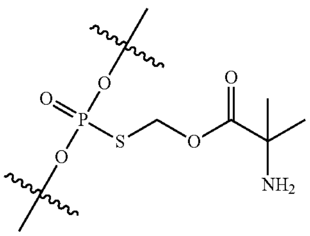
, or -continued

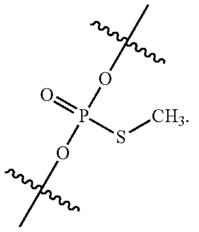

In some embodiments, the present disclosure provides a chirally controlled oligonucleotide comprising one or more natural phosphate linkages, and one or more modified internucleotidic linkages having the formula of I-a, I-b, or I-c.

In some embodiments, a modified internucleotidic linkage has the structure of I. In some embodiments, a modified internucleotidic linkage has the structure of I-a. In some embodiments, a modified internucleotidic linkage has the structure of I-b. In some embodiments, a modified internucleotidic linkage has the structure of I-c.

In some embodiments, a modified internucleotidic linkage is phosphorothioate internucleotidic linkage. Examples of internucleotidic linkages having the structure of formula I that can be utilized in accordance with the present disclosure include those described in U.S. Pat. Nos. 9,394,333, 9,744,183, 9,605,019, US20130178612, US20150211006, U.S. Pat. No. 9,598,458, US20170037399, WO 2017/015555, WO 2017/062862, the internucleotidic linkages of each of which is incorporated herein by reference.

Non-limiting examples of internucleotidic linkages that can be utilized in accordance with the present disclosure also include those described in the art, including, but not limited to, those described in any of: Gryaznov, S.; Chen, J.-K. J. Am. Chem. Soc. 1994, 116, 3143, Jones et al. J. Org. Chem. 1993, 58, 2983, Koshkin et al. 1998 Tetrahedron 54: 3607-3630, Lauritsen et al. 2002 Chem. Comm. 5: 530-531, Lauritsen et al. 2003 Bioo. Med. Chem. Lett. 13: 253-256, Mesmaeker et al. Angew. Chem., Int. Ed. Engl. 1994, 33, 226, Petersen et al. 2003 TRENDS Biotech. 21: 74-81, Schultz et al. 1996 Nucleic Acids Res. 24: 2966, Ts'o et al. Ann. N. Y. Acad. Sci. 1988, 507, 220, and Vasseur et al. J. Am. Chem. Soc. 1992, 114, 4006.

In some embodiments, oligonucleotides comprise one or more, e.g., 1, 2, 3, 4, 5, 6, 7, 8, 9, 10, 11, 12, 13, 14, 15, 16, 17, 18, 19, 20 or more non-negatively charged internucleotidic linkages. In some embodiments, a non-negatively charged internucleotidic linkage is not negatively charged in that at a given pH in an aqueous solution less than 50%, 40%, 40%, 30%, 20%, 10%, 5%, or 1% of the internucleotidic linkage exists in a negatively charged salt form. In some embodiments, a pH is about pH 7.4. In some embodiments, a pH is about 4-9. In some embodiments, the percentage is less than 10%. In some embodiments, the percentage is less than 5%. In some embodiments, the percentage is less than 1%. In some embodiments, an internucleotidic linkage is a non-negatively charged internucleotidic linkage in that the neutral form of the internucleotidic linkage has no pKa that is no more than about 1, 2, 3, 4, 5, 6, or 7 in water. In some embodiments, no pKa is 7 or less. In some embodiments, no pKa is 6 or less. In some embodiments, no pKa is 5 or less. In some embodiments, no pKa is 4 or less. In some embodiments, no pKa is 3 or less. In some embodiments, no pKa is 2 or less. In some embodiments, no pKa is 1 or less. In some embodiments, pKa of the neutral form of an internucleotidic linkage can be represented by pKa of the neutral form of a compound having the structure of $CH_3$—the internucleotidic linkage—$CH_3$. For example, pKa of the neutral form of an internucleotidic linkage having the structure of formula I may be represented by the pKa of the neutral form of a compound having the structure of

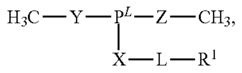

pKa of

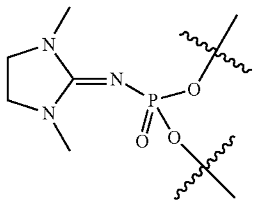

can be represented by pKa

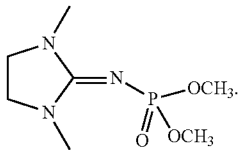

In some embodiments, a non-negatively charged internucleotidic linkage is a neutral internucleotidic linkage. In some embodiments, a non-negatively charged internucleotidic linkage is a positively-charged internucleotidic linkage. In some embodiments, a non-negatively charged internucleotidic linkage comprises a guanidine moiety. In some embodiments, a non-negatively charged internucleotidic linkage comprises a heteroaryl base moiety. In some embodiments, a non-negatively charged internucleotidic linkage comprises a triazole moiety. In some embodiments, a non-negatively charged internucleotidic linkage comprises an alkynyl moiety.

In some embodiments, a non-negatively charged internucleotidic linkage, e.g., a neutral internucleotidic linkage, comprises —$P^L$ (—N═)—, wherein $P^L$ is as described in the present disclosure. In some embodiments, a non-negatively charged internucleotidic linkage, e.g., a neutral internucleotidic linkage, comprises —P(—N═)—. In some embodiments, a non-negatively charged internucleotidic linkage, e.g., a neutral internucleotidic linkage, comprises —P(═)(—N═)—. In some embodiments, a non-negatively charged internucleotidic linkage, e.g., a neutral internucleotidic linkage, comprises —P(═O)(—N═)—. In some embodiments, a non-negatively charged internucleotidic linkage, e.g., a neutral internucleotidic linkage, comprises —P(═S)(—N═)—.

In some embodiments, a non-negatively charged internucleotidic linkage, e.g., a neutral internucleotidic linkage, comprises

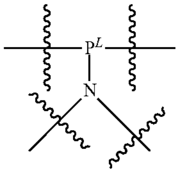,
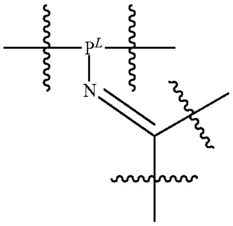,
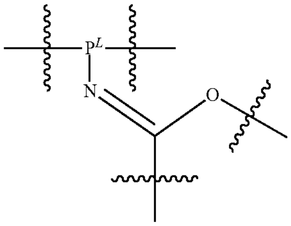,
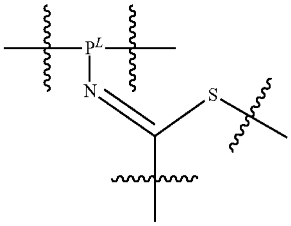,
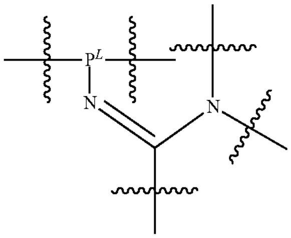,
-continued
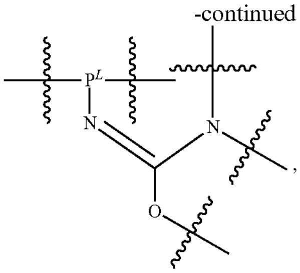,
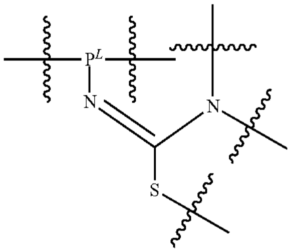, or
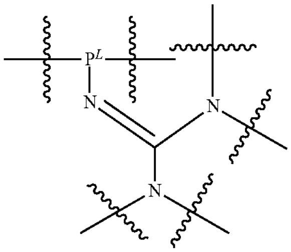,
wherein $P^L$ is as described in the present disclosure. For example, in some embodiments, $P^L$ is P; in some embodiments, $P^L$ is P(O); in some embodiments, $P^L$ is P(S); etc. In some embodiments, a non-negatively charged internucleotidic linkage, e.g., a neutral internucleotidic linkage, comprises
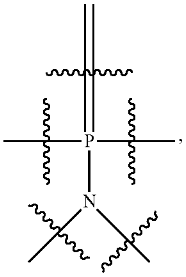,
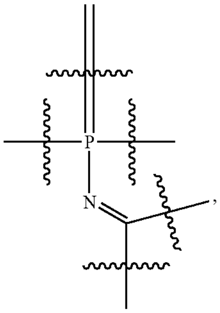,
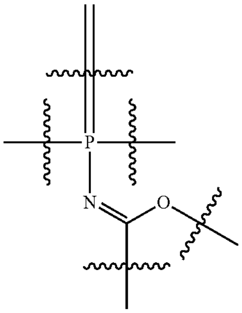,
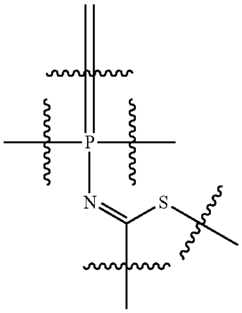,
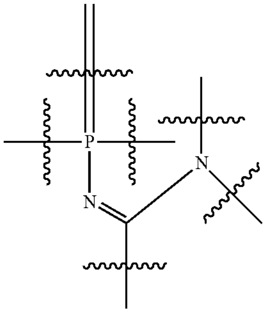,
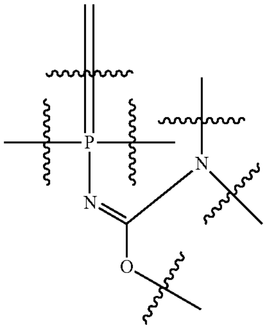,
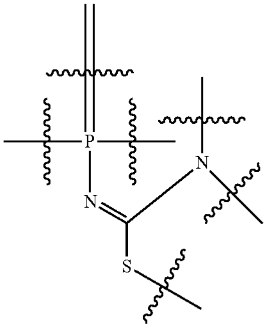, or -continued

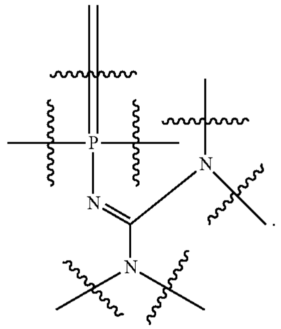

In some embodiments, a non-negatively charged internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof (not negatively charged). In some embodiments, an internucleotidic linkage, e.g., a non-negatively charged internucleotidic linkage, has the structure of formula I-n-1 or a salt form thereof:

I-n-1

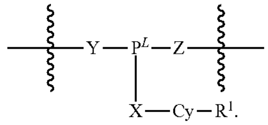

In some embodiments, X is a covalent bond and —X—Cy—$R^1$ is —Cy—$R^1$. In some embodiments, —Cy— is an optionally substituted bivalent group selected from a 5-20 membered heteroaryl ring having 1-10 heteroatoms, and a 3-20 membered heterocyclyl ring having 1-10 heteroatoms. In some embodiments, —Cy— is an optionally substituted bivalent 5-20 membered heteroaryl ring having 1-10 heteroatoms. In some embodiments, —Cy—$R^1$ is optionally substituted 5-20 membered heteroaryl ring having 1-10 heteroatoms, wherein at least one heteroatom is nitrogen. In some embodiments, —Cy—$R^1$ is optionally substituted 5-membered heteroaryl ring having 1-4 heteroatoms, wherein at least one heteroatom is nitrogen. In some embodiments, —Cy—$R^1$ is optionally substituted 6-membered heteroaryl ring having 1-4 heteroatoms, wherein at least one heteroatom is nitrogen. In some embodiments, —Cy—$R^1$ is optionally substituted triazolyl.

In some embodiments, an internucleotidic linkage, e.g., a non-negatively charged internucleotidic linkage, has the structure of formula I-n-2 or a salt form thereof:

I-n-2

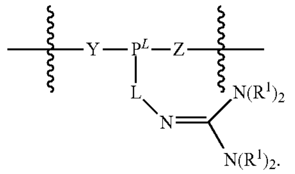

In some embodiments, $R^1$ is R'. In some embodiments, L is a covalent bond. In some embodiments, an internucleotidic linkage, e.g., a non-negatively charged internucleotidic linkage, has the structure of formula I-n-3 or a salt form thereof:

I-n-3

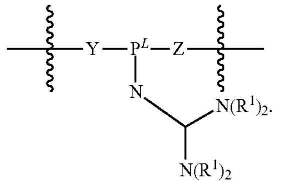

In some embodiments, two R' on different nitrogen atoms are taken together to form a ring as described. In some embodiments, a formed ring is 5-membered. In some embodiments, a formed ring is 6-membered. In some embodiments, a formed ring is substituted. In some embodiments, the two R' group that are not taken together to form a ring are each independently R. In some embodiments, the two R' group that are not taken together to form a ring are each independently hydrogen or an optionally substituted $C_{1-6}$ aliphatic. In some embodiments, the two R' group that are not taken together to form a ring are each independently hydrogen or an optionally substituted $C_{1-6}$ alkyl. In some embodiments, the two R' group that are not taken together to form a ring are the same. In some embodiments, the two R' group that are not taken together to form a ring are different. In some embodiments, both of them are —$CH_3$.

In some embodiments, an internucleotidic linkage, e.g., a non-negatively charged internucleotidic linkage, has the structure of formula I-n-4 or a salt form thereof:

I-n-4

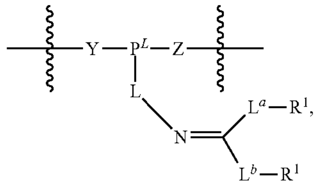

wherein each of $L^a$ and $L^b$ is independently L or —$N(R^1)$—, and each other variable is independently as described in the present disclosure. In some embodiments, L is a covalent bond, and an internucleotidic linkage of formula I-n-4 has the structure of:

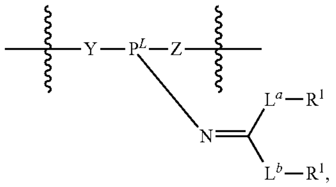

or a salt form thereof, wherein each variable is independently as described in the present disclosure.

In some embodiments, $L^a$ is —N($R^1$)—. In some embodiments, $L^a$ is L as described in the present disclosure. In some embodiments, $L^a$ is a covalent bond. In some embodiments, $L^a$ is —N(R')—. In some embodiments, $L^a$ is —N(R)—. In some embodiments, $L^a$ is —O—. In some embodiments, $L^a$ is —S—. In some embodiments, $L^a$ is —S(O)—. In some embodiments, $L^a$ is —$S(O)_2$—. In some embodiments, $L^a$ is —$S(O)_2N(R')$—. In some embodiments, $L^b$ is —N($R^1$)—. In some embodiments, $L^b$ is L as described in the present disclosure. In some embodiments, $L^b$ is a covalent bond. In some embodiments, $L^b$ is —N(R')—. In some embodiments, $L^b$ is —N(R)—. In some embodiments, $L^b$ is —O—. In some embodiments, $L^b$ is —S—. In some embodiments, $L^b$ is —S(O)—. In some embodiments, $L^b$ is —$S(O)_2$—. In some embodiments, $L^b$ is —$S(O)_2N(R')$—. In some embodiments, $L^a$ and $L^b$ are the same. In some embodiments, $L^a$ and $L^b$ are different. In some embodiments, at least one of $L^a$ and $L^b$ is —N($R^1$)—. In some embodiments, at least one of $L^a$ and $L^b$ is —O—. In some embodiments, at least one of $L^a$ and $L^b$ is —S—. In some embodiments, at least one of $L^a$ and $L^b$ is a covalent bond. In some embodiments, as described herein, $R^1$ is R. In some embodiments, $R^1$ is —H. In some embodiments, $R^1$ is optionally substituted $C_{1-10}$ aliphatic. In some embodiments, $R^1$ is optionally substituted $C_{1-10}$ alkyl. In some embodiments, a structure of formula I-n-4 is a structure of formula I-n-2. In some embodiments, a structure of formula I-n-4 is a structure of formula I-n-3. In some embodiments, a non-negatively charged internucleotidic linkage, e.g., a neutral internucleotidic linkage, has the structure of formula I. In some embodiments, X, e.g., in formula I, II, etc., is —N(-L-$R^5$)—, wherein $R^5$ is R as described herein. In some embodiments, X is —NH—. In some embodiments, L, e.g., in —X-L- of formula I, II, etc., comprises —$SO_2$—. In some embodiments, L is —$SO_2$—. In some embodiments, L is a covalent bond. In some embodiments, L is —C(O)O—($C_{1-4}$ alkylene)- wherein the alkylene is optionally substituted. In some embodiments, L is —C(O) $OCH_2$—. In some embodiments, $R^1$, e.g., in formula I, III, etc., comprise an optionally substituted ring. In some embodiments, $R^1$ is R as described herein. In some embodiments, $R^1$ is optionally substituted phenyl. In some embodiments, $R^1$ is 4-methylphenyl. In some embodiments, $R^1$ is 4-methoxyphenyl. In some embodiments, $R^1$ is 4-aminophenyl. In some embodiments, $R^1$ is an optionally substituted heteroaliphatic ring. In some embodiments, $R^1$ is an optionally substituted 3-10 (e.g., 3, 4, 5, 6, 7, or 8) membered heteroaliphatic ring. In some embodiments, $R^1$ is an optionally substituted 5- or 6-membered saturated monocyclic heteroaliphatic ring having 1-3 heteroatoms. In some embodiments, the ring is 5-membered. In some embodiments, the ring is 6-membered. In some embodiments, the number of ring heteroatom(s) is 1. In some embodiments, the number of ring heteroatoms is 2. In some embodiments, a heteroatom is oxygen. In some embodiments, $R^1$ is optionally substituted

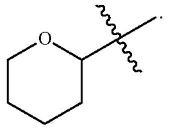 [SMILES: *C1CCCCO1]

In some embodiments, $R^1$ is optionally substituted

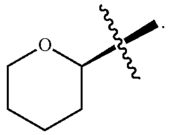

In some embodiments, $R^1$ is

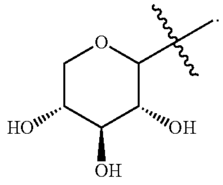 [SMILES: *C1OC[C@@H](O)[C@H](O)[C@H]1O]

In some embodiments, $R^1$ is optionally substituted $C_{1-30}$ aliphatic. In some embodiments, $R^1$ is optionally substituted $C_{1-10}$ alkyl.

In some embodiments, an internucleotidic linkage, e.g., a non-negatively charged internucleotidic linkage, has the structure of formula II or a salt form thereof:

II

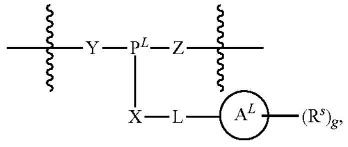

or a salt form thereof, wherein:

$P^L$ is P(=W), P, or P→B(R')$_3$;

W is O, N(-L-$R^5$), S or Se;

each of X, Y and Z is independently —O—, —S—, —N(-L-$R^5$)—, or L;

$R^5$ is —H, -L-R', halogen, —CN, —$NO_2$, -L-Si(R')$_3$, —OR', —SR', or —N(R')$_2$;

Ring $A^L$ is an optionally substituted 3-20 membered monocyclic, bicyclic or polycyclic ring having 0-10 heteroatoms;

each $R^s$ is independently —H, halogen, —CN, —$N_3$, —NO, —$NO_2$, -L-R', -L-Si(R)$_3$, -L-OR', -L-SR', -L-N(R')$_2$, —O-L-R', —O-L-Si(R)$_3$, —O-L-OR', —O-L-SR', or —O-L-N(R')$_2$;

g is 0-20;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, $—S(O)_2—$, $—S(O)_2N(R')—$, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, $—P(OR')[B(R')_3]—$, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or $—OP(OR')[B(R')_3]O—$, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each R' is independently —R, —C(O)R, —C(O)OR, or $—S(O)_2R$;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or, two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

In some embodiments, Ring $A^L$ in various structures of the present disclosure is an optionally substituted aryl ring. In some embodiments, Ring $A^L$ is an optionally substituted phenyl ring. In some embodiments, Ring $A^L$ is an optionally substituted 3-10 (e.g., 3, 4, 5, 6, 7, or 8) membered heteroaliphatic ring. In some embodiments, Ring $A^L$ is an optionally substituted 5- or 6-membered saturated monocyclic heteroaliphatic ring having 1-3 heteroatoms. In some embodiments, the ring is 5-membered. In some embodiments, the ring is 6-membered. In some embodiments, the number of ring heteroatom(s) is 1. In some embodiments, the number of ring heteroatoms is 2. In some embodiments, a heteroatom is oxygen. In some embodiments, $R^s$ is optionally substituted $C_1$-$C_6$ alkyl group. In some embodiments, $R^s$ is Me. In some embodiments, $R^s$ is OR, wherein R is hydrogen or $C_1$-$C_6$ alkyl group. In some embodiments, $R^s$ is OH. In some embodiments, $R^s$ is OMe. In some embodiments, $R^s$ is $—N(R')_2$. In some embodiments, $R^s$ is $—NH_2$. In some embodiments,

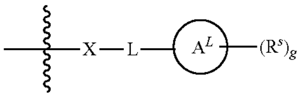

is

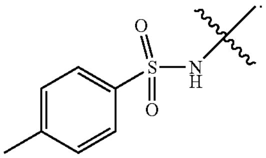 [SMILES: *NS(=O)(=O)c1ccc(C)cc1]

In some embodiments,

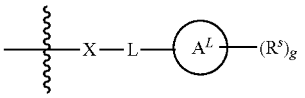

is

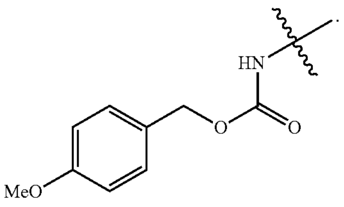 [SMILES: *NC(=O)OCc1ccc(OC)cc1]

In some embodiments,

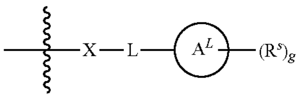

is

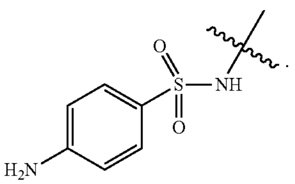 [SMILES: *NS(=O)(=O)c1ccc(N)cc1]

In some embodiments,

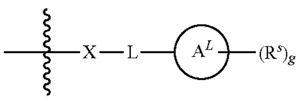

is

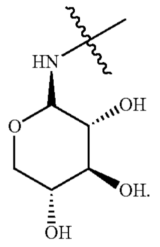

In some embodiments, an internucleotidic linkage, e.g. a neutral internucleotidic linkage of formula I or II, is n002

(

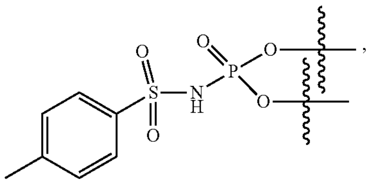

which, as one skilled in the art will appreciate, can exist under certain conditions in the form of

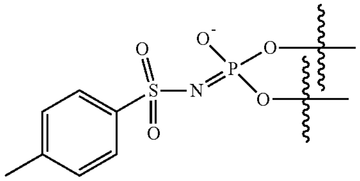

).

In some embodiments, an internucleotidic linkage, e.g. a neutral internucleotidic linkage of formula I or II, is n005 (

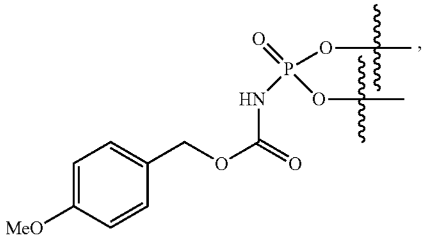

which, as one skilled in the art will appreciate, can exist under certain conditions in the form of

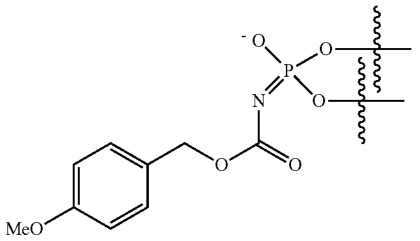

).

In some embodiments, an internucleotidic linkage, e.g. a neutral internucleotidic linkage of formula I or II, is n006

(

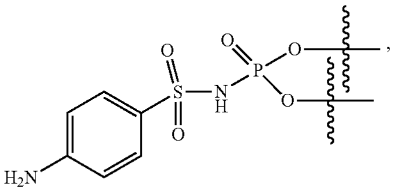

which, as one skilled in the art will appreciate, can exist under certain conditions in the form of

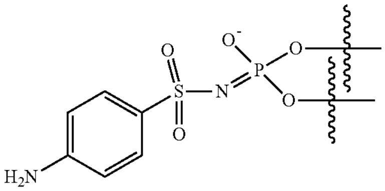

).

In some embodiments, an internucleotidic linkage, e.g. a neutral internucleotidic linkage of formula I or II, is n007

(

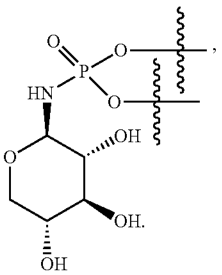

which, as one skilled in the art will appreciate, can exist under certain conditions in a form of

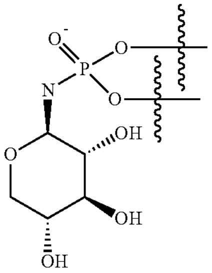

).

In some embodiments, an internucleotidic linkage, e.g., a non-negatively charged internucleotidic linkage of formula II, has the structure of formula II-a-1 or a salt form thereof:

II-a-1

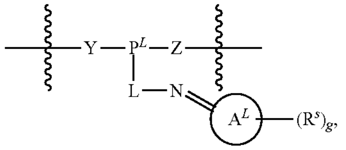

or a salt form thereof.

In some embodiments, an internucleotidic linkage, e.g., a non-negatively charged internucleotidic linkage of formula II, has the structure of formula II-a-2 or a salt form thereof:

II-a-2

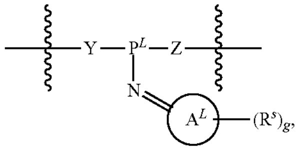

or a salt form thereof.

In some embodiments, $A^L$ is bonded to —N= or L through a carbon atom. In some embodiments, an internucleotidic linkage, e.g., a non-negatively charged internucleotidic linkage of formula II or II-a-1, II-a-2, has the structure of formula II-b-1 or a salt form thereof:

II-b-1

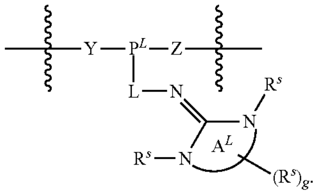

In some embodiments, a structure of formula II-a-1 or II-a-2 may be referred to a structure of formula II-a. In some embodiments, a structure of formula II-b-1 or II-b-2 may be referred to a structure of formula II-b. In some embodiments, a structure of formula II-c-1 or II-c-2 may be referred to a structure of formula II-c. In some embodiments, a structure of formula II-d-1 or II-d-2 may be referred to a structure of formula II-d.

In some embodiments, $A^L$ is bonded to —N= or L through a carbon atom. In some embodiments, an internucleotidic linkage, e.g., a non-negatively charged internucleotidic linkage of formula II or II-a-1, II-a-2, has the structure of formula II-b-2 or a salt form thereof:

II-b-2

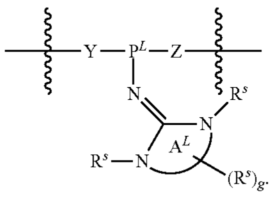

In some embodiments, Ring $A^L$ is an optionally substituted 3-20 membered monocyclic ring having 0-10 heteroatoms (in addition to the two nitrogen atoms for formula II-b). In some embodiments, Ring $A^L$ is an optionally substituted 5-membered monocyclic saturated ring.

In some embodiments, an internucleotidic linkage, e.g., a non-negatively charged internucleotidic linkage of formula II, II-a, or II-b, has the structure of formula II-c-1 or a salt form thereof:

II-c-1

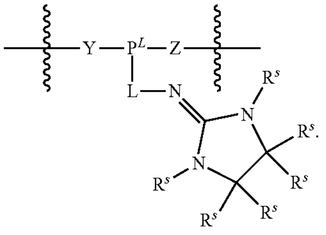

In some embodiments, an internucleotidic linkage, e.g., a non-negatively charged internucleotidic linkage of formula II, II-a, or II-b, has the structure of formula II-c-2 or a salt form thereof:

II-c-2

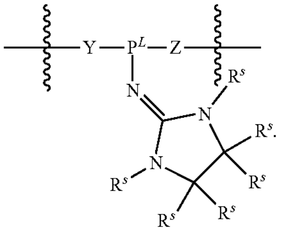

In some embodiments, an internucleotidic linkage, e.g., a non-negatively charged internucleotidic linkage of formula II, II-a, II-b, or II-c has the structure of formula II-d-1 or a salt form thereof:

II-d-1

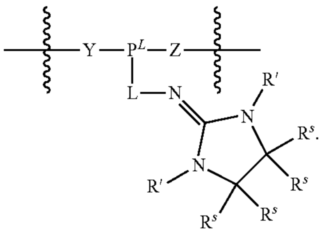

In some embodiments, an internucleotidic linkage, e.g., a non-negatively charged internucleotidic linkage of formula II, II-a, II-b, or II-c has the structure of formula II-d-2 or a salt form thereof:

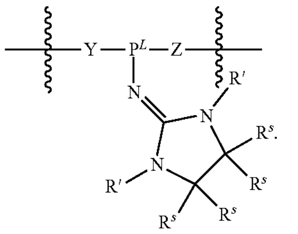

II-d-2

In some embodiments, each R' is independently optionally substituted $C_{1-6}$ aliphatic. In some embodiments, each R' is independently optionally substituted $C_{1-6}$ alkyl. In some embodiments, each R' is independently —$CH_3$. In some embodiments, each $R^s$ is —H.

In some embodiments, a non-negatively charged internucleotidic linkage has the structure of

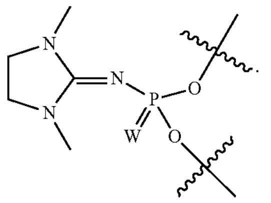

In some embodiments, a non-negatively charged internucleotidic linkage has the structure of

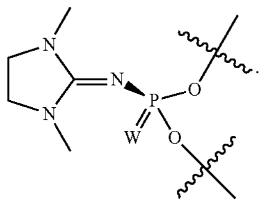

In some embodiments, a non-negatively charged internucleotidic linkage has the structure of

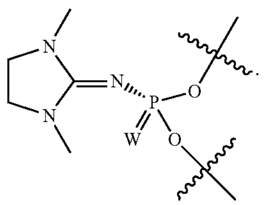

In some embodiments, a non-negatively charged internucleotidic linkage has the structure of

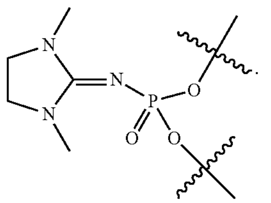

In some embodiments, a non-negatively charged internucleotidic linkage has the structure of

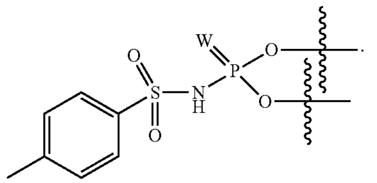

In some embodiments, a non-negatively charged internucleotidic linkage has the structure of

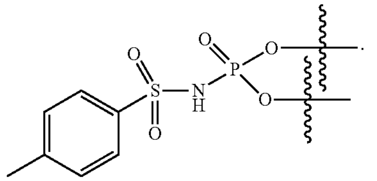

In some embodiments, a non-negatively charged internucleotidic linkage has the structure of

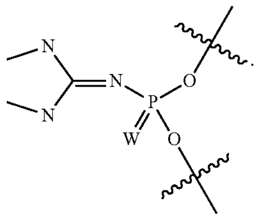

In some embodiments, a non-negatively charged internucleotidic linkage has the structure of

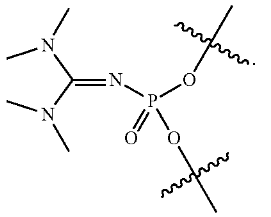

In some embodiments, a non-negatively charged internucleotidic linkage has the structure of

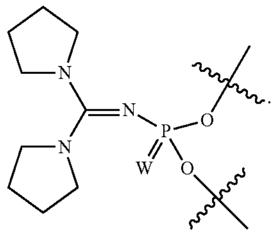

In some embodiments, a non-negatively charged internucleotidic linkage has the structure of

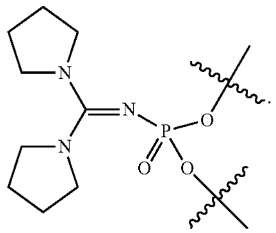

In some embodiments, a non-negatively charged internucleotidic linkage has the structure of

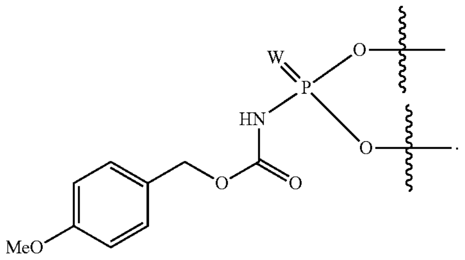

In some embodiments, a non-negatively charged internucleotidic linkage has the structure of

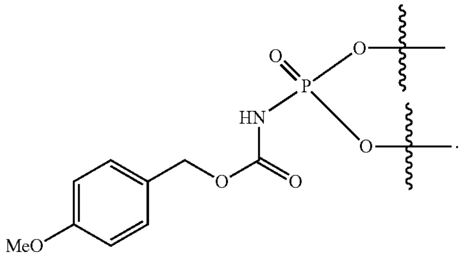

In some embodiments, a non-negatively charged internucleotidic linkage has the structure of

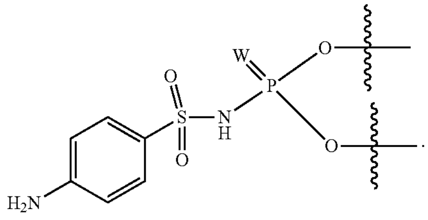

In some embodiments, a non-negatively charged internucleotidic linkage has the structure of

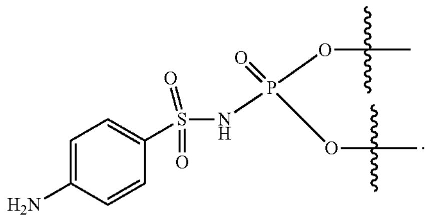

In some embodiments, a non-negatively charged internucleotidic linkage has the structure of

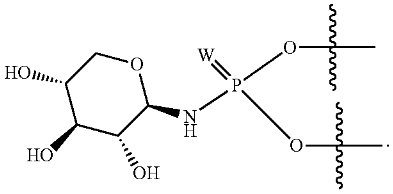

In some embodiments, a non-negatively charged internucleotidic linkage has the structure of

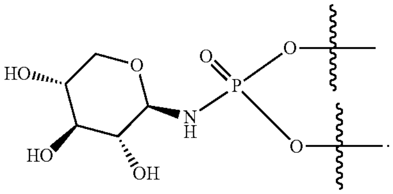

In some embodiments, a non-negatively charged internucleotidic linkage has the structure of

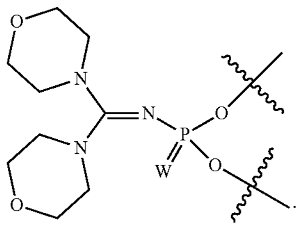

In some embodiments, a non-negatively charged internucleotidic linkage has the structure of

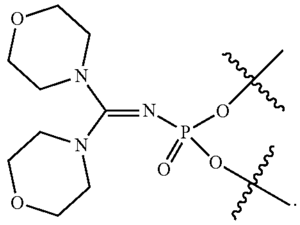

In some embodiments, a non-negatively charged internucleotidic linkage has the structure of

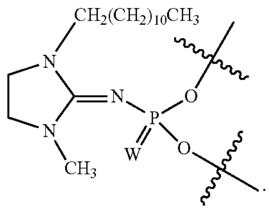

embodiments, a non-negatively charged internucleotidic linkage has the structure of

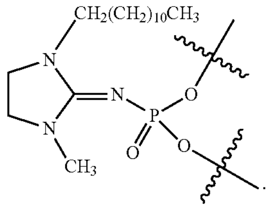

In some embodiments, a non-negatively charged internucleotidic linkage has the structure of

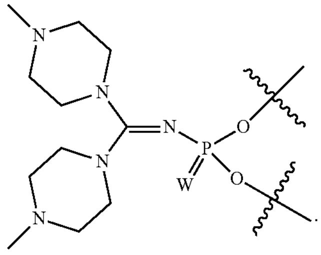

In some embodiments, a non-negatively charged internucleotidic linkage has the structure of

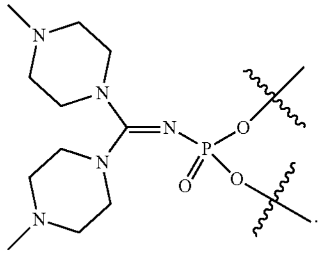

In some embodiments, a non-negatively charged internucleotidic linkage has the structure of

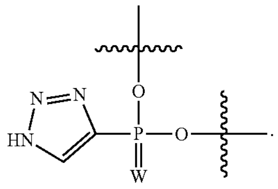

In some embodiments, a non-negatively charged internucleotidic linkage has the structure of

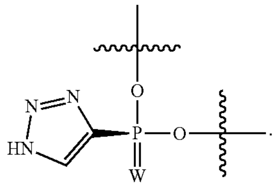

In some embodiments, a non-negatively charged internucleotidic linkage has the structure of

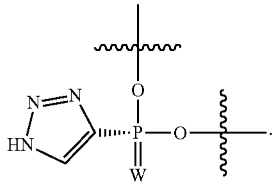

In some embodiments, a non-negatively charged internucleotidic linkage has the structure of

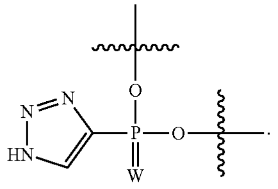

In some embodiments, a non-negatively charged internucleotidic linkage has the structure of

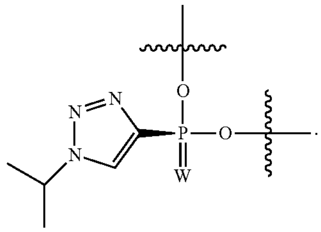

In some embodiments, a non-negatively charged internucleotidic linkage has the structure of

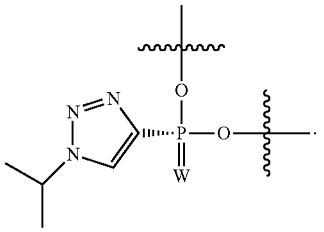

In some embodiments, a non-negatively charged internucleotidic linkage has the structure of

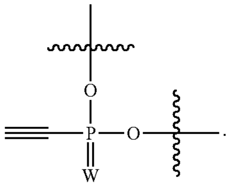

In some embodiments, a non-negatively charged internucleotidic linkage has the structure of

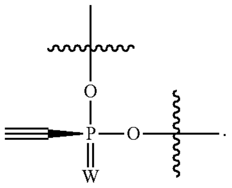

In some embodiments, a non-negatively charged internucleotidic linkage has the structure of

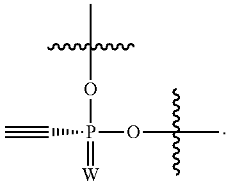

In some embodiments, W is O. In some embodiments, W is S. In some embodiments, a non-negatively charged internucleotidic linkage is chirally controlled. In some embodiments, the linkage phosphorus is Rp. In some embodiments, the linkage phosphorus is Sp.

In some embodiments, each non-negatively charged internucleotidic linkage or neutral internucleotidic linkage (e.g., those of formula I-n-1, I-n-2, I-n-3, I-n-4, II, II-a-1, II-a-2, II-b-1, II-b-2, II-c-1, II-c-2, II-d-1, or II-d-2) is independently Rp at its linkage phosphorus. In some embodiments, each negatively charged chiral internucleotidic linkage is Sp at its linkage phosphorus. In some embodiments, each phosphorothioate internucleotidic linkages is Sp at its linkage phosphorus. In some embodiments, each natural phosphate linkage is independently bonded to a sugar comprising a 2'-OR modification, wherein R is not —H. In some embodiments, each natural phosphate linkage is independently bonded to a sugar comprising a 2'-OR modification, wherein R is not —H, at a 3'-position. In some embodiments, each sugar that contains no 2'-OR modification wherein R is not —H is independently bonded to at least one non-natural phosphate linkages, in many cases, two non-natural natural phosphate linkages. In some embodiments, each 2'-F modified sugar is independently bonded to at least one non-natural phosphate linkages, in many cases, two non-natural natural phosphate linkages. In some embodiments, each non-natural phosphate linkage is a phosphorothioate internucleotidic linkage. In some embodiments, each non-natural phosphate linkage is a Sp phosphorothioate internucleotidic linkage. In some embodiments, each sugar bonded to non-negatively charged internucleotidic linkage or neutral internucleotidic linkage (e.g., those of formula I-n-1, I-n-2, I-n-3, I-n-4, II, II-a-1, II-a-2, II-b-1, II-b-2, II-c-1, II-c-2, II-d-1, or II-d-2) independently contains no 2'-OR. In some embodiments, each sugar bonded to non-negatively charged internucleotidic linkage or neutral internucleotidic linkage (e.g., those of formula I-n-1, I-n-2, I-n-3, I-n-4, II, II-a-1, II-a-2, II-b-1, II-b-2, II-c-1, II-c-2, II-d-1, or II-d-2) is a 2'-F modified sugar.

In some embodiments, the present disclosure provides a compound, e.g., an oligonucleotide, a chirally controlled oligonucleotide, an oligonucleotide of a provided composition (e.g., of a plurality of oligonucleotides), having the structure of formula O-I:

O-I

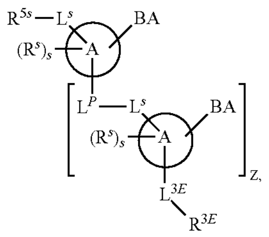

or a salt thereof, wherein:

$R^{5s}$ is independently R' or —OR';

each BA is independently an optionally substituted group selected from $C_{3-30}$ cycloaliphatic, $C_{6-30}$ aryl, $C_{5-30}$ heteroaryl having 1-10 heteroatoms, $C_{3-30}$ heterocyclyl having 1-10 heteroatoms, a natural nucleobase moiety, and a modified nucleobase moiety;

each $R^s$ is independently —H, halogen, —CN, —$N_3$, —NO, —$NO_2$, -L-R', -L-Si$(R)_3$, -L-OR', -L-SR', -L-N$(R')_2$, —O-L-R', —O-L-Si$(R)_3$, —O-L-OR', —O-L-SR', or —O-L-N$(R')_2$;

each s is independently 0-20;

each $L^s$ is independently —$C(R^{5s})_2$—, or L;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —$C(R')_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —$S(O)_2$—, —$S(O)_2N(R')$—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each Ring A is independently an optionally substituted 3-20 membered monocyclic, bicyclic or polycyclic ring having 0-10 heteroatoms independently selected from oxygen, nitrogen, sulfur, phosphorus and silicon;

each $L^P$ is independently an internucleotidic linkage;

z is 1-1000;

$L^{3E}$ is L or -L-L-;

$R^{3E}$ is —R', -L-R', —OR', or a solid support;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

In some embodiments, each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, each $L^P$ independently has the structure of formula I, I-a, I-b, I-c, I-n-1, I-n-2, I-n-3, II, II-a-1, II-a-2, II-b-1, II-b-2, II-c-1, II-c-2, II-d-1, II-d-2, or a salt form thereof. In some embodiments, an internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, an internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, each internucleotidic linkage independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, each internucleotidic linkage independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, an internucleotidic linkage has the structure of formula I, I-a, I-b, I-c, I-n-1, I-n-2, I-n-3, II, II-a-1, II-a-2, II-b-1, II-b-2, II-c-1, II-c-2, II-d-1, II-d-2, or a salt form thereof. In some embodiments, each internucleotidic linkage independently has the structure of formula I, I-a, I-b, I-c, I-n-1, I-n-2, I-n-3, II, II-a-1, II-a-2, II-b-1, II-b-2, II-c-1, II-c-2, II-d-1, II-d-2, or a salt form thereof.

In some embodiments, each BA is independently an optionally substituted group selected from $C_{5-30}$ heteroaryl having 1-10 heteroatoms independently selected from oxygen, nitrogen, sulfur, phosphorus and silicon, and $C_{3-30}$ heterocyclyl having 1-10 heteroatoms independently selected from oxygen, nitrogen, sulfur, phosphorus, boron and silicon;

each Ring A is independently an optionally substituted 3-20 membered monocyclic, bicyclic or polycyclic ring having 0-10 heteroatoms independently selected from oxygen, nitrogen, sulfur, phosphorus and silicon; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof.

In some embodiments, each BA is independently an optionally substituted $C_{5-30}$ heteroaryl having 1-10 heteroatoms independently selected from oxygen, nitrogen, sulfur, phosphorus and silicon, wherein the heteroaryl comprises one or more heteroatoms selected from oxygen and nitrogen;

each Ring A is independently an optionally substituted 5-10 membered monocyclic or bicyclic saturated ring having 0-5 heteroatoms independently selected from oxygen, nitrogen, sulfur, phosphorus and silicon, wherein the ring comprises at least one oxygen atom; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof.

In some embodiments, each BA is independently an optionally substituted A, T, C, G, or U, or an optionally substituted tautomer of A, T, C, G, or U;

each Ring A is independently an optionally substituted 5-7 membered monocyclic or bicyclic saturated ring having one or more oxygen atoms; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof.

In some embodiments, each BA is independently an optionally substituted or protected nucleobase selected from adenine, cytosine, guanosine, thymine, and uracil and tautomers thereof;

each Ring A is independently an optionally substituted 5-7 membered monocyclic or bicyclic saturated ring having one or more oxygen atoms; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof.

In some embodiments, BA is an optionally substituted group selected from $C_{3-30}$ cycloaliphatic, $C_{6-30}$ aryl, $C_{5-30}$ heteroaryl having 1-10 heteroatoms independently selected from oxygen, nitrogen, sulfur, phosphorus and silicon, $C_{3-30}$ heterocyclyl having 1-10 heteroatoms independently selected from oxygen, nitrogen, sulfur, phosphorus and silicon, a natural nucleobase moiety, and a modified nucleobase moiety. In some embodiments, BA is an optionally substituted group selected from $C_{5-30}$ heteroaryl having 1-10 heteroatoms independently selected from oxygen, nitrogen, sulfur, phosphorus and silicon, $C_{3-30}$ heterocyclyl having 1-10 heteroatoms independently selected from oxygen, nitrogen, sulfur, phosphorus and silicon, a natural nucleobase moiety, and a modified nucleobase moiety. In some embodiments, BA is an optionally substituted group selected from $C_{5-30}$ heteroaryl having 1-10 heteroatoms independently selected from oxygen, nitrogen, sulfur, phosphorus and silicon, a natural nucleobase moiety, and a modified nucleobase moiety. In some embodiments, BA is optionally substituted $C_{5-30}$ heteroaryl having 1-10 heteroatoms independently selected from oxygen, nitrogen, and sulfur. In some embodiments, BA is optionally substituted natural nucleobases and tautomers thereof. In some embodiments, BA is protected natural nucleobases and tautomers thereof. Various nucleobase protecting groups for oligonucleotide synthesis are known and can be utilized in accordance with the present disclosure. In some embodiments, BA is an optionally substituted nucleobase selected from adenine, cytosine, guanosine, thymine, and uracil, and tautomers thereof. In some embodiments, BA is an optionally protected nucleobase selected from adenine, cytosine, guanosine, thymine, and uracil, and tautomers thereof.

In some embodiments, BA is optionally substituted $C_{3-30}$ cycloaliphatic. In some embodiments, BA is optionally substituted $C_{6-30}$ aryl. In some embodiments, BA is optionally substituted $C_{3-30}$ heterocyclyl. In some embodiments, BA is optionally substituted $C_{5-30}$ heteroaryl. In some embodiments, BA is an optionally substituted natural base moiety. In some embodiments, BA is an optionally substituted modified base moiety. BA is an optionally substituted group selected from $C_{3-30}$ cycloaliphatic, $C_{6-30}$ aryl, $C_{3-30}$ heterocyclyl, and $C_{5-30}$ heteroaryl. In some embodiments, BA is an optionally substituted group selected from $C_{3-30}$ cycloaliphatic, $C_{6-30}$ aryl, $C_{3-30}$ heterocyclyl, $C_{5-30}$ heteroaryl, and a natural nucleobase moiety.

In some embodiments, BA is connected through an aromatic ring. In some embodiments, BA is connected through a heteroatom. In some embodiments, BA is connected through a ring heteroatom of an aromatic ring. In some embodiments, BA is connected through a ring nitrogen atom of an aromatic ring.

In some embodiments, BA is a natural nucleobase moiety. In some embodiments, BA is an optionally substituted natural nucleobase moiety. In some embodiments, BA is a substituted natural nucleobase moiety. In some embodiments, BA is optionally substituted, or an optionally substituted tautomer of, A, T, C, U, or G. In some embodiments, BA is natural nucleobase A, T, C, U, or G. In some embodiments, BA is an optionally substituted group selected from natural nucleobases A, T, C, U, and G.

In some embodiments, BA is an optionally substituted purine base residue. In some embodiments, BA is a protected purine base residue. In some embodiments, BA is an optionally substituted adenine residue. In some embodiments, BA is a protected adenine residue. In some embodiments, BA is an optionally substituted guanine residue. In some embodiments, BA is a protected guanine residue. In some embodiments, BA is an optionally substituted cytosine residue. In some embodiments, BA is a protected cytosine residue. In some embodiments, BA is an optionally substituted thymine residue. In some embodiments, BA is a protected thymine residue. In some embodiments, BA is an optionally substituted uracil residue. In some embodiments, BA is a protected uracil residue. In some embodiments, BA is an optionally substituted 5-methylcytosine residue. In some embodiments, BA is a protected 5-methylcytosine residue.

In some embodiments, BA is a protected base residue as used in oligonucleotide preparation. In some embodiments, BA is a base residue illustrated in US 2011/0294124, US 2015/0211006, US 2015/0197540, and WO 2015/107425, each of which is incorporated herein by reference.

In some embodiments, $R^{5s}$-$L^s$- is —$CH_2$OH. In some embodiments, $R^{5s}$-$L^s$- is —CH($R^{5s}$)—OH, wherein $R^{5s}$ is as described in the present disclosure. In some embodiments, $L^s$ is —$CH_2$—. In some embodiments, L' is —CH($R^{5s}$)— wherein $R^{5s}$ is not —H. In some embodiments, $L^s$ is —CH ($R^{5s}$)— wherein $R^{5s}$ is not —H and is otherwise R. In some embodiments, R is optionally substituted $C_{1-6}$ aliphatic. In some embodiments, R is optionally substituted $C_{1-6}$ alkyl. In some embodiments, R is methyl. In some embodiments, —CH($R^{5s}$)— wherein $R^{5s}$ is not —H has is R. In some embodiments, —CH($R^{5s}$)— wherein $R^{5s}$ is not —H has is S.

Example embodiments for variables, e.g., variables of each of the formulae, are additionally described in the present disclosure, and may be independently and optionally combined.

In some embodiments, the present disclosure provides oligonucleotides and oligonucleotide compositions that are chirally controlled. For instance, in some embodiments, a provided composition contains controlled levels of one or more individual oligonucleotide types, wherein an oligonucleotide type is defined by: 1) base sequence; 2) pattern of backbone linkages; 3) pattern of backbone chiral centers; and 4) pattern of backbone P-modifications. In some embodiments, oligonucleotides of the same oligonucleotide type are identical.

In some embodiments, a provided oligonucleotide is an altmer. In some embodiments, a provided oligonucleotide is a P-modification altmer. In some embodiments, a provided oligonucleotide is a stereoaltmer.

In some embodiments, a provided oligonucleotide is a blockmer. In some embodiments, a provided oligonucleotide is a P-modification blockmer. In some embodiments, a provided oligonucleotide is a stereoblockmer.

In some embodiments, a provided oligonucleotide is a gapmer.

In some embodiments, a provided oligonucleotide is a skipmer.

In some embodiments, a provided oligonucleotide is a hemimer. In some embodiments, a hemimer is an oligonucleotide wherein the 5'-end or the 3'-end has a sequence that possesses a structure feature that the rest of the oligonucleotide does not have. In some embodiments, the 5'-end or the 3'-end has or comprises 2 to 20 nucleotides. In some embodiments, a structural feature is a base modification. In some embodiments, a structural feature is a sugar modification. In some embodiments, a structural feature is a P-modification. In some embodiments, a structural feature is stereochemistry of the chiral internucleotidic linkage. In some embodiments, a structural feature is or comprises a base modification, a sugar modification, a P-modification, or stereochemistry of the chiral internucleotidic linkage, or combinations thereof. In some embodiments, a hemimer is an oligonucleotide in which each sugar moiety of the 5'-end sequence shares a common modification. In some embodiments, a hemimer is an oligonucleotide in which each sugar moiety of the 3'-end sequence shares a common modification. In some embodiments, a common sugar modification of the 5' or 3' end sequence is not shared by any other sugar moieties in the oligonucleotide. In some embodiments, an example hemimer is an oligonucleotide comprising a sequence of substituted or unsubstituted 2'-O-alkyl sugar modified nucleosides, bicyclic sugar modified nucleosides, β-D-ribonucleosides or β-D-deoxyribonucleosides (for example 2'-MOE modified nucleosides, and LNA™ or ENA™ bicyclic sugar modified nucleosides) at one terminus and a sequence of nucleosides with a different sugar moiety (such as a substituted or unsubstituted 2'-O-alkyl sugar modified nucleosides, bicyclic sugar modified nucleosides or natural ones) at the other terminus. In some embodiments, a provided oligonucleotide is a combination of one or more of unimer, altmer, blockmer, gapmer, hemimer and skipmer. In some embodiments, a provided oligonucleotide is a combination of one or more of unimer, altmer, blockmer, gapmer, and skipmer. For instance, in some embodiments, a provided oligonucleotide is both an altmer and a gapmer. In some embodiments, a provided nucleotide is both a gapmer and a skipmer. One of skill in the chemical and synthetic arts will recognize that numerous other combinations of patterns are available and are limited only by the commercial availability and/or synthetic accessibility of constituent parts required to synthesize a provided oligonucleotide in accordance with methods of the present disclosure. In some embodiments, a hemimer structure provides advantageous benefits. In some embodiments, provided oligonucleotides are 5'-hemimers that comprises modified sugar moieties in a 5'-end sequence. In some embodiments, provided oligonucleotides are 5'-hemimers that comprises modified 2'-sugar moieties in a 5'-end sequence.

In some embodiments, a provided oligonucleotide comprises one or more optionally substituted nucleotides. In some embodiments, a provided oligonucleotide comprises one or more modified nucleotides. In some embodiments, a provided oligonucleotide comprises one or more optionally substituted nucleosides. In some embodiments, a provided oligonucleotide comprises one or more modified nucleosides. In some embodiments, a provided oligonucleotide comprises one or more optionally substituted nucleosides or sugars of LNAs.

In some embodiments, a provided oligonucleotide comprises one or more optionally substituted nucleobases. In some embodiments, a provided oligonucleotide comprises one or more optionally substituted natural nucleobases. In some embodiments, a provided oligonucleotide comprises one or more optionally substituted modified nucleobases. In some embodiments, a provided oligonucleotide comprises one or more 5-methylcytidine; 5-hydroxymethylcytidine, 5-formylcytosine, or 5-carboxylcytosine. In some embodiments, a provided oligonucleotide comprises one or more 5-methylcytidine.

In some embodiments, a provided oligonucleotide comprises one or more optionally substituted sugars. In some embodiments, a provided oligonucleotide comprises one or more optionally substituted sugars found in naturally occurring DNA and RNA. In some embodiments, a provided oligonucleotide comprises one or more optionally substituted ribose or deoxyribose. In some embodiments, a provided oligonucleotide comprises one or more optionally substituted ribose or deoxyribose, wherein one or more hydroxyl groups of the ribose or deoxyribose moiety is optionally and independently replaced by halogen, R', —N(R')$_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with $R^{2s}$, halogen, R', —N(R')$_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with halogen. In some embodiments, a provided oligonucleotide comprises one or more optionally substituted deoxyribose, wherein the 2' position of the deoxyribose is optionally and independently substituted with one or more —F. halogen. In some embodiments, a provided oligonucleotide comprises one or more optionally substituted deoxyribose, wherein the 2' position of the deoxyribose is optionally and independently substituted with —OR', wherein each R' is independently as defined above and described herein. In some embodiments, a provided oligonucleotide comprises one or more optionally substituted deoxyribose, wherein the 2' position of the deoxyribose is optionally and independently substituted with —OR', wherein each R' is independently an optionally substituted $C_1$-$C_6$ aliphatic. In some embodiments, a provided oligonucleotide comprises one or more optionally substituted deoxyribose, wherein the 2' position of the deoxyribose is optionally and independently substituted with —OR', wherein each R' is independently an optionally substituted $C_1$-$C_6$ alkyl. In some embodiments, a provided oligonucleotide comprises one or more optionally substituted deoxyribose, wherein the 2' position of the deoxyribose is optionally and independently substituted with —OMe. In some embodiments, a provided oligonucleotide comprises one or more optionally substituted deoxyribose, wherein the 2' position of the deoxyribose is optionally and independently substituted with —O-methoxyethyl.

In some embodiments, a provided oligonucleotide is single-stranded oligonucleotide. In some embodiments, a provided oligonucleotide is a hybridized oligonucleotide strand. In certain embodiments, a provided oligonucleotide is a partially hybridized oligonucleotide strand. In certain embodiments, a provided oligonucleotide is a completely hybridized oligonucleotide strand. In certain embodiments, a provided oligonucleotide is a double-stranded oligonucleotide. In certain embodiments, a provided oligonucleotide is a triple-stranded oligonucleotide (e.g., a triplex).

In some embodiments, a provided oligonucleotide is chimeric. For example, in some embodiments, a provided oligonucleotide is DNA-RNA chimera, DNA-LNA chimera, etc.

In some embodiments, an oligonucleotide is a chirally controlled oligonucleotide variant of an oligonucleotide described in WO2012/030683. For example, in some embodiments, a chirally controlled oligonucleotide variant comprises a chirally controlled version of a chiral internucleotidic linkage which is not chirally controlled in WO2012/030683. In some embodiments, a chirally controlled oligonucleotide variant comprises one or more chirally controlled internucleotidic linkages which independently replace one or more natural phosphate linkages or non-chirally controlled modified internucleotidic linkages in WO2012/030683.

In some embodiments, a provided oligonucleotide is or comprises a portion of GNA, LNA, PNA, TNA or Morpholino.

In some embodiments, a provided oligonucleotide is from about 15 to about 25 nucleotide units in length. In some embodiments, a provided oligonucleotide is from about 5, 6, 7, 8, 9, 10, 11, 12, 13, 14, 15, 16, 17, 18, 19, 20, 21, 22, 23, 24, or 25 nucleotide units in length.

In some embodiments, the present disclosure provides oligonucleotides comprising one or more modified internucleotidic linkage, which can be chiral at linkage phosphorus and chirally controlled. In some embodiments, an oligonucleotide comprises one or more linkages $L^{PO}$, $L^{PA}$ or $L^{PB}$, wherein:

each $L^{PO}$ is independently

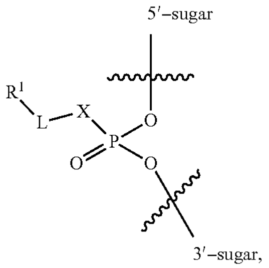

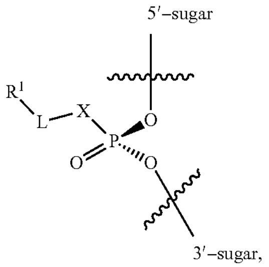

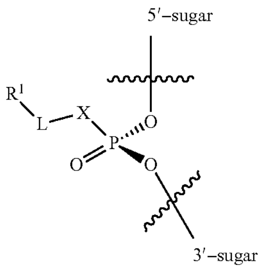

or a salt form thereof;

each $L^{PA}$ is independently an internucleotidic linkage having the structure of

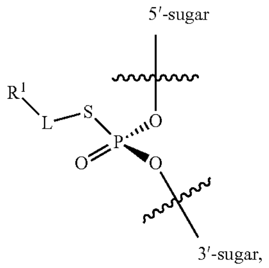

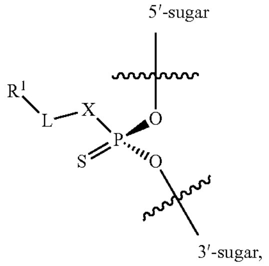

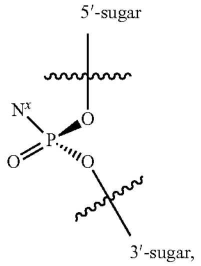

or

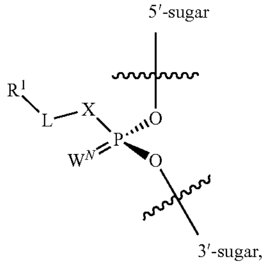

or a salt form thereof;

each $L^{PB}$ is independently an internucleotidic linkage having the structure of

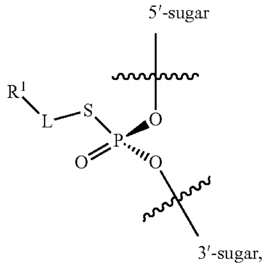

-continued
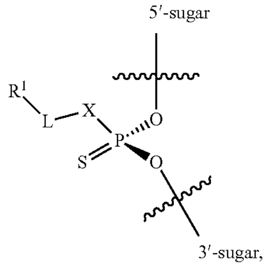
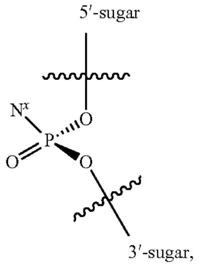
or
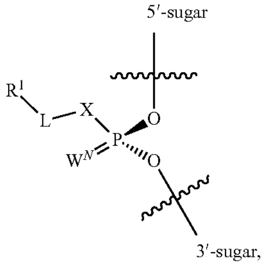
or a salt form thereof;
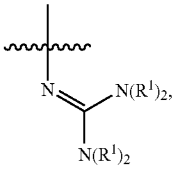
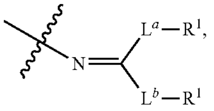
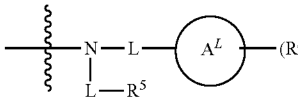
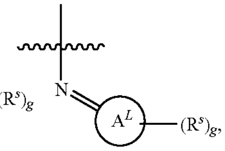
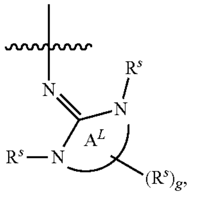
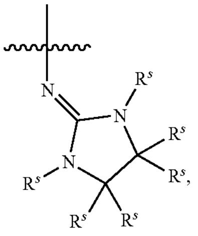
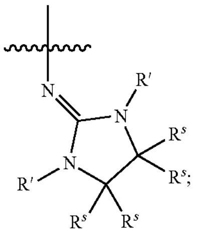
and
$W^N$ is =N-L-$R^5$,
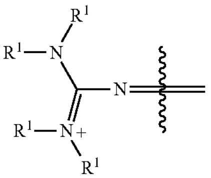
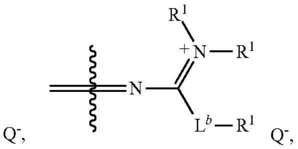
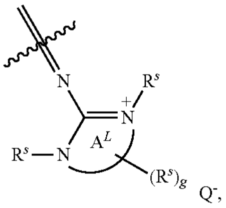
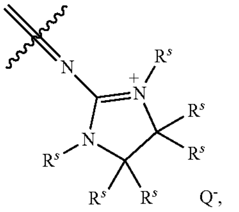
or
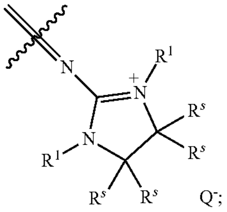
wherein each other variable is independently as described herein.
In some embodiments, each $L^{PO}$ is independently
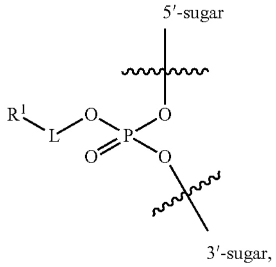
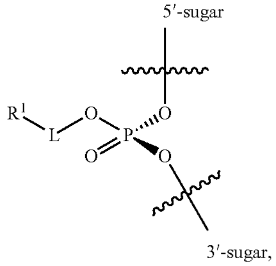
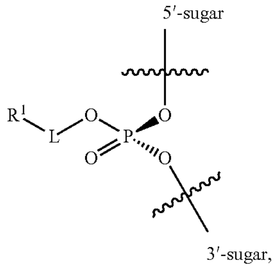
or a salt form thereof.

In some embodiments, —O-L-$R^1$ is —OH. In some embodiments, —X-L-$R^1$, e.g., in $L^{PO}$ is —$OCH_2CH_2CN$. In some embodiments, —S-L-$R^1$ is —SH. In some embodiments, $L^{PA}$ is a phosphorothioate internucleotidic linkage with the specified stereochemistry. In some embodiments, $L^{PB}$ is a phosphorothioate internucleotidic linkage with the specified stereochemistry. In some embodiments, X is —O—, and —X-L-$R^1$ is as described in the present disclosure, e.g., —X-L-$R^1$ is

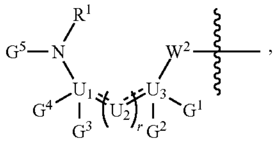,
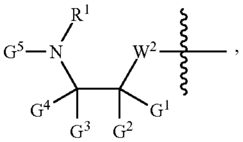,
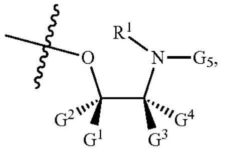
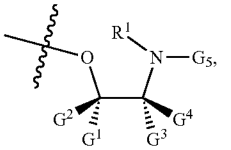
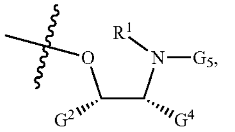
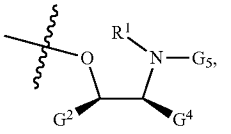
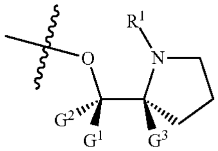,
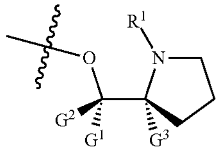,
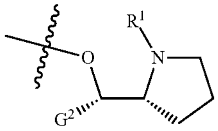, or
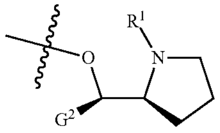, wherein each variable is independently in accordance with the present disclosure, or H—X-L-$R^1$ is a chiral auxiliary as described herein. In some embodiments, —X-L-$R^1$ is

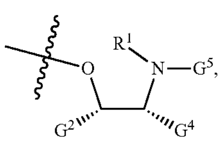 or
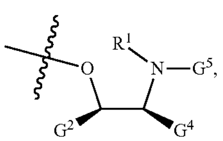

wherein $G^4$ and $G^5$ are taken together to form an optionally substituted ring as described herein. In some embodiments, —X-L-$R^1$ is

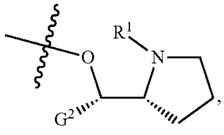, or
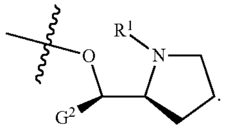.

In some embodiments, $G^2$ is —$CH_2Si(R)_3$ as described herein. In some embodiments, $G^2$ is —$CH_2Si(Ph)_2Me$. In some embodiments, $G^2$ comprises an electron-withdrawing group as described herein, for example, in some embodiments, $G^2$ is —$CH_2SO_2R$ as described herein. In some embodiments, $G^2$ is —$CH_2SO_2Ph$.

In some embodiments, $N^x$ is —N(-L-$R^5$)-L-$R^1$, and an internucleotidic linkage having such a $N^x$ group is an internucleotidic linkage having the structure of formula I wherein $P^L$ is P═O, Y and Z are —O—, and X is —N(-L-$R^5$)—, wherein the linkage phosphorus stereochemistry is as specified. In some embodiments, $N^x$ is

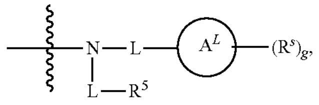

and an internucleotidic linkage having such a $N^x$ group is an internucleotidic linkage having the structure of formula II, wherein $P^L$ is P═O, Y and Z are —O—, and X is —N(-L-$R^5$)—, wherein the linkage phosphorus stereochemistry is as specified. In some embodiments, $N^x$ is

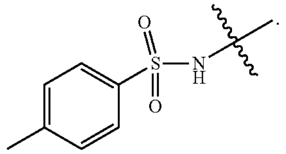 [SMILES: *NS(=O)(=O)c1ccc(C)cc1]

In some embodiments, $N^x$ is

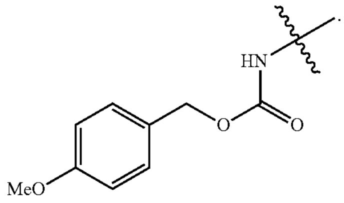 [SMILES: *NC(=O)OCc1ccc(OC)cc1]

In some embodiments, $N^x$ is

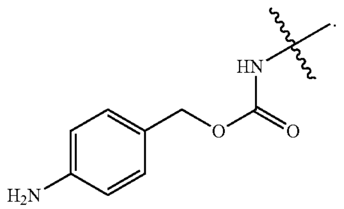 [SMILES: *NC(=O)OCc1ccc(N)cc1]

In some embodiments, $N^x$ is.

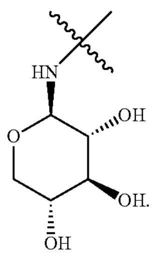 [SMILES: *N[C@@H]1OC[C@@H](O)[C@H](O)[C@H]1O]

In some embodiments, $N^x$ is

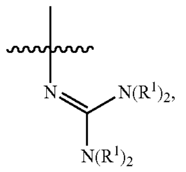

and an internucleotidic linkage having such a $N^x$ group is an internucleotidic linkage having the structure of formula I-n-3, wherein $P^L$ is P═O, and Y and Z are —O—, wherein the linkage phosphorus stereochemistry is as specified. In some embodiments, $R^1$ is optionally substituted alkyl. In some embodiments, $R^1$ is methyl. In some embodiments, $N^x$ is

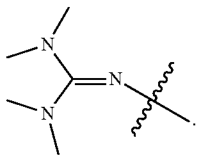 [SMILES: *N=C(N(C)C)N(C)C]

In some embodiments, two $R^1$ on the same nitrogen independently are taken together to form an optionally substituted ring as described herein, e.g., an optionally substituted 5- or 6-membered ring which in addition to the nitrogen atom, has 1-3 heteroatoms. In some embodiments, the ring is saturated. In some embodiments, the ring is monocyclic. In some embodiments, $N^x$ is

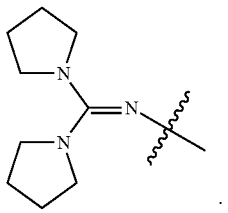 [SMILES: *N=C(N1CCCC1)N1CCCC1]

In some embodiments, $N^x$ is

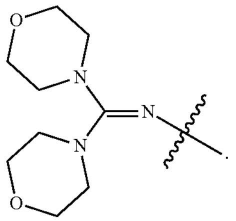 [SMILES: *N=C(N1CCOCC1)N1CCOCC1]

In some embodiments, $N^x$ is

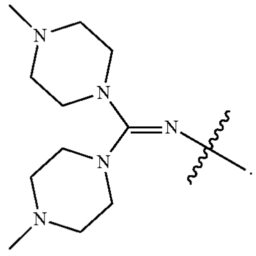 [SMILES: *N=C(N1CCN(C)CC1)N1CCN(C)CC1]

Those skilled in the art will appreciate that two —$N(R^1)_2$ groups, in any, in a structure or formula can either be the same or different. In some embodiments, $N^x$ is

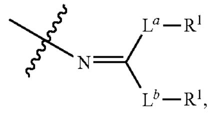

and an internucleotidic linkage having such a $N^x$ group is an internucleotidic linkage having the structure of formula I-n-4, wherein $P^L$ is P═O, L is a covalent bond, and Y and Z are —O—, wherein the linkage phosphorus stereochemistry is as specified. In some embodiments, $N^x$ is

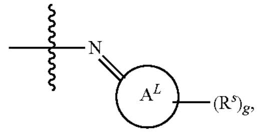

and an internucleotidic linkage having such a $N^x$ group is an internucleotidic linkage having the structure of formula II-a-1, wherein $P^L$ is P═O, L is a covalent bond, and Y and Z are —O—, wherein the linkage phosphorus stereochemistry is as specified. In some embodiments, $N^x$ is

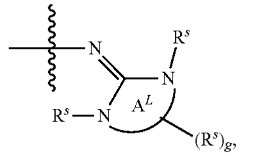

and an internucleotidic linkage having such a $N^x$ group is an internucleotidic linkage having the structure of formula II-b-1, wherein $P^L$ is P═O, L is a covalent bond, and Y and Z are —O—, wherein the linkage phosphorus stereochemistry is as specified. In some embodiments, $N^x$ is

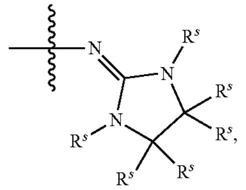

and an internucleotidic linkage having such a N group is an internucleotidic linkage having the structure of formula II-c-1, wherein $P^L$ is P═O, L is a covalent bond, and Y and Z are —O—, wherein the linkage phosphorus stereochemistry is as specified. In some embodiments, $N^x$ is

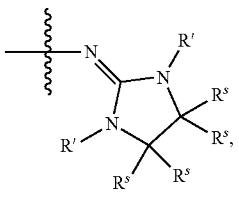

and an internucleotidic linkage having such a $N^x$ group is an internucleotidic linkage having the structure of formula II-d-1, wherein $P^L$ is P═O, L is a covalent bond, and Y and Z are —O—, wherein the linkage phosphorus stereochemistry is as specified. In some embodiments, R' or $R^s$ is optionally substituted alkyl. In some embodiments, R' or $R^s$ is —$CH_3$. In some embodiments, R' or $R^s$ is —$CH_2(CH_2)_{10}CH_3$. In some embodiments, $R^s$ is —H. In some embodiments, $N^x$ is

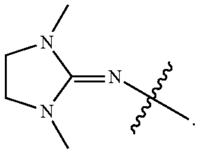 [SMILES: *N=C1N(C)CCN1C]

In some embodiments, $N^x$ is

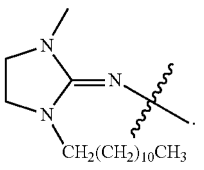

In some embodiments, P═$W^N$ is a $P^N$ group as described herein. In some embodiments, $W^N$ is

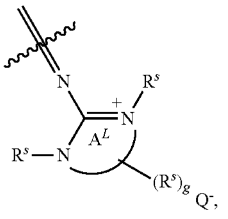

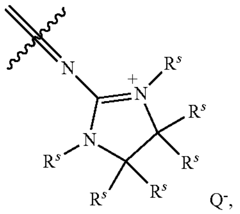

or

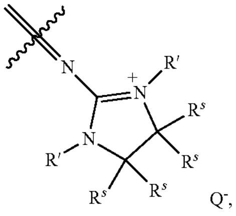

wherein each variable is as described herein (for example, in $N^x$). In some embodiments, $W^N$ is

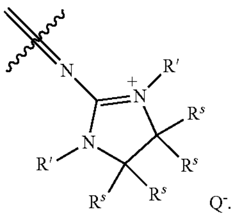

In some embodiments, as described herein R' or $R^s$ is optionally substituted alkyl or —H. In some embodiments, R' is —$CH_3$. In some embodiments, R' is —$CH_2(CH_2)_{10}CH_3$. In some embodiments, $R^s$ is —H. In some embodiments, $W^N$ is

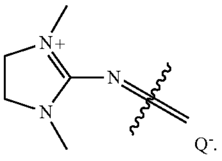

In some embodiments, $W^N$ is

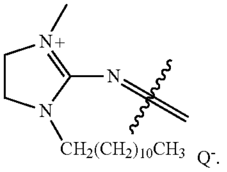

In some embodiments, $W^N$ is ═N-L-$R^5$ wherein each variable is as described herein. For example, in some embodiments, L is —$SO_2$—. In some embodiments, L is —C(O)$OCH_2$—. In some embodiments, as described herein, $R^5$ is or comprise an optionally substituted ring. In some embodiments, $R^5$ is R as described herein. In some embodiments, $R^5$ is optionally substituted phenyl. In some embodiments, $R^5$ is 4-methylphenyl. In some embodiments, $R^5$ is 4-methoxyphenyl. In some embodiments, $R^5$ is 4-aminophenyl. In some embodiments, $R^5$ is an optionally substituted heteroaliphatic ring. In some embodiments, $R^5$ is an optionally substituted 3-10 (e.g., 3, 4, 5, 6, 7, or 8) membered heteroaliphatic ring. In some embodiments, $R^5$ is an optionally substituted 5- or 6-membered saturated monocyclic heteroaliphatic ring having 1-3 heteroatoms. In some embodiments, the ring is 5-membered. In some embodiments, the ring is 6-membered. In some embodiments, the number of ring heteroatom(s) is 1. In some embodiments, the number of ring heteroatoms is 2. In some embodiments, a heteroatom is oxygen. In some embodiments, $R^5$ is optionally substituted

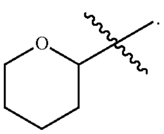 [SMILES: *C1CCCCO1]

In some embodiments, $R^5$ is optionally substituted

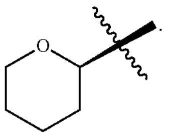

In some embodiments, $R^5$ is

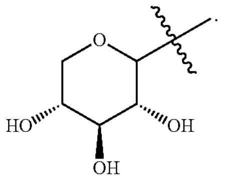

In some embodiments, $R^5$ is optionally substituted $C_{1-30}$ aliphatic. In some embodiments, $R^5$ is optionally substituted $C_{1-10}$ alkyl. In some embodiments, $W^N$ is

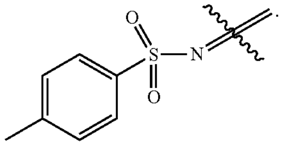 [SMILES: *=NS(=O)(=O)c1ccc(C)cc1]

In some embodiments, $W^N$ is

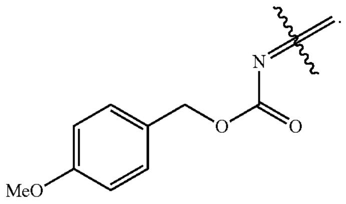 [SMILES: *=NC(=O)OCc1ccc(OC)cc1]

In some embodiments, $W^N$ is

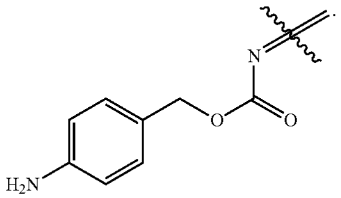 [SMILES: *=NC(=O)OCc1ccc(N)cc1]

In some embodiments, $W^N$ is

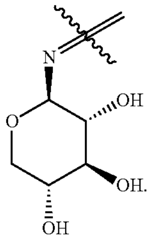 [SMILES: *=N[C@@H]1OC[C@@H](O)[C@H](O)[C@H]1O]

In some embodiments, $W^N$ is

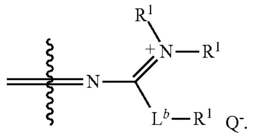

In some embodiments, $W^N$ is

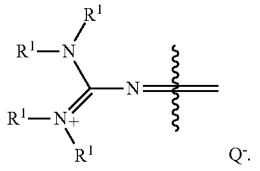

In In some embodiments, $W^N$ is

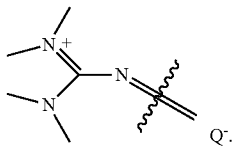

In some embodiments, $W^N$ is

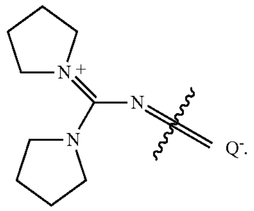

In some embodiments, $W^N$ is

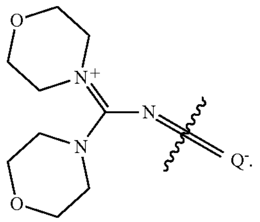

$Q^-$. In some embodiments, $W^N$ is

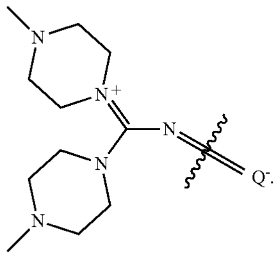

In some embodiments, $Q^-$ is $PF_6^-$.

In some embodiments, —X-L-$R^1$ in

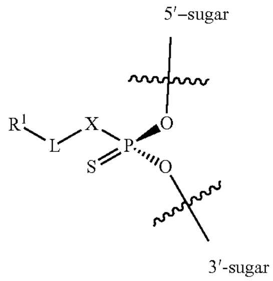

is

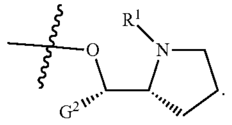

In some embodiments, —X-L-$R^1$ in

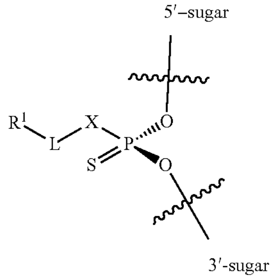

is

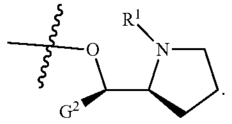

In some embodiments, $G^2$ is —$CH_2Si(R)_3$ as described herein. In some embodiments, $G^2$ is —$CH_2Si(Ph)_2Me$. In some embodiments, —X-L-$R^1$ in

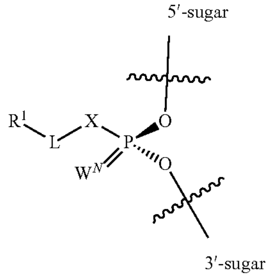

is

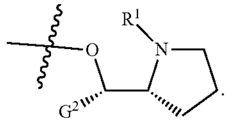

In some embodiments, —X-L-$R^1$ in

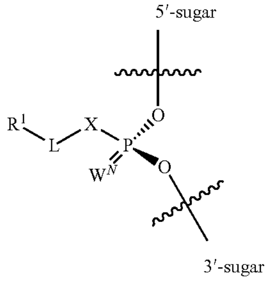

is

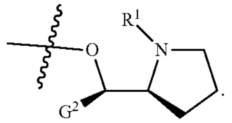

In some embodiments, $G^2$ comprises an electron-withdrawing group as described herein. In some embodiments, $G^2$ is —$CH_2SO_2R$, wherein R is not —H. In some embodiments, R is optionally substituted phenyl. In some embodiments, $G^2$ is —$CH_2SO_2Ph$. In some embodiments, R is optionally substituted $C_{1-6}$ aliphatic, e.g., t-butyl. In some embodiments, as described herein, $R^1$ is —C(O)R'. In some embodiments, $R^1$ is —$C(O)CH_3$. In some embodiments, $R^1$ is —H.

In some embodiments, $L^{PO}$ is a natural phosphate linkage. In some embodiments, $L^{PA}$ is a Rp phosphorothioate internucleotidic linkage. In some embodiments, $L^{PA}$ is a Rp non-negatively charged internucleotidic linkage, e.g., n001. In some embodiments, $L^{PB}$ is a Sp phosphorothioate internucleotidic linkage. In some embodiments, $L^{PB}$ is a Sp non-negatively charged internucleotidic linkage, e.g., n001. In some embodiments, an oligonucleotide comprises one or more linkages $L^{PO}$. In some embodiments, an oligonucleotide comprises one or more linkages $L^{PA}$. In some embodiments, an oligonucleotide comprises one or more linkages $L^{PB}$. In some embodiments, an oligonucleotide comprises one or more internucleotidic linkages independently selected from $L^{PO}$, $L^{PA}$ and $L^{PB}$. In some embodiments, each internucleotidic linkage is independently selected from $L^{PO}$, $L^{PA}$ and $L^{PB}$. In some embodiments, each internucleotidic linkage is independently selected from $L^{PA}$ and $L^{PB}$. In some embodiments, at least one internucleotidic linkage is $L^{PA}$ or $L^{PB}$. In some embodiments, each chirally controlled internucleotidic linkage is independently selected from $L^{PA}$ and $L^{PB}$ In some embodiments, the present disclosure provides oligonucleotides (e.g., chirally controlled oligonucleotides) and compositions thereof (e.g., chirally controlled oligonucleotide compositions), wherein the internucleotidic linkages of the oligonucleotides or regions thereof are or comprise the following consecutive internucleotidic linkages (from 5' to 3'):

($L^{PX}$/$L^{PO}$)t[($L^{PA}$)n($L^{PB}$)m]y, ($L^{PX}$/$L^{PO}$)t[($L^{PO}$)n($L^{PB}$)m]y, [($L^{PA}$)n($L^{PB}$)m]y, [($L^{PO}$)n($L^{PB}$)m]y, (($L^{PB}$)t[($L^{PA}$)n($L^{PB}$) m]y, ($L^{PB}$)t[($L^{PO}$)n($L^{PB}$)m]y, ($L^{PB}$)t[($L^{PO}$/_PA)n($L^{PB}$)m]y, [($L^{PA}$)n($L^{PB}$)m]y, [($L^{PO}$)n($L^{PB}$)m]y, [($L^{PO}$/$L^{PA}$)n($L^{PB}$)m]y, ($L^{PA}$)t($L^{PX}$)n($L^{PA}$)m, ($L^{PA}$)t($L^{PB}$)n($L^{PA}$)m, ($L^{PA}$)t[($L^{PX}$/$L^{PO}$)n]y($L^{PA}$)m, ($L^{PA}$)t[($L^{PB}$/$L^{PX}$)n]y($L^{PA}$)m, ($L^{PA}$)t[($L^{PB}$/$L^{PO}$)n]y($L^{PA}$)m, ($L^{PX}$/$L^{PO}$)t($L^{PX}$)n($L^{PX}$/$L^{PO}$)m, ($L^{PX}$/$L^{PO}$)t($L^{PB}$)n($L^{PX}$/$L^{PO}$)m, ($L^{PX}$/$L^{PO}$)t[($L^{PX}$/$L^{PO}$)n]y($L^{PX}$/$L^{PO}$)m, ($L^{PX}$/$L^{PO}$)t[($L^{PB}$/$L^{PO}$)n]y($L^{PX}$/$L^{PO}$)m, ($L^{PX}$/$L^{PO}$)t[($L^{PB}$/_PO)n]y($L^{PX}$/$L^{PO}$)m, ($L^{PA}$/$L^{PO}$)t($L^{PX}$)n($L^{PA}$/$L^{PO}$)m, ($L^{PA}$/$L^{PO}$)t($L^{PB}$)n($L^{PA}$/$L^{PO}$)m, ($L^{PA}$/$L^{PO}$)t[($L^{PX}$/$L^{PO}$)n]y($L^{PA}$/$L^{PO}$)m, ($L^{PA}$/$L^{PO}$)t[($L^{PB}$/$L^{PO}$)n]y($L^{PA}$/$L^{PO}$)m, or ($L^{PA}$/$L^{PO}$)t[($L^{PB}$/$L^{PO}$)n]y($L^{PA}$/$L^{PO}$)m, or a combination thereof, wherein:

each $L^{PX}$ is independently $L^{PA}$ or $L^{PB}$; and each other variable is independently as described herein.

In some embodiments, internucleotidic linkages of an provided oligonucleotides or regions thereof comprise or are consecutive internucleotidic linkages [($L^{PA}$)n($L^{PB}$)m]y, [($L^{PO}$)n($L^{PB}$)m]y, ($L^{PB}$)t[($L^{PA}$)n($L^{PB}$)m]y, or ($L^{PB}$)t[($L^{PO}$)n($L^{PB}$)m]y. In some embodiments, internucleotidic linkages of an provided oligonucleotides or regions thereof comprise or are consecutive internucleotidic linkages ($L^{PA}$)($L^{PB}$)m. In some embodiments, internucleotidic linkages of an provided oligonucleotides or regions thereof comprise or are consecutive internucleotidic linkages [($L^{PA}$)($L^{PB}$)m]y. In some embodiments, internucleotidic linkages of an provided oligonucleotides or regions thereof comprise or are consecutive internucleotidic linkages ($L^{PB}$)t($L^{PA}$)($L^{PB}$)m. In some embodiments, each sugar between two of the consecutive internucleotidic linkages independently contains no 2'-modification. In some embodiments, each sugar between two of the consecutive internucleotidic linkages is independently

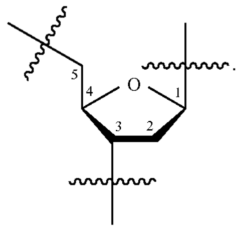

In some embodiments, n is 1. In some embodiments, y is 1. In some embodiments, y is 2-10. In some embodiments, t is 1. In some embodiments, t is 2-10. In some embodiments, t is 1, 2, 3, 4, 5, 6, 7, 8, 9, or 10, n is 1, and m is 1, 2, 3, 4, 5, 6, 7, 8, 9, or 10. In some embodiments, t is 1, 2, 3, 4, 5, 6, 7, 8, 9, or 10, n is 1, and m is 2, 3, 4, 5, 6, 7, 8, 9, or 10. In some embodiments, t is 2-10, n is 1 and m is 2-10. In some embodiments, each $L^{PA}$ is independently

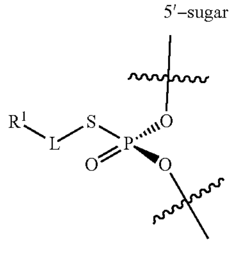

or

-continued

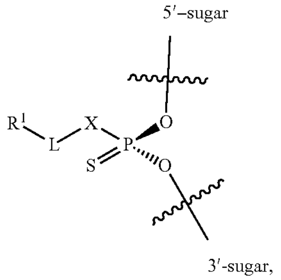

, or a salt form thereof. In some embodiments, each $L^{PB}$ is independently

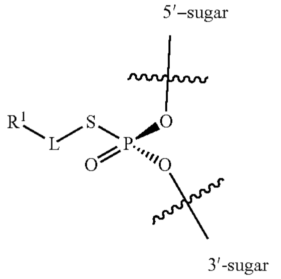

or

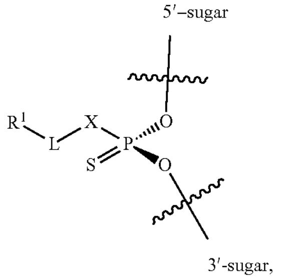

, or a salt form thereof. In some embodiments, each $L^{PA}$ is independently

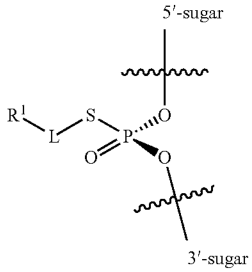

or a salt form thereof, and each each $L^{PB}$ is independently

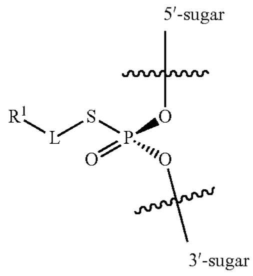

or a salt form thereof.

In some embodiments, internucleotidic linkages of an provided oligonucleotides or regions thereof comprise or are consecutive internucleotidic linkages (from 5' to 3') $(L^{PO})m(L^{PA}/L^{PB})n$, $L^{PO}(L^{PA}/L^{PB})n$, $(L^{PO})m(L^{PB})n$, $L^{PO}(L^{PB})n$, $[(L^{PO})m(L^{PA}/L^{PB})n]y$, $[L^{PO}(L^{PA}/L^{PB})n]y$, $[(L^{PO})m(L^{PB})n]y$, $[L^{PO}(L^{PB})n]y$, $(L^{PA}/L^{PB})t(L^{PO})m(L^{PA}/L^{PB})n$, $(L^{PA}/L^{PB})t(L^{PO})m(L^{PB})n$, $(L^{PA}/L^{PB})tL^{PO}(L^{PB})n$, $(L^{PA}/L^{PB})t[(L^{PO})m(L^{PA}/L^{PB})n]y$, $(L^{PA}/L^{PB})t[(L^{PO})m(L^{PB})n]y$, $(L^{PA}/L^{PB})t[L^{PO}(L^{PB})n]y$, $(L^{PO})m(L^{PA}/L^{PB})n(L^{PA}/L^{PB})t$, $L^{PO}(L^{PA}/L^{PB})n(L^{PA}/L^{PB})t$, $(L^{PO})m(L^{PB})n(L^{PA}/L^{PB})t$, $L^{PO}(L^{PB})n(L^{PA}/L^{PB})t$, $[(L^{PO})m(L^{PA}/L^{PB})n]y(L^{PA}/L^{PB})t$, $[L^{PO}(L^{PA}/L^{PB})n]y(L^{PA}/L^{PB})t$, $[(L^{PO})m(L^{PB})n]y(L^{PA}/L^{PB})t$, $[L^{PO}(L^{PB})n]y(L^{PA}/L^{PB})t$, $(L^{PA}/L^{PB})t[(L^{PO})m(L^{PA}/L^{PB})n]y(L^{PA}/L^{PB})t$, $L^{PB}(L^{PA}/L^{PB})t[(L^{PO})m(L^{PA}/L^{PB})n]y(L^{PA}/L^{PB})tL^{PB}$, $(L^{PA}/L^{PB})t[(L^{PO})m(L^{PB})n]y(L^{PA}/L^{PB})t$, $L^{PB}(L^{PA}/L^{PB})t[(L^{PO})m(L^{PB})n]y(L^{PA}/L^{PB})tL^{PB}$, $(L^{PA}/L^{PB})t[(L^{PO})(L^{PA}/L^{PB})]y(L^{PA}/L^{PB})t$, $L^{PB}(L^{PA}/L^{PB})t[(L^{PO})(L^{PA}/L^{PB})]y(L^{PA}/L^{PB})tL^{PB}(L^{PA}/L^{PB})t[(L^{PO})(L^{PB})]y(L^{PA}/L^{PB})t$, $L^{PB}(L^{PA}/L^{PB})t[(L^{PO})(L^{PB})]y(L^{PA}/L^{PB})tL^{PB}$, or a combination thereof, wherein each variable is independently as described herein. In some embodiments, at least one $L^{PA}/L^{PB}$ of $(L^{PA}/L^{PB})t$ is $L^{PA}$. In some embodiments, at least one $L^{PA}/L^{PB}$ of $(L^{PA}/L^{PB})t$ is $L^{PB}$. In some embodiments, at least one $L^{PA}/L^{PB}$ of $(L^{PA}/L^{PB})t$ is $L^{PA}$, and at least one $L^{PA}/L^{PB}$ of $(L^{PA}/L^{PB})t$ is $L^{PB}$. In some embodiments, at least one $L^{PA}/L^{PB}$ of $(L^{PA}/L^{PB})m$ is $L^{PA}$. In some embodiments, at least one $L^{PA}/L^{PB}$ of $(L^{PA}/L^{PB})m$ is $L^{PB}$. In some embodiments, at least one $L^{PA}/L^{PB}$ of $(L^{PA}/L^{PB})m$ is $L^{PA}$, and at least one $L^{PA}/L^{PB}$ of $(L^{PA}/L^{PB})m$ is $L^{PB}$. In some embodiments, each $L^{PA}/L^{PB}$ of $(L^{PA}/L^{PB})m$ is $L^{PB}$. In some embodiments, a sugar bonded to a $L^{PO}$ linkage at its 3'-carbon comprises a 2'-modification, wherein the 2'-modification is not 2'-F. In some embodiments, a sugar bonded to a $L^{PO}$ linkage at its 3'-carbon is independently

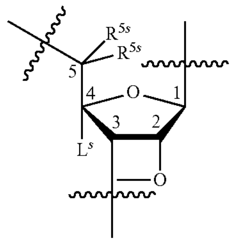

or

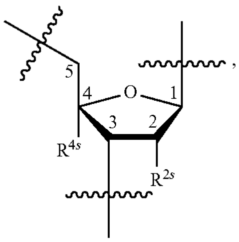

, wherein $R^{2s}$ is not —H or —OH. In some embodiments, each sugar bonded to a $L^{PO}$ linkage at its 3'-carbon is independently

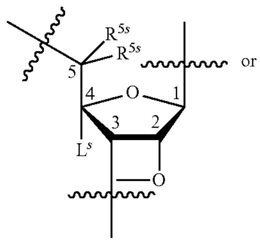

or

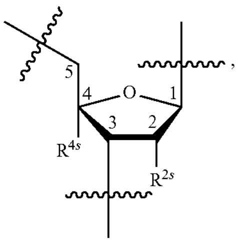

, wherein $R^{2s}$ is not —H or —OH. In some embodiments, each sugar bonded to a $L^{PO}$ linkage at its 3'-carbon is independently

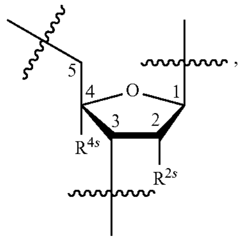

, wherein $R^{2s}$ is not —H or —OH. In some embodiments, $R^{4s}$ is —H. In some embodiments, $R^{2s}$ is not —H, —For —OH. In some embodiments, each sugar bonded to a $L^{PO}$ linkage at its 3'-carbon is independently

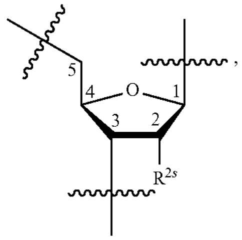

, wherein $R^{2s}$ is not —H, —F or —OH. In some embodiments, $R^{2s}$ is —OR, wherein R is optionally substituted $C_{1-6}$ aliphatic. In some embodiments, R is optionally substituted $C_{1-6}$ alkyl. In some embodiments, $R^{2s}$ is —OMe. In some embodiments, a 5'-end sugar, a 3'-end sugar, and/or a sugar between $L^{PA}/L^{PB}$ and $L^{PA}/L^{PB}$ comprises a 2'-F modification. In some embodiments, a 5'-end sugar, a 3'-end sugar, and/or a sugar between $L^{PA}/L^{PB}$ and $L^{PA}/L^{PB}$ is

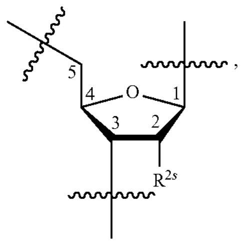

, wherein $R^{2s}$ is —F. In some embodiments, each sugar comprises a 2'-F is bonded to a modified internucleotidic linkage, e.g., at its 3'-carbon. In some embodiments, a modified internucleotidic linkage is $L^{PA}$ or $L^{PB}$. In some embodiments, each $L^{PA}$ is independently

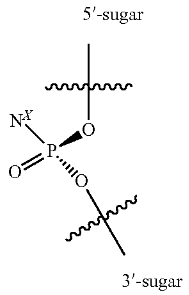

or

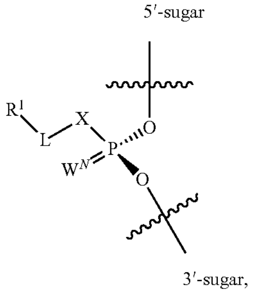

or a salt form thereof. In some embodiments, each $L^{PB}$ is independently

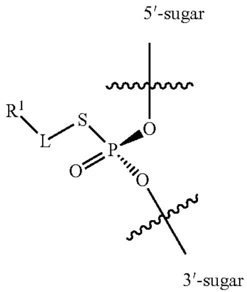

or

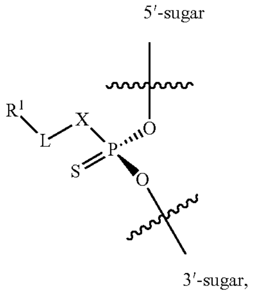

or a salt form thereof. In some embodiments, t is 2-10. In some embodiments, each $L^{PA}$ is independently

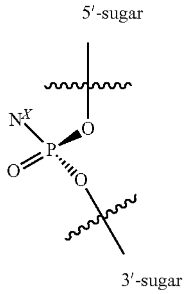

or a salt form thereof, and each $L^{PB}$ is independently

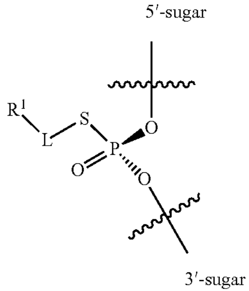

or a salt form thereof. In some embodiments, each modified internucleotidic linkage in a provided oligonucleotide is independently $L^{PO}$(wherein —X-L-$R^1$ is not —H),

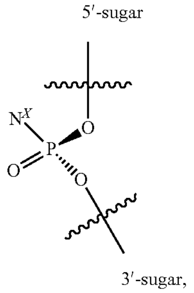

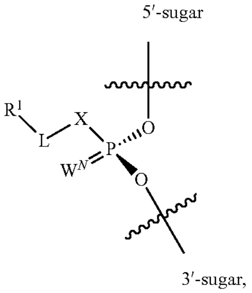

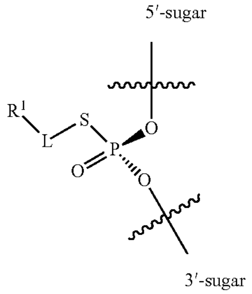

or

-continued

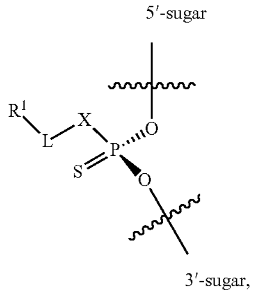

or a salt form thereof. In some embodiments, each modified internucleotidic linkage is independently

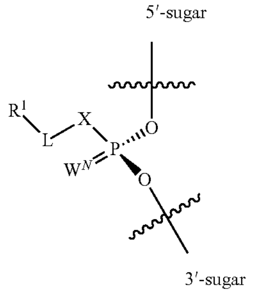

or

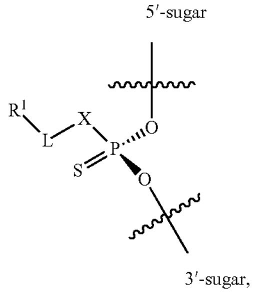

or a salt form thereof. In some embodiments, each modified internucleotidic linkage is independently

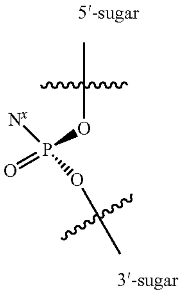

or

-continued

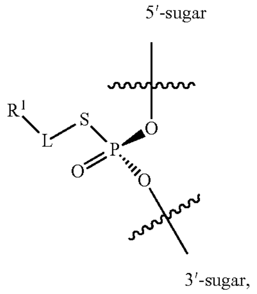

or a salt form thereof. In some embodiments, m is 1. In some embodiments, each m is 1. In some embodiments, n is 2 or more. In some embodiments, each n is 2 or more. In some embodiments, t is 1. In some embodiments, t is 2 or more. In some embodiments, t is 3. In some embodiments, t is 4. In some embodiments, t is 5. In some embodiments, t is 6. In some embodiments, t is 7. In some embodiments, t is 8. In some embodiments, t is 9. In some embodiments, t is 10. In some embodiments, each t is independently 2 or more. In some embodiments, each t is independently 3 or more. In some embodiments, each t is independently 4 or more. In some embodiments, each t is independently 5 or more.

In some embodiments, each of $L^{PO}$, $L^{PA}$ and $L^{PB}$ independently bonds to a 5'-sugar through its 3'-carbon, and to a 3'-sugar through its 5'-carbon, e.g., each $L^{PA}$ is independently an internucleotidic linkage having the structure of

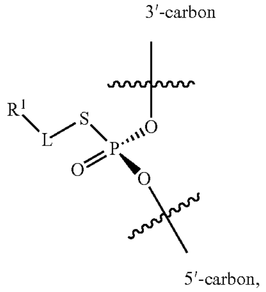

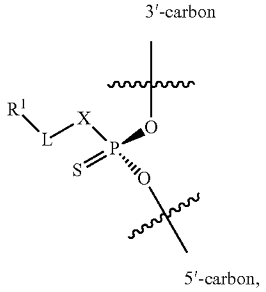

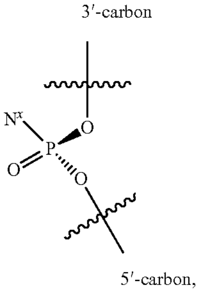

or

-continued

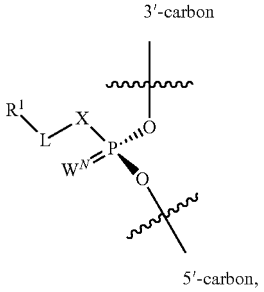

or a salt form thereof; each $L^{PB}$ is independently an internucleotidic linkage having the structure of

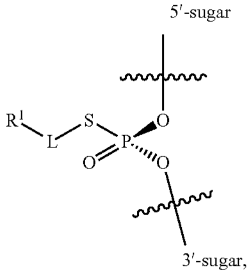

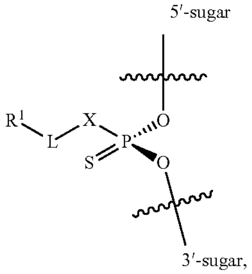

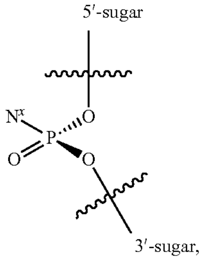

or

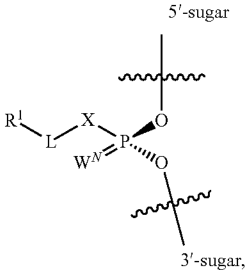

or a salt form thereof. Example sugar structures are described herein, e.g., in some embodiments, each sugar moiety independently has the structure of

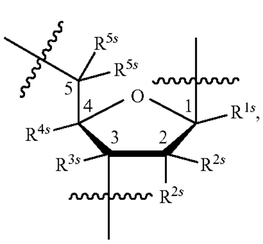

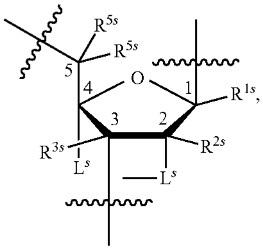

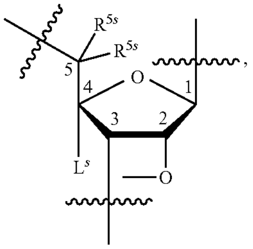

-continued

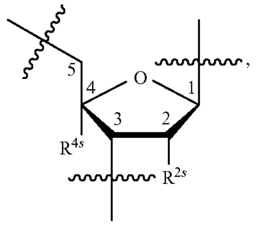

, or

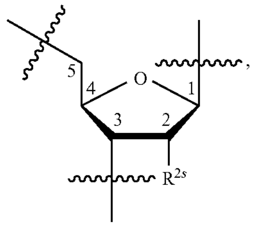

wherein each variable is independently as described in the present disclosure.

In some embodiments, $L^{PO}$ has a pattern, location, number, percentage, etc. as described herein for a natural phosphate linkage. In some embodiments, $L^{PA}$ has a pattern, location, number, percentage, etc. as described herein for a Rp internucleotidic linkage. In some embodiments, a Rp internucleotidic linkage is a Rp phosphorothioate internucleotidic linkage. In some embodiments, a Rp internucleotidic linkage is a Rp non-negatively charged internucleotidic linkage (e.g., n001). In some embodiments, $L^{PB}$ has a pattern, location, number, percentage, etc. as described herein for a Sp internucleotidic linkage. In some embodiments, a Sp internucleotidic linkage is a Sp phosphorothioate internucleotidic linkage. In some embodiments, a Sp internucleotidic linkage is a Sp non-negatively charged internucleotidic linkage (e.g., n001).

In some embodiments, the present disclosure provides an oligonucleotide, wherein the first internucleotidic linkage from the 5'-end is an internucleotidic linkage of $O^{5P}$, and each other internucleotidic linkage is independently selected from $O^P$, $*^{PD}$, $*^{PD}S$, $*^{PD}R$, $*^N$, $*^NS$ and $*^NR$, wherein:

$O^{5P}$ is

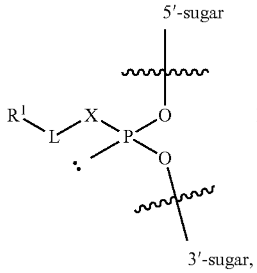

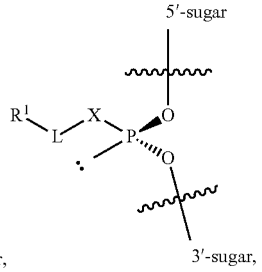

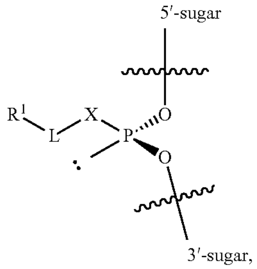

$L^{PO}$, $L^{PA}$, $L^{PB}$, or a salt form thereof;

each $O^{P}$ is independently $L^{PO}$;

each $*^{PD}$ is independently

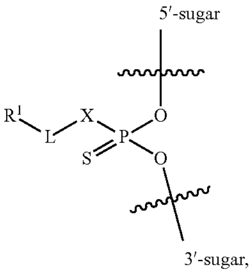

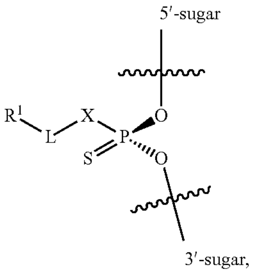

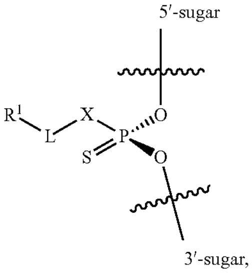

or a salt form thereof;

each $*^{PD}$S is independently

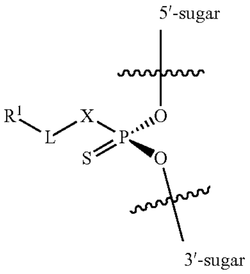

or a salt form thereof;

each $*^{PD}$R is independently

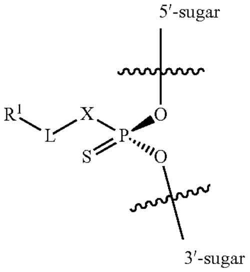

or a salt form thereof;

each $*^{N}$ is independently

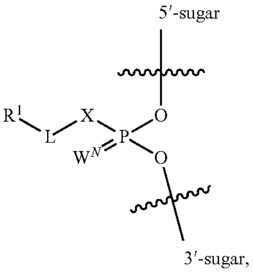

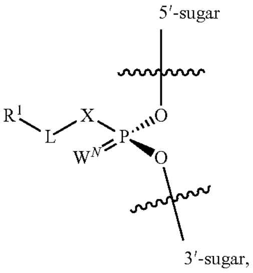

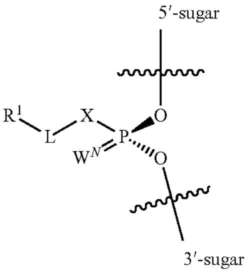

or a salt form thereof;

each $*^{N}$S is independently

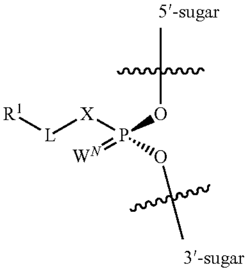

or a salt form thereof; and each $*^{N}$R is independently

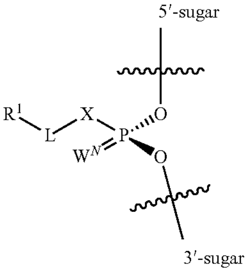

or a salt form thereof;

wherein each variable in independently as described herein, wherein —X-L-$R^1$ is not —OH.

In some embodiments, $O^{5P}$ is independently

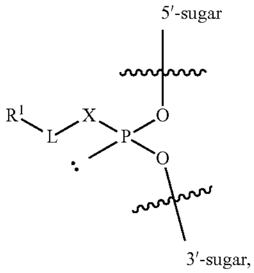

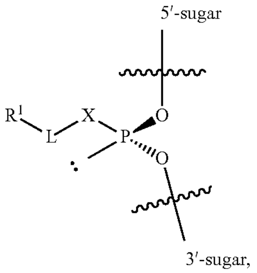

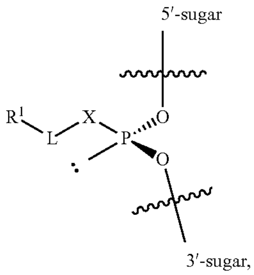

$L^{PO}$, $L^{PA}$, $L^{PB}$, or a salt form thereof. In some embodiments, each $O^{P}$ is independently $L^{PO}$. In some embodiments, each $*^{PD}$ is independently

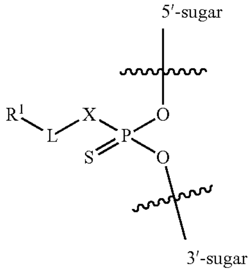

or a salt form thereof. In some embodiments, each $*^{PD}S$ is independently

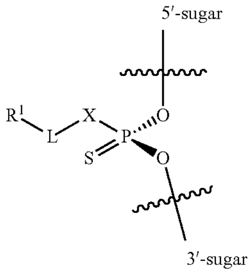

or a salt form thereof. In some embodiments, each $*^{PD}R$ is independently

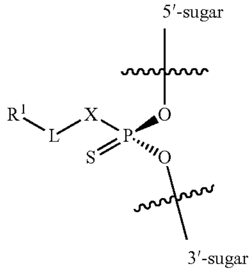

or a salt form thereof. In some embodiments, each $*^{N}$ is independently

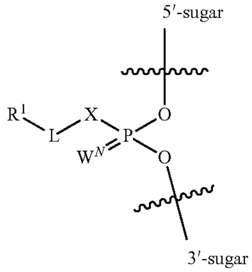

or a salt form thereof. In some embodiments, each $*^{N}S$ is independently

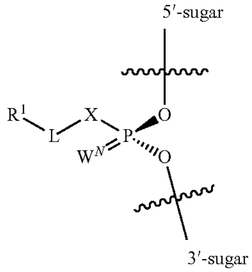

or a salt form thereof. In some embodiments, each $*^{N}R$ is independently

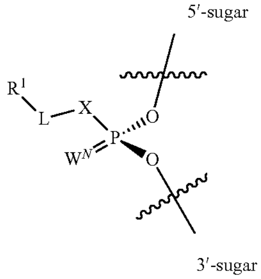

or a salt form thereof.

In some embodiments, X is —O—. In some embodiments, $-L-R^1$ contains an electron-withdrawing group. In some embodiments, $-L-R^1$ is $—CH_2G^2$, wherein the methylene unit is optionally substituted. In some embodiments, $-L-R^1$ is —CH(R') $G^2$. In some embodiments, $G^2$ does not comprise a chiral element, and $G^2$ comprises an electron-withdrawing group as described herein, e.g., in some embodiments, $G^2$ is —$CH_2CN$ (e.g., in $O^{5P}$, $O^P$, $*^{PD}$, or $*^N$, wherein linkage phosphorus is not chirally controlled). In some embodiments, $G^2$ comprises a chiral element, e.g., wherein linkage phosphorus is chirally controlled. In some embodiments, —X-L-$R^1$ is of such a structure that H—X-L-$R^1$ is a chiral reagent described herein, or a capped chiral reagent described herein wherein an amino group of the chiral reagent (typically of —$W^1$—H or —$W^2$—H, which comprises an amino group —$NHG^5$-) is capped, e.g., with —C(O)R' (replacing a —H, e.g., —N[—C(O)R']$G^5$-). In some embodiments, —X-L-$R^1$ is

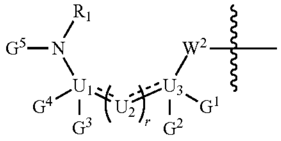
,

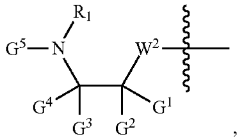
,
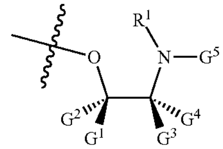
,

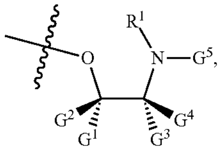

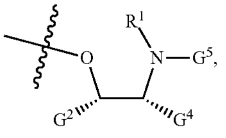

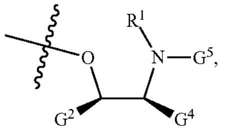

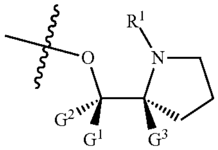
,
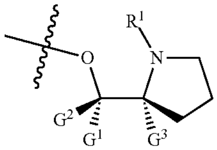
,

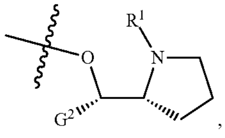
, or
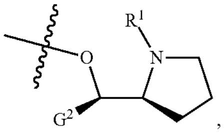
, wherein each variable is independently in accordance with the present disclosure. In some embodiments, —X-L-$R^1$ is

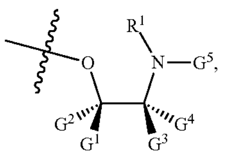

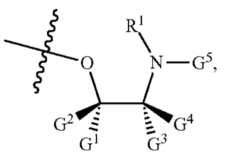

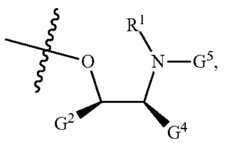

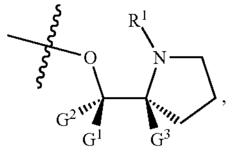
,

-continued

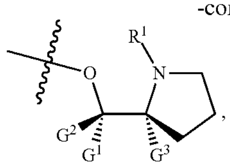
,
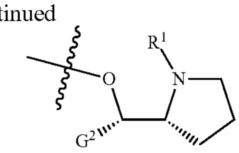
, or

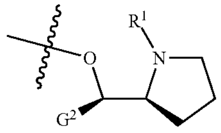
, wherein each variable is independently in accordance with the present disclosure. In some embodiments, $R^1$ is —H or —C(O)R'. In some embodiments, wherein $R^1$ is —H, e.g., in $O^{5P}$. In some embodiments, $R^1$ is —C(O)R' (e.g., in $O^{5P}$, $O^P$, $*^{PD}S$, $*^{PD}R$, $*^NS$, $*^NR$, etc.). In some embodiments, $R^1$ is $CH_3C(O)$—. In some embodiments, as described herein, $G^2$ is In some embodiments, $G^2$ is —$C(R)_2Si(R)_3$, wherein-$C(R)_2$— is optionally substituted —$CH_2$—, and each R of —$Si(R)_3$ is independently an optionally substituted group selected from $C_{1-10}$ aliphatic, heterocyclyl, heteroaryl and aryl. In some embodiments, $G^2$ is —$CH_2Si(Me)(Ph)_2$. In some embodiments, e.g., in $*^{PD}S$, $*^{PD}R$, etc., $G^2$ is —$CH_2Si(Me)(Ph)_2$. In some embodiments, $G^2$ comprises an electron-withdrawing group as described herein. In some embodiments, $G^2$ is —$C(R)_2SO_2R'$, wherein —$C(R)_2$— is optionally substituted —$CH_2$—, and R' is an optionally substituted group selected from $C_{1-10}$ aliphatic, heterocyclyl, heteroaryl and aryl. In some embodiments, R' is phenyl. In some embodiments, e.g., in $*^NS$, $*^NR$, etc., $G^2$ is —$CH_2SO_2Ph$.

In some embodiments, the present disclosure provides an oligonucleotide ("a first oligonucleotide"), which has an identical structure as an oligonucleotide described in a Table herein or an oligonucleotide described in e.g., US20150211006, US20170037399, US20180216107, US 20180216108, US20190008986, WO 2017/015555, WO 2017/015575, WO 2017/062862, WO 2017/160741, WO 2017/192664, WO 2017/192679, WO 2017/210647, WO 2018/022473, WO 2018/067973, WO 2018/098264, WO 2018/223056, WO 2018/223073, WO 2018/223081, WO 2018/237194, WO 2019/032607, WO 2019/032612, etc., the oligonucleotide of each of which is incorporated herein by reference ("a second oligonucleotide"), which second oligonucleotide comprises modified internucleotidic linkages, except that compared to the second oligonucleotide, in the first oligonucleotide:

- the first internucleotidic linkage from the 5'-end is an internucleotidic linkage of $O^{5P}$; and for the rest linkages:
- at each location where there is a phosphate linkage in the second oligonucleotide, there is independently a linkage of $O^P$ in the first oligonucleotide;
- at each location where there is a stereorandom phosphorothioate linkages in the second oligonucleotide, there is independently a linkage of $*^{PD}$ in the first oligonucleotide;
- at each location where there is a Sp phosphorothioate linkage in the second oligonucleotide, there is independently a linkage of $*^{PD}S$ in the first oligonucleotide;
- at each location where there is a Rp phosphorothioate linkage in the second oligonucleotide, there is independently a linkage of $*^{PD}R$ in the first oligonucleotide;
- at each location where there is a stereorandom non-negatively charged internucleotidic linkage in the second oligonucleotide, there is independently a linkage of $*^N$ in the first oligonucleotide;

at each location where there is a Sp non-negatively charged internucleotidic linkage in the second oligonucleotide, there is independently a linkage of $*^N$S in the first oligonucleotide;

at each location where there is a Rp non-negatively charged internucleotidic linkage in the second oligonucleotide, there is independently a linkage of $*^N$R in the first oligonucleotide, and each nucleobase in the first oligonucleotide is optionally and independently protected (e.g., as in oligonucleotide synthesis), and each additional chemical moiety, if any, in the first oligonucleotide is optionally and independently protected (e.g., —OH in a carbohydrate moiety protected as —OAc).

In some embodiments, at each location where there is a phosphate linkage in the second oligonucleotide, there is independently a linkage of $O^P$ in the first oligonucleotide; at each location where there is a stereorandom phosphorothioate linkages in the second oligonucleotide, there is independently a linkage of $*^{PD}$ in the first oligonucleotide; at each location where there is a Sp phosphorothioate linkage in the second oligonucleotide, there is independently a linkage of $*^{PD}$S in the first oligonucleotide; at each location there is a Rp phosphorothioate linkage in the second oligonucleotide, there is independently a linkage of $*^{PD}$R in the first oligonucleotide; at each location there is a stereorandom non-negatively charged internucleotidic linkage in the second oligonucleotide, there is independently a linkage of $*^N$ in the first oligonucleotide; at each location there is a Sp non-negatively charged internucleotidic linkage in the second oligonucleotide, there is independently a linkage of $*^N$S in the first oligonucleotide; at each location there is a Rp non-negatively charged internucleotidic linkage in the second oligonucleotide, there is independently a linkage of $*^N$R in the first oligonucleotide, and each nucleobase in the first oligonucleotide is optionally and independently protected (e.g., as in oligonucleotide synthesis), and each additional chemical moiety, if any, in the first oligonucleotide is optionally and independently protected (e.g., —OH in a carbohydrate moiety protected as —OAc); wherein each of $O^{5P}$, $O^P$, $*^{PD}$, $*^{PD}$S, $*^{PD}$R, $*^N$, $*^N$S and $*^N$R is independently as described herein. In some embodiments, such an oligonucleotide is linked to a support optionally through a linker, e.g., a CNA linker to CPG. In some embodiments, as appreciated by those skilled in the art, after a removal process of —X-L-$R^1$, a linkage of $O^{5P}$, $O^P$, $*^{PD}$, $*^{PD}$S, $*^{PD}$R, $*^N$, $*^N$S or $*^N$R becomes a linkage it replaces. In some embodiments, such oligonucleotides (e.g., first oligonucleotides) are useful intermediates for preparing their corresponding oligonucleotides (e.g., second oligonucleotides). In some embodiments, the present disclosure provides chirally controlled oligonucleotide composition of a provided first oligonucleotide or a stereoisomer thereof.

In some embodiments, as appreciated by those skilled in the art, $W^N$ is of such a structure that its N-moiety has the same non-hydrogen atoms and connections of non-hydrogen atoms as the N-moiety of the non-negatively charged internucleotidic linkage it replaces (without considering single, double, or triple bond etc.). For example, in some embodiments, $P^N$ in $*^N$ is

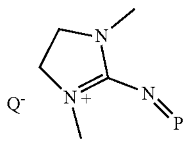

(such a $*^N$ is $n001^P$), and its corresponding non-negatively charged internucleotidic linkage is n001.

In some embodiments, a provided oligonucleotide has the same "Description" as an oligonucleotide listed in a Table herein (e.g., Table A1), except that:

the oligonucleotide comprises at least one linkage of $O^P$, and/or at each location in the oligonucleotide where there is a phosphate linkage, there is independently a linkage of $O^P$, wherein $O^P$ is

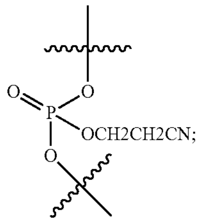

at each location where there is a stereorandom phosphorothioate linkages, there is independently a linkage of $*^{PD}$, wherein $*^{PD}$ is

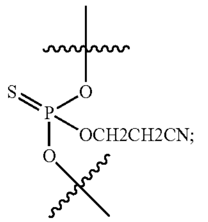

at each location where there is a Sp phosphorothioate linkage, there is independently a linkage of $*^{PD}$S, wherein $*^{PD}$S is

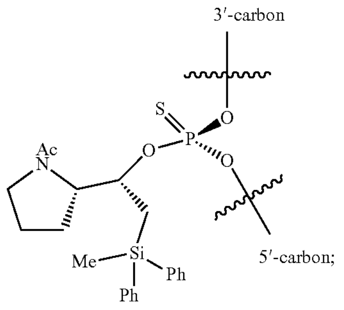

at each location where there is a Rp phosphorothioate linkage, there is independently a linkage of $*^{PD}$R, wherein $*^{PD}$R is

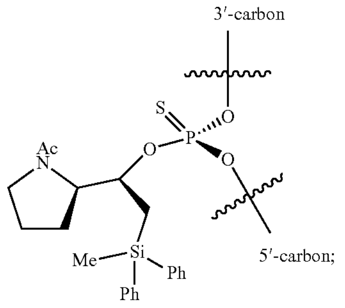

at each location where there is a stereorandom n001, there is independently a linkage of $*^N$ wherein $*^N$ is

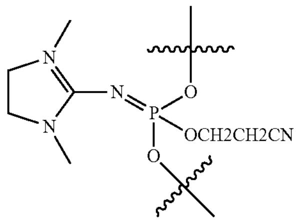

(as appreciated by those skilled in the art, it is associated with an anion (e.g., $Q^-$ such as $PF_6^-$ (which can be an anion in a modification step)));

at each location where there is a Sp n001, there is independently a linkage of $*^N$S, wherein $*^N$S is

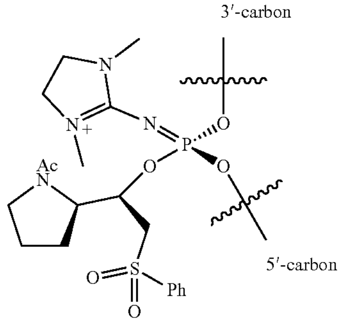

(as appreciated by those skilled in the art, it is associated with an anion (e.g., $Q^-$ such as $PF_6^-$ (which can be an anion in a modification step))); and at each location where there is a Rp n001, there is independently a linkage of $*^N$R, wherein $*^N$R is

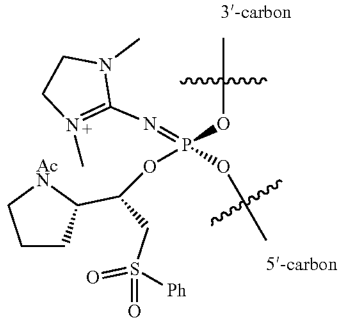

(as appreciated by those skilled in the art, it is associated with an anion (e.g., $Q^-$ such as $PF_6^-$ (which can be an anion in a modification step))); and the oligonucleotide is optionally connected to a solid support, optionally through a linker.

In some embodiments, the oligonucleotide is connected to a solid support, e.g., CPG, polystyrene support, etc. In some embodiments, the oligonucleotide is connected to a solid support through a linker, e.g., a CNA linker. In some embodiments, such an oligonucleotide is an oligonucleotide of formula O-I or a salt form thereof.

Certain Embodiments of Stereochemistry and Pattern of Backbone Chiral Centers

Among other things, the present disclosure provides oligonucleotides comprising one or more chirally controlled internucleotidic linkages. In some embodiments, the present disclosure provides chirally controlled oligonucleotide compositions. In some embodiments, each chiral linkage phosphorus of provided oligonucleotides is independently chirally controlled (stereocontrolled) (e.g., each independently having a stereopurity (diastereopurity) of at least 80%, 85%, 90%, 95%, 96%, 97%, 98%, or 99% (e.g., as typically assessed using an appropriate dimer comprising an internucleotidic linkage containing the linkage phosphorus, and the two nucleoside units being linked by the internucleotidic linkage)). In some embodiments, a stereopurity is at least 90%. In some embodiments, a stereopurity is at least 95%. In some embodiments, a stereopurity is at least 96%. In some embodiments, a stereopurity is at least 97%. In some embodiments, a stereopurity is at least 98%. In some embodiments, a stereopurity is at least 99%. With the capability to fully control stereochemistry and other modifications (e.g., base modifications, sugar modifications, internucleotidic linkage modifications, etc.), the present disclosure provides technologies of improved properties and/or activities compared to corresponding non-chirally controlled technologies.

In some embodiments, pattern of backbone chiral centers of a region, particularly a core region or a middle region, or of an oligonucleotide (e.g., an oligonucleotide of a plurality of oligonucleotides) is or comprises (Np/Op)t[(Rp)n(Sp)m]y, (Np/Op)t[(Op)n(Sp)m]y, (Np/Op)t[(Op/Rp)n(Sp)m]y, (Sp)t[(Rp)n(Sp)m]y, (Sp)t[(Op)n(Sp)m]y, (Sp)t[(Op/Rp)n(Sp)m]y, [(Rp)n(Sp)m]y, [(Op)n(Sp)m]y, [(Op/Rp)n(Sp)m]y, (Rp)t(Np)n(Rp)m, (Rp)t(Sp)n(Rp)m, (Rp)t[(Np/Op)n]y(Rp)m, (Rp)t[(Sp/Np)n]y(Rp)m, (Rp)t[(Sp/Op)n]y(Rp)m, (Np/Op)t(Np)n(Np/Op)m, (Np/Op)t(Sp)n(Np/Op)m, (Np/Op)t[(Np/Op)n]y(Np/Op)m, (Np/Op)t[(Sp/Op)n]y(Np/Op)m, (Np/Op)t[(Sp/Op)n]y(Np/Op)m, (Rp/Op)t(Np)n(Rp/Op)m, (Rp/Op)t(Sp)n(Rp/Op)m, (Rp/Op)t[(Np/Op)n]y(Rp/Op)m, (Rp/Op)t[(Sp/Op)n]y(Rp/Op)m, or (Rp/Op)t[(Sp/Op)n]y(Rp/Op) m (unless otherwise specified, description of patterns of modifications and stereochemistry are from 5' to 3' as typically used in the art), wherein Sp indicates S configuration of a chiral linkage phosphorus of a chiral modified internucleotidic linkage, Rp indicates R configuration of a chiral linkage phosphorus of a chiral modified internucleotidic linkage, Op indicates an achiral linkage phosphorus of a natural phosphate linkage, each Np is independently Rp, or Sp, and each of m, n, t and y is independently 1-50 as described in the present disclosure. In some embodiments, a pattern of backbone chiral centers is or comprises [(Rp/Op)n(Sp)m]y. In some embodiments, a pattern of backbone chiral centers is or comprises [(Rp)n(Sp)m]y. In some embodiments, a pattern of backbone chiral centers is or comprises [(Op)n(Sp)m]y. In some embodiments, a pattern of backbone chiral centers is or comprises (Np/Op)t[(Rp/Op)n(Sp)m]y. In some embodiments, a pattern of backbone chiral centers is or comprises (Np/Op)t[(Rp)n(Sp)m]y. In some embodiments, a pattern of backbone chiral centers is or comprises (Np/Op)t[(Op)n(Sp)m]y. In some embodiments, a pattern of backbone chiral centers is or comprises (Sp)t[(Rp/Op)n(Sp)m]y. In some embodiments, a pattern of backbone chiral centers is or comprises (Sp)t[(Rp)n(Sp)m]y. In some embodiments, a pattern of backbone chiral centers is or comprises (Sp)t[(Op)n(Sp)m]y. In some embodiments, a pattern of backbone chiral centers is or comprises (Rp)t(Np)n(Rp)m. In some embodiments, a pattern of backbone chiral centers is or comprises (Rp)t(Sp)n(Rp)m. In some embodiments, a pattern of backbone chiral centers is or comprises (Rp)t[(Np/Op)n]y(Rp)m. In some embodiments, a pattern of backbone chiral centers is or comprises (Rp)t[(Sp/Np)n]y(Rp)m. In some embodiments, a pattern of backbone chiral centers is or comprises (Rp)t[(Sp/Op)n]y(Rp)m. In some embodiments, a pattern of backbone chiral centers is or comprises (Np/Op)t(Np)n(Np/Op)m. In some embodiments, a pattern of backbone chiral centers is or comprises (Np/Op)t(Sp)n(Np/Op)m. In some embodiments, a pattern of backbone chiral centers is or comprises (Np/Op)t[(Np/Op)n]y(Np/Op)m. In some embodiments, a pattern of backbone chiral centers is or comprises (Np/Op)t[(Sp/Op)n]y(Np/Op)m. In some embodiments, a pattern of backbone chiral centers is or comprises (Np/Op)t[(Sp/Op)n]y(Np/Op)m. In some embodiments, a pattern of backbone chiral centers is or comprises (Rp/Op)t(Np)n(Rp/Op)m. In some embodiments, a pattern of backbone chiral centers is or comprises (Rp/Op)t(Sp)n(Rp/Op)m. In some embodiments, a pattern of backbone chiral centers is or comprises (Rp/Op)t[(Np/Op)n]y(Rp/Op)m. In some embodiments, a pattern of backbone chiral centers is or comprises (Rp/Op)t[(Sp/Op)n]y(Rp/Op)m. In some embodiments, a pattern of backbone chiral centers is or comprises (Rp) (Rp/Op)t[(Sp/Op)n]y(Rp/Op)m(Rp). In some embodiments, n is 1. For example, in some embodiments, a pattern of backbone chiral centers is or comprises (Sp)t[Op(Sp)m]y; in some embodiments, a pattern of backbone chiral centers is or comprises (Sp)t[Rp(Sp)m]y. In some embodiments, y is 1. In some embodiments, m is 2 or more. In some embodiments, t is 1, 2, 3, 4, 5, 6, 7, 8, 9, or 10, n is 1, and m is 1, 2, 3, 4, 5, 6, 7, 8, 9, or 10. In some embodiments, t is 1, 2, 3, 4, 5, 6, 7, 8, 9, or 10, n is 1, and m is 2, 3, 4, 5, 6, 7, 8, 9, or 10. In some embodiments, there are at least 1, 2, 3, 4, 5, 6, 7, 8, 9, 10 internucleotidic linkages preceding, and there are at least 1, 2, 3, 4, 5, 6, 7, 8, 9, 10 internucleotidic linkages after the Rp or Op. In some embodiments, there are at least 2 internucleotidic linkages preceding and/or following. In some embodiments, there are at least 3 internucleotidic linkages preceding and/or following. In some embodiments, there are at least 4 internucleotidic linkages preceding and/or following. In some embodiments, there are at least 5 internucleotidic linkages preceding and/or following. In some embodiments, there are at least 6 internucleotidic linkages preceding and/or following. In some embodiments, there are at least 7 internucleotidic linkages preceding and/or following. In some embodiments, there are at least 8 internucleotidic linkages preceding and/or following. In some embodiments, there are at least 9 internucleotidic linkages preceding and/or following. In some embodiments, there are at least 10 internucleotidic linkages preceding and/or following. In some embodiments, y is 1. In some embodiments, y is 2 or more. In some embodiments, y is 2, 3, 4, or 5. In some embodiments, y is 2. In some embodiments, y is 3. In some embodiments, y is 4. In some embodiments, y is 5. In some embodiments, a region having such a pattern of backbone chiral centers contains no 2'-modifications on its sugar moieties, wherein the 2'-modification is 2'-$OR^1$ or 2'-O-L-, wherein $R^1$ is not hydrogen and L comprises a carbon atom and connects to another carbon atom of the sugar moiety. In some embodiments, each sugar moiety of a region having such a pattern of backbone chiral centers is independently a natural DNA sugar moiety

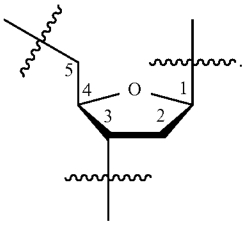

(

As appreciated by a person having ordinary skill in the art, for a natural DNA sugar moiety in natural DNA, C1 is connected to a base, C3 and C5 are each independently connected to internucleotidic linkages or —OH (when at the 5'- or 3'-end)). Certain benefits/advantages provided by such patterns of backbone chiral centers are described in US20170037399, WO 2017/015555, and WO 2017/062862.

In some embodiments, y, t, n and m each are independently 1-20 as described in the present disclosure. In some embodiments, y is 1. In some embodiments, y is at least 2, 3, 4, 5, 6, 7, 8, 9, 10, 11, 12, 13, 14, or 15. In some embodiments, y is 2, 3, 4, 5, 6, 7, 8, 9, 10, 11, 12, 13, 14, or 15. In some embodiments, y is 1, 2, 3, 4, 5, 6, 7, 8, 9, or 10. In some embodiments, y is 1. In some embodiments, y is 2. In some embodiments, y is 3. In some embodiments, y is 4. In some embodiments, y is 5. In some embodiments, y is 6. In some embodiments, y is 7. In some embodiments, y is 8. In some embodiments, y is 9. In some embodiments, y is 10.

In some embodiments, n is 1. In some embodiments, n is at least 2, 3, 4, 5, 6, 7, 8, 9, 10, 11, 12, 13, 14, or 15. In some embodiments, n is 2, 3, 4, 5, 6, 7, 8, 9, 10, 11, 12, 13, 14, or 15. In some embodiments, n is 1-10. In some embodiments, n is 1, 2, 3, 4, 5, 6, 7 or 8. In some embodiments, n is 1. In some embodiments, n is 2, 3, 4, 5, 6, 7 or 8. In some embodiments, n is 3, 4, 5, 6, 7 or 8. In some embodiments, n is 4, 5, 6, 7 or 8. In some embodiments, n is 5, 6, 7 or 8. In some embodiments, n is 6, 7 or 8. In some embodiments, n is 7 or 8. In some embodiments, n is 1. In some embodiments, n is 2. In some embodiments, n is 3. In some embodiments, n is 4. In some embodiments, n is 5. In some embodiments, n is 6. In some embodiments, n is 7. In some embodiments, n is 8. In some embodiments, n is 9. In some embodiments, n is 10.

In some embodiments, m is 0-50. In some embodiments, m is 1-50. In some embodiments, m is 1. In some embodiments, m is 2-50. In some embodiments, m is at least 2, 3, 4, 5, 6, 7, 8, 9, 10, 11, 12, 13, 14, or 15. In some embodiments, m is 2, 3, 4, 5, 6, 7 or 8. In some embodiments, m is 3, 4, 5, 6, 7 or 8. In some embodiments, m is 4, 5, 6, 7 or 8. In some embodiments, m is 5, 6, 7 or 8. In some embodiments, m is 6, 7 or 8. In some embodiments, m is 7 or 8. In some embodiments, m is 0. In some embodiments, m is 1. In some embodiments, m is 2. In some embodiments, m is 3. In some embodiments, m is 4. In some embodiments, m is 5. In some embodiments, m is 6. In some embodiments, m is 7. In some embodiments, m is 8. In some embodiments, m is 9. In some embodiments, m is 10. In some embodiments, m is 11. In some embodiments, m is 12. In some embodiments, m is 13. In some embodiments, m is 14. In some embodiments, m is 15. In some embodiments, m is 16. In some embodiments, m is 17. In some embodiments, m is 18. In some embodiments, m is 19. In some embodiments, m is 20. In some embodiments, m is 21. In some embodiments, m is 22. In some embodiments, m is 23. In some embodiments, m is 24. In some embodiments, m is 25. In some embodiments, m is at least 2. In some embodiments, m is at least 3. In some embodiments, m is at least 4. In some embodiments, m is at least 5. In some embodiments, m is at least 6. In some embodiments, m is at least 7. In some embodiments, m is at least 8. In some embodiments, m is at least 9. In some embodiments, m is at least 10. In some embodiments, m is at least 11. In some embodiments, m is at least 12. In some embodiments, m is at least 13. In some embodiments, m is at least 14. In some embodiments, m is at least 15. In some embodiments, m is at least 16. In some embodiments, m is at least 17. In some embodiments, m is at least 18. In some embodiments, m is at least 19. In some embodiments, m is at least 20. In some embodiments, m is at least 21. In some embodiments, m is at least 22. In some embodiments, m is at least 23. In some embodiments, m is at least 24. In some embodiments, m is at least 25. In some embodiments, m is at least greater than 25.

In some embodiments, t is 1-20. In some embodiments, tis 1. In some embodiments, t is at least 2, 3, 4, 5, 6, 7, 8, 9, 10, 11, 12, 13, 14, or 15. In some embodiments, t is 2, 3, 4, 5, 6, 7, 8, 9, 10, 11, 12, 13, 14, or 15. In some embodiments, t is 1-5. In some embodiments, t is 2. In some embodiments, t is 3. In some embodiments, t is 4. In some embodiments, t is 5. In some embodiments, t is 6. In some embodiments, t is 7. In some embodiments, t is 8. In some embodiments, t is 9. In some embodiments, t is 10. In some embodiments, t is 11. In some embodiments, t is 12. In some embodiments, t is 13. In some embodiments, t is 14. In some embodiments, t is 15. In some embodiments, t is 16. In some embodiments, t is 17. In some embodiments, t is 18. In some embodiments, t is 19. In some embodiments, t is 20.

In some embodiments, each of t and m is independently at least 2, 3, 4, 5, 6, 7, 8, 9, 10, 11, 12, 13, 14, or 15. In some embodiments, each of t and m is independently at least 3. In some embodiments, each of t and m is independently at least 4. In some embodiments, each of t and m is independently at least 5. In some embodiments, each of t and m is independently at least 6. In some embodiments, each of t and m is independently at least 7. In some embodiments, each of t and m is independently at least 8. In some embodiments, each of t and m is independently at least 9. In some embodiments, each of t and m is independently at least 10.

In some embodiments, provided oligonucleotides comprises a block, e.g., a first block, a 5'-wing, etc., that has a pattern of backbone chiral centers of or comprising a t-section, e.g., (Sp)t, (Rp)t, (Np/Op)t, (Rp/Op)t, etc., a block, e.g., a second block, a core, etc., that has a pattern of backbone chiral centers of or comprising a y- or n-section, e.g., (Np)n, (Sp)n, [(Np/Op)n]y, [(Rp/Op)n]y, [(Sp/Op)n]y, etc., and a block, e.g., a third block, a 3'-wing, etc., that has a pattern of backbone chiral centers of or comprising a m-section, e.g., (Sp)m, (Rp)m, (Np/Op)m, (Rp/Op)m, etc.

In some embodiments, a t-, y-, n-, or m-section that comprises Np or Rp, e.g., (Rp)t, (Np/Op)t, (Rp/Op)t, (Np)n, [(Np/Op)n]y, [(Rp/Op)n]y, (Rp)m, (Np/Op)m, (Rp/Op)m, etc. independently comprises at least 10%, 20%, 30%, 40%, 50%, 60%, 70%, 75%, 80%, 85%, 90%, or 95%, or 100% Rp. In some embodiments, a t- or m-section that comprises Np or Rp independently comprises at least 10%, 20%, 30%, 40%, 50%, 60%, 70%, 75%, 80%, 85%, 90%, or 95%, or 100% Rp. In some embodiments, provided oligonucleotides comprise at least 10%, 20%, 30%, 40%, 50%, 60%, 70%, 75%, 80%, 85%, 90%, or 95%, or 100% Rp. In some embodiments, a percentage is at least 10%. In some embodiments, a percentage is at least 20%. In some embodiments, a percentage is at least 30%. In some embodiments, a percentage is at least 40%. In some embodiments, a percentage is at least 50%. In some embodiments, a percentage is at least 60%. In some embodiments, a percentage is at least 70%. In some embodiments, a percentage is at least 75%. In some embodiments, a percentage is at least 80%. In some embodiments, a percentage is at least 85%. In some embodiments, a percentage is at least 90%. In some embodiments, a percentage is at least 95%. In some embodiments, a percentage is 100%.

In some embodiments, each sugar moiety bonded to a Rp or Op linkage phosphorus at 3' independently comprises a modification. In some embodiments, each sugar moiety bonded to a Rp or Op linkage phosphorus at 5' independently comprises a modification. In some embodiments, each sugar moiety bonded to a Rp linkage phosphorus at 3' independently comprises a modification. In some embodiments, each sugar moiety bonded to a Rp linkage phosphorus at 5' independently comprises a modification. In some embodiments, each sugar moiety bonded to an Op linkage phosphorus at 3' independently comprises a modification. In some embodiments, each sugar moiety bonded to an Op linkage phosphorus at 5' independently comprises a modification. In some embodiments, each sugar moiety bonded to a Sp linkage phosphorus at 3' independently comprises a modification. In some embodiments, each sugar moiety bonded to a Sp linkage phosphorus at 5' independently comprises a modification. In some embodiments, each sugar moiety independently comprises a modification. In some embodiments, a modification is a 2'-modification. In some embodiments, a modification is 2'-OR, wherein R is not hydrogen. In some embodiments, a modification is 2'-OR, wherein R is optionally substituted $C_{1-6}$ alkyl. In some embodiments, a modification is 2'-OR, wherein R is substituted $C_{1-6}$ alkyl. In some embodiments, a modification is 2'-OR, wherein R is optionally substituted $C_{2-6}$ alkyl. In some embodiments, a modification is 2'-OR, wherein R is substituted $C_{2-6}$ alkyl. In some embodiments, R is —$CH_2CH_2OMe$. In some embodiments, a modification is or comprises -L- connecting two sugar carbons, e.g., those found in LNA. In some embodiments, a modification is -L- connecting $C_2$ and $C_4$ of a sugar moiety. In some embodiments, L is —$CH_2$—CH(R)—, wherein R is as described in the present disclosure. In some embodiments, L is —$CH_2$—CH(R)—, wherein R is as described in the present disclosure and is not hydrogen. In some embodiments, L is —$CH_2$—(R)—CH(R)—, wherein R is as described in the present disclosure and is not hydrogen. In some embodiments, L is —$CH_2$—(S)—CH(R)—, wherein R is as described in the present disclosure and is not hydrogen. In some embodiments, a block, a wing, a core, or an oligonucleotide has sugar modifications as described in the present disclosure.

In some embodiments, a provided pattern of backbone chiral centers is or comprises (Rp/Sp)-(All Rp or All Sp)-(Rp/Sp), wherein each Rp/Sp is independently Rp or Sp. In some embodiments, a provided pattern of backbone chiral centers is or comprises (Rp)-(All Sp)-(Rp). In some embodiments, a provided pattern of backbone chiral centers is or comprises (Sp)-(All Sp)-(Sp). In some embodiments, a provided pattern of backbone chiral centers is or comprises (Sp)-(All Rp)-(Sp). In some embodiments, a provided pattern of backbone chiral centers is or comprises (Rp/Sp)-(repeating (Sp)m(Rp)n)-(Rp/Sp). In some embodiments, a provided pattern of backbone chiral centers is or comprises (Rp/Sp)-(repeating SpSpRp)-(Rp/Sp).

Blocks

In some embodiments, provided oligonucleotides comprise one or more blocks, characterized by base modifications, sugar modifications, types of internucleotidic linkages, stereochemistry of linkage phosphorus, etc. In some embodiments, provided oligonucleotides comprises or are of a 5'-first block-second block-third block-3' structure. In some embodiments, a first block is a 5'-wing. In some embodiments, a first block is 5'-end region. In some embodiments, a second block is a core. In some embodiments, a second block is a middle region between a 5'-end and a 3'-end region. In some embodiments, a third block a 3'-wing. In some embodiments, a third block is a 3'-end region. Each of a 5'-wing, 5'-end region, core, middle region, 3'-wing, and 3'-end region can independently be a block.

In some embodiments, provided oligonucleotides comprises or are of a 5'-wing-core-wing-3', 5'-wing-core-3' or 5'-core-wing-3' structures. In some embodiments, a first block, a second block, a third block, a wing (e.g., a 5'-wing, a 3'-wing) and/or a core of provided oligonucleotides are each independently a block or comprise one or more blocks as described in the present disclosure.

Various blocks, 5'-wings, 3'-wings and cores can be utilized in accordance with the present disclosure, including those described in US20150211006, US20150211006, WO 2017015555, WO 2017015575, WO 2017062862, WO 2017160741, blocks, 5'-wings, 3'-wings and cores of each of which are incorporated herein by reference.

In some embodiments, a block is a linkage phosphorus stereochemistry block. For example, in some embodiments, a block comprises only Rp, Sp, or Op linkage phosphorus. In some embodiments, a block is a Rp block comprising only Rp linkage phosphorus. In some embodiments, a block is a Rp/Op block comprising only Rp/Op linkage phosphorus. In some embodiments, a block is a Sp/Op block comprising only Sp/Op linkage phosphorus. In some embodiments, a block is an Op block. In some embodiments, an oligonucleotide, or a region thereof (a first block, a second block, a third block, a wing, a core, etc.) comprises one or more of a Rp block, a Sp block and/or an Op block. In some embodiments, a block comprises one or more, e.g., 1, 2, 3, 4, 5, 6, 7, 8, 9, 10, 11, 12, 13, 14, 15, 16, 17, 18, 19, 20, or more, linkage phosphorus.

In some embodiments, a block is a sugar modification block. In some embodiments, a block is a 2'-modification block wherein each sugar moiety of the block independently comprises the 2'-modification. In some embodiments, a 2'-modification is 2'-OR wherein R is as described in the present disclosure. In some embodiments, a 2'-modification is a 2'-OR wherein R is not hydrogen. In some embodiments, a 2'-modification is 2'-OMe. In some embodiments, a 2'-modification is 2'-MOE. In some embodiments, a modification is a LNA modification. In some embodiments, an oligonucleotide, or a region thereof (a first block, a second block, a third block, a wing, a core, etc.) comprises one or more sugar modification blocks, each independently of its own sugar modification. In some embodiments, a block comprises one or more, e.g., 1, 2, 3, 4, 5, 6, 7, 8, 9, 10, 11, 12, 13, 14, 15, 16, 17, 18, 19, 20, or more, sugar moieties.

As illustrated herein, a block can be of various lengths. In some embodiments, a block is of 1-30, e.g., 1, 2, 3, 4, 5, 6, 7, 8, 9, 10, 11, 12, 13, 14, 15, 16, 17, 18, 19, or 20 nucleobases in length. In some embodiments, a 5'-first block-second-block-third block-3', or a 5'-wing-core-wing-3' is of 5-10-5, 3-10-4, 3-10-6, 4-12-4, etc.

In some embodiments, an oligonucleotide or a block or region thereof (e.g., a 5'-end region, a 5'-wing, a middle region, a core region, a 3'-end region, a 3'-ring, etc.) comprises one or more, e.g., 1, 2, 3, 4, 5, 6, 7, 8, 9, 10, 11, 12, 13, 14, 15, 16, 17, 18, 19, 20 or more, non-negatively charged internucleotidic linkages as described in the present disclosure. In some embodiments, a provided oligonucleotide comprises two or more, e.g., 2, 3, 4, 5, 6, 7, 8, 9, 10, 11, 12, 13, 14, 15, 16, 17, 18, 19, 20 or more, consecutive non-negatively charged internucleotidic linkages. In some embodiments, a block or region comprises two or more, e.g., 2, 3, 4, 5, 6, 7, 8, 9, 10, 11, 12, 13, 14, 15, 16, 17, 18, 19, 20 or more, consecutive non-negatively charged internucleotidic linkages. In some embodiments, the number is 1. In some embodiments, the number is 2. In some embodiments, the number is 3. In some embodiments, the number is 4. In some embodiments, the number is 5. In some embodiments, the number is 6. In some embodiments, the number is 7. In some embodiments, the number is 8. In some embodiments, the number is 9. In some embodiments, the number is 10 or more. In some embodiments, each internucleotidic linkage between nucleoside units in a block, e.g., a 5'-end region, a 5'-wing, is a non-negatively charged internucleotidic linkage except the first internucleotidic linkage between two nucleoside units of the block from the 5'-end of the block. In some embodiments, each internucleotidic linkage between nucleoside units in a block, e.g., a 3'-end region, a 3'-wing, is a non-negatively charged internucleotidic linkage except the first internucleotidic linkage between two nucleoside units of the block from the 3'-end of the block. In some embodiments, each internucleotidic linkage between nucleoside units in a region, e.g., a 5'-end region, a 5'-wing, is a non-negatively charged internucleotidic linkage except the first internucleotidic linkage between two nucleoside units of the region from the 5'-end of the region. In some embodiments, each internucleotidic linkage between nucleoside units in a region, e.g., a 3'-end region, a 3'-wing, is a non-negatively charged internucleotidic linkage except the first internucleotidic linkage between two nucleoside units of the region from the 3'-end of the region. In some embodiments, each internucleotidic linkage in a region or block, e.g., a 5'-end region, a 5'-wing, a middle region, a core region, a 3'-end region, a 3'-ring, etc., is independently a non-negatively charged internucleotidic linkage, a natural phosphate internucleotidic linkage or a Rp chiral internucleotidic linkage. In some embodiments, each internucleotidic linkage in a region or block is independently a non-negatively charged internucleotidic linkage, a natural phosphate internucleotidic linkage or a Rp phosphorothioate internucleotidic linkage. In some embodiments, about 40%, 45%, 50%, 55%, 60%, 65%, 70%, 75%, 80%, 85%, 90%, 95% or more of internucleotidic linkages of an oligonucleotide or a region or block, e.g., a 5'-end region, a 5'-wing, a middle region, a core region, a 3'-end region, a 3'-ring, etc., is independently a non-negatively charged internucleotidic linkage, a natural phosphate internucleotidic linkage or a Rp chiral internucleotidic linkage. In some embodiments, about 40%, 45%, 50%, 55%, 60%, 65%, 70%, 75%, 80%, 85%, 90%, 95% or more of internucleotidic linkages of an oligonucleotide or a region or block is independently a non-negatively charged internucleotidic linkage, a natural phosphate internucleotidic linkage or a Rp phosphorothioate internucleotidic linkage. In some embodiments, about 40%, 45%, 50%, 55%, 60%, 65%, 70%, 75%, 80%, 85%, 90%, 95% or more of internucleotidic linkages of an oligonucleotide or a region or block is independently a non-negatively charged internucleotidic linkage or a natural phosphate internucleotidic linkage. In some embodiments, about 40%, 45%, 50%, 55%, 60%, 65%, 70%, 75%, 80%, 85%, 90%, 95% or more of internucleotidic linkages of an oligonucleotide or a region or block is independently a non-negatively charged internucleotidic linkage. In some embodiments, the percentage is 45% or more. In some embodiments, the percentage is 50% or more. In some embodiments, the percentage is 60% or more. In some embodiments, the percentage is 70% or more. In some embodiments, the percentage is 80% or more. In some embodiments, the percentage is 90% or more. In some embodiments, a region or block is a wing. In some embodiments, a region or block is a 5'-wing. In some embodiments, a region or block is a 3'-wing. In some embodiments, a region or block is a core. As described herein, a region or block, e.g., a wing, a core, etc., can have various lengths, e.g., comprising 2, 3, 4, 5, 6, 7, 8, 9, 10, 11, 12, 13, 14, 15, 16, 17, 18, 19, 20 or more nucleobases. In some embodiments, each nucleobase is independently optionally substituted A, T, C, G, U or an optionally substituted tautomer of A, T, C, G, or U.

Length

As described in the present disclosure, provided oligonucleotides can be of various lengths, e.g., 2-200, 10-15, 10-25, 15-20, 15-25, 15-40, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 60, 70, 80, 90, 100, 150, nucleobases in length, wherein each nucleobase is independently optionally substituted A, T, C, G, or U, or an optionally substituted tautomer of A, T, C, G, or U. In some embodiments, provided oligonucleotides, e.g., oligonucleotide of a plurality in chirally controlled oligonucleotide compositions, are 15 nucleobases in length. In some embodiments, provided oligonucleotides are 16 nucleobases in length. In some embodiments, provided oligonucleotides are 17 nucleobases in length. In some embodiments, provided oligonucleotides are 18 nucleobases in length. In some embodiments, provided oligonucleotides are 19 nucleobases in length. In some embodiments, provided oligonucleotides are 20 nucleobases in length. In some embodiments, provided oligonucleotides are 21 nucleobases in length. In some embodiments, provided oligonucleotides are 22 nucleobases in length. In some embodiments, provided oligonucleotides are 23 nucleobases in length. In some embodiments, provided oligonucleotides are 24 nucleobases in length. In some embodiments, provided oligonucleotides are 25 nucleobases in length.

As described in the present disclosure, provided oligonucleotides, oligonucleotides of a plurality in chirally controlled oligonucleotide compositions, may comprise various modifications, e.g., base modifications, sugar modifications, internucleotidic linkage modifications, etc. In some embodiments, the oligonucleotide composition comprises at least one modified nucleotide, at least one modified sugar moiety, at least one morpholino moiety, at least one 2'-deoxy ribonucleotide, at least one locked nucleotide, and/or at least one bicyclic nucleotide.

Nucleobases

In some embodiments, a nucleobase is a natural nucleobase. In some embodiments, a nucleobase is a modified nucleobase (non-natural nucleobase). In some embodiments, a nucleobase, e.g., BA, in provided oligonucleotides is a natural nucleobase (e.g., adenine, cytosine, guanosine, thymine, or uracil) or a modified nucleobase derived from a natural nucleobase, e.g., optionally substituted adenine, cytosine, guanosine, thymine, or uracil, or tautomeric forms thereof. Examples include, but are not limited to, uracil, thymine, adenine, cytosine, and guanine, and tautomeric forms thereof, having their respective amino groups protected by protecting groups, e.g., one or more of —R, —C(O)R, etc. Example protecting groups, including those useful for oligonucleotide synthesis, are widely known in the art and can be utilized in accordance with the present disclosure. In some embodiments, a protected nucleobase and/or derivative is selected from nucleobases with one or more acyl protecting groups, 2-fluorouracil, 2-fluorocytosine, 5-bromouracil, 5-iodouracil, 2,6-diaminopurine, azacytosine, pyrimidine analogs such as pseudoisocytosine and pseudouracil and other modified nucleobases such as 8-substituted purines, xanthine, or hypoxanthine (the latter two being the natural degradation products). Example modified nucleobases are also disclosed in Chiu and Rana, *RNA,* 2003, 9, 1034-1048, Limbach et al. *Nucleic Acids Research,* 1994, 22, 2183-2196 and Revankar and Rao, *Comprehensive Natural Products Chemistry*, vol. 7, 313. In some embodiments, a modified nucleobase is substituted uracil, thymine, adenine, cytosine, or guanine. In some embodiments, a modified nucleobase is a functional replacement, e.g., in terms of hydrogen bonding and/or base pairing, of uracil, thymine, adenine, cytosine, or guanine. In some embodiments, a nucleobase is optionally substituted uracil, thymine, adenine, cytosine, 5-methylcytosine, or guanine. In some embodiments, a nucleobase is uracil, thymine, adenine, cytosine, 5-methylcytosine, or guanine.

In some embodiments, a modified base is optionally substituted adenine, cytosine, guanine, thymine, or uracil. In some embodiments, a modified nucleobase is independently adenine, cytosine, guanine, thymine or uracil, modified by one or more modifications by which:

(1) a nucleobase is modified by one or more optionally substituted groups independently selected from acyl, halogen, amino, azide, alkyl, alkenyl, alkynyl, aryl, heteroalkyl, heteroalkenyl, heteroalkynyl, heterocyclyl, heteroaryl, carboxyl, hydroxyl, biotin, avidin, streptavidin, substituted silyl, and combinations thereof;

(2) one or more atoms of a nucleobase are independently replaced with a different atom selected from carbon, nitrogen or sulfur;

(3) one or more double bonds in a nucleobase are independently hydrogenated; or (4) one or more optionally substituted aryl or heteroaryl rings are independently inserted into a nucleobase.

Modified nucleobases also include expanded-size nucleobases in which one or more aryl rings, such as phenyl rings, have been added. Nucleic base replacements described in the Glen Research catalog (available at the Glen Research website); Krueger A T et al, *Acc. Chem. Res.,* 2007, 40, 141-150; Kool, E T, *Acc. Chem. Res.,* 2002, 35, 936-943; Benner S. A., et al., *Nat. Rev. Genet.,* 2005, 6, 553-543; Romesberg, F. E., et al., *Curr. Opin. Chem. Biol.,* 2003, 7, 723-733; Hirao, I., *Curr. Opin. Chem. Biol.,* 2006, 10, 622-627, are contemplated as useful for oligonucleotides of the present disclosure.

In some embodiments, modified nucleobases include structures such as, but not limited to, corrin- or porphyrin-derived rings. Porphyrin-derived base replacements have been described in Morales-Rojas, H and Kool, E T, *Org. Lett.,* 2002, 4, 4377-4380. Shown below is an example of a porphyrin-derived ring which can be used as a nucleobase replacement:

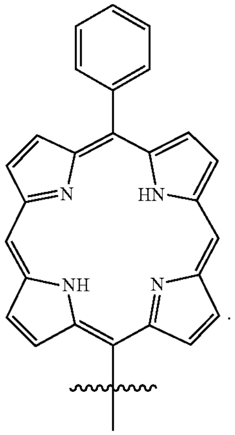 [SMILES: *c1c2nc(cc3ccc([nH]3)c(-c3ccccc3)c3nc(cc4ccc1[nH]4)C=C3)C=C2]

In some embodiments, a modified nucleobase is fluorescent. Examples of such fluorescent modified nucleobases include phenanthrene, pyrene, stillbene, isoxanthine, isozanthopterin, terphenyl, terthiophene, benzoterthiophene, coumarin, lumazine, tethered stillbene, benzo-uracil, and naphtho-uracil.

In some embodiments, a modified nucleobase is a universal base or a degenerate base, e.g., 3-nitropyrrole, 5'-nitroindole, P, K, etc.

In some embodiments, other nucleosides can also be used in technologies disclosed in the present disclosure and include nucleosides that incorporate modified nucleobases, or nucleobases covalently bound to modified sugars. Some examples of nucleosides that incorporate modified nucleobases include 4-acetylcytidine; 5-(carboxyhydroxylmethyl)uridine; 2'-O-methylcytidine; 5-carboxymethylaminomethyl-2-thiouridine; 5-carboxymethylaminomethyluridine; dihydrouridine; 2'-O-methylpseudouridine; beta,D-galactosylqueosine; 2'-O-methylguanosine; $N^6$-isopentenyladenosine; 1-methyladenosine; 1-methylpseudouridine; 1-methylguanosine; 1-methylinosine; 2,2-dimethylguanosine; 2-methyladenosine; 2-methylguanosine; $N^7$-methylguanosine; 3-methyl-cytidine; 5-methylcytidine; 5-hydroxymethylcytidine; 5-formylcytosine; 5-carboxylcytosine; $N^6$-methyladenosine; 7-methylguanosine; 5-methylaminoethyluridine; 5-methoxyaminomethyl-2-thiouridine; beta, D-mannosylqueosine; 5-methoxycarbonylmethyluridine; 5-methoxyuridine; 2-methylthio-$N^6$-isopentenyladenosine; N-((9-beta,D-ribofuranosyl-2-methylthiopurine-6-yl)carbamoyl)threonine; N-((9-beta,D-ribofuranosylpurine-6-yl)-N-methylcarbamoyl)threonine; uridine-5-oxyacetic acid methylester; uridine-5-oxyacetic acid (v); pseudouridine; queosine; 2-thiocytidine; 5-methyl-2-thiouridine; 2-thiouridine; 4-thiouridine; 5-methyluridine; 2'-O-methyl-5-methyluridine; and 2'-O-methyluridine.

In some embodiments, a nucleobase is optionally substituted A, T, C, G or U, wherein one or more $—NH_2$ are independently and optionally replaced with $—C(-L-R^1)_3$, one or more —NH— are independently and optionally replaced with $—C(-L-R^1)_2—$, one or more =N— are independently and optionally replaced with $—C(-L-R^1)—$, one or more =CH— are independently and optionally replaced with =N—, and one or more =O are independently and optionally replaced with =S, $=N(-L-R^1)$, or $=C(-L-R^1)_2$, wherein two or more $-L-R^1$ are optionally taken together with their intervening atoms to form a 3-30 membered bicyclic or polycyclic ring having 0-10 heteroatom ring atoms. In some embodiments, a modified nucleobase is optionally substituted A, T, C, G or U, wherein one or more $—NH_2$ are independently and optionally replaced with $—C(-L-R^1)_3$, one or more —NH— are independently and optionally replaced with $—C(-L-R^1)_2—$, one or more =N— are independently and optionally replaced with $—C(-L-R^1)—$, one or more =CH— are independently and optionally replaced with =N—, and one or more =O are independently and optionally replaced with =S, $=N(-L-R^1)$, or $=C(-L-R^1)_2$, wherein two or more $-L-R^1$ are optionally taken together with their intervening atoms to form a 3-30 membered bicyclic or polycyclic ring having 0-10 heteroatom ring atoms, wherein the modified base is different than the natural A, T, C, G and U. In some embodiments, a nucleobase is optionally substituted A, T, C, G or U. In some embodiments, a modified base is substituted A, T, C, G or U, wherein the modified base is different than the natural A, T, C, G and U.

In some embodiments, a modified nucleobase may be optionally substituted. In some embodiments, a modified nucleobase contains one or more, e.g., heteroatoms, alkyl groups, or linking moieties connected to fluorescent moieties, biotin or avidin moieties, or other proteins or peptides. In some embodiments, a nucleobase or modified nucleobase comprises or is conjugated with one or more biomolecule binding moieties such as e.g., antibodies, antibody fragments, biotin, avidin, streptavidin, receptor ligands, or chelating moieties. In some embodiments, a modified nucleobase is modified by substitution with a fluorescent or biomolecule binding moiety. In some embodiments, a substituent on a nucleobase or modified nucleobase is a fluorescent moiety. In some embodiments, a substituent on a nucleobase or modified nucleobase is biotin or avidin.

Example nucleobases are also described in US20110294124, US20120316224, US 20140194610, US20150211006, US20150197540, WO 2015107425, WO/2017/015555, WO/2017/015575, and WO/2017/062862, the nucleobases of each of which is incorporated herein by reference.

Sugars

In some embodiments, oligonucleotides comprise one or more modified sugar moieties beside the natural sugar moieties. In some embodiments, a sugar is a natural sugar. In some embodiments, a sugar is a modified sugar (non-natural sugar). The most common naturally occurring nucleotides are comprised of ribose sugars linked to the nucleobases adenosine (A), cytosine (C), guanine (G), and thymine (T) or uracil (U). Also included in the present disclosure are modified nucleotides wherein an internucleotidic linkage is linked to various positions of a sugar or modified sugar. As non-limiting examples, an internucleotidic linkage can be linked to the 2', 3', 4' or 5' position of a sugar.

In some embodiments, a sugar moiety is

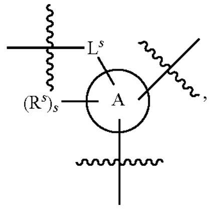
, wherein each variable is independently as described in the present disclosure. In some embodiments, a sugar moiety is

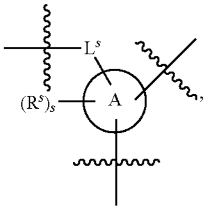

wherein $L^s$ is $-C(R^{5s})_2-$, wherein each $R^{5s}$ is independently as described in the present disclosure. In some embodiments, a sugar moiety has the structure of

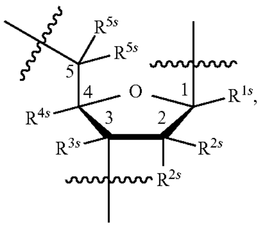

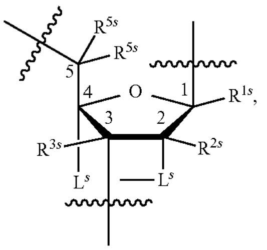

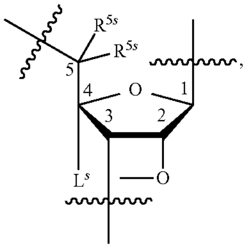

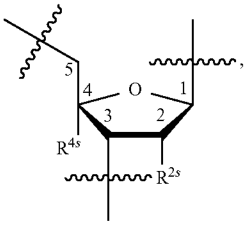

or

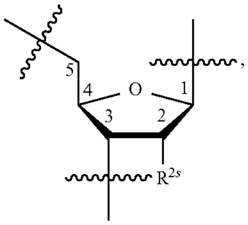

wherein each variable is independently as described in the present disclosure. In some embodiments, a sugar moiety has the structure of

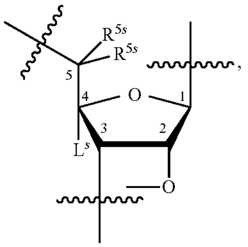

wherein each variable is independently as described in the present disclosure. In some embodiments, a sugar has or is derived from the structure of

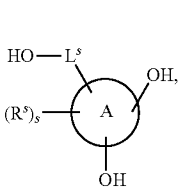

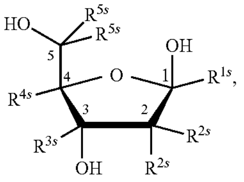

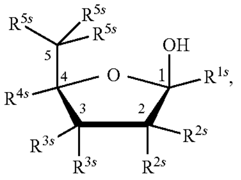

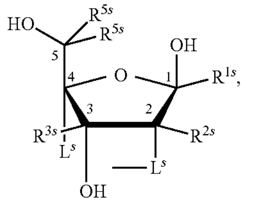

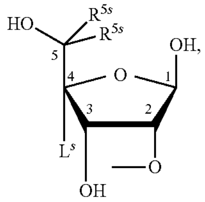

or

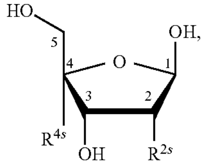

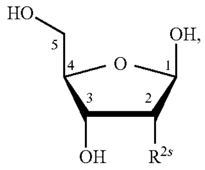

wherein each variable is independently as described in the present disclosure. In some embodiments, a nucleoside has the structure of

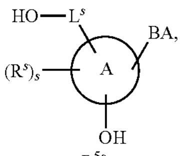

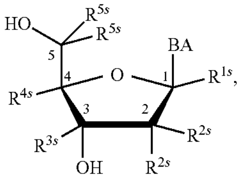

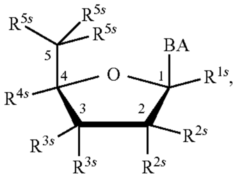

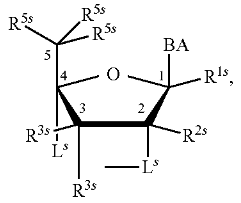

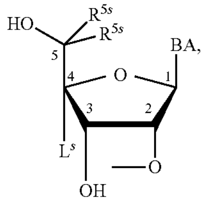

or

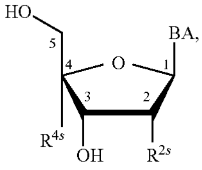

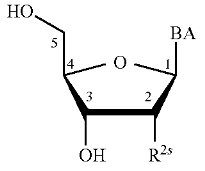

wherein each variable is independently as described in the present disclosure. In some embodiments, a nucleoside moiety has or comprises the structure of

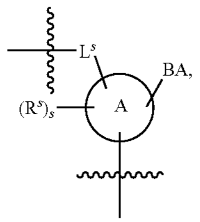

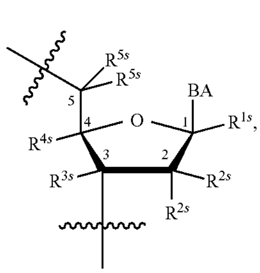

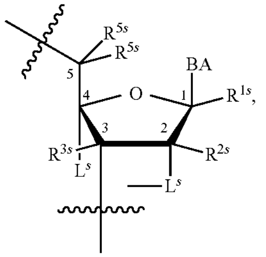

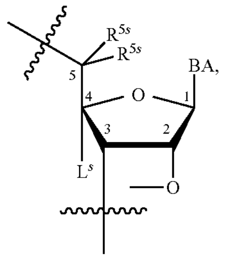

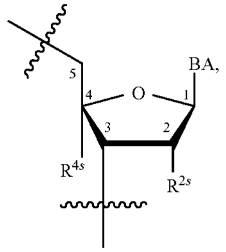

or

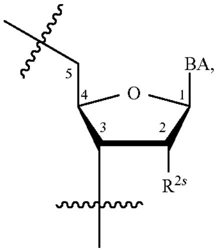

wherein each variable is independently as described in the present disclosure. In some embodiments, $L^s$ is —CH(R)—, wherein R is as described in the present disclosure. In some embodiments, R is —H. In some embodiments, R is not —H, and $L^s$ is —(R)—CH(R)—. In some embodiments, R is not —H, and $L^s$ is —(S)—CH(R)—. In some embodiments, R, as described in the present disclosure, is optionally substituted $C_{1-6}$ alkyl. In some embodiments, R is methyl.

Various types of sugar modifications are known and can be utilized in accordance with the present disclosure. In some embodiments, a sugar modification is a 2'-modification (e.g. $R^{2s}$ (e.g., in

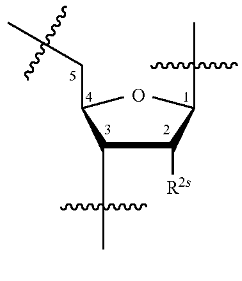

)).

In some embodiments, a 2'-modification is 2'-F. In some embodiments, a 2'-modification is 2'-OR, wherein R is not hydrogen. In some embodiments, a 2'-modification is 2'-OR, wherein R is optionally substituted $C_{1-6}$ aliphatic. In some embodiments, a 2'-modification is 2'-OR, wherein R is optionally substituted $C_{1-6}$ alkyl. In some embodiments, a 2'-modification is 2'-OMe. In some embodiments, a 2'-modification is 2'-MOE. In some embodiments, a 2'-modification is a LNA sugar modification ($C_2$—O—$CH_2$—C4). In some embodiments, a 2'-modification is ($C_2$—O—$C(R)_2$—C4), wherein each R is independently as described in the present disclosure. In some embodiments, a 2'-modification is ($C_2$—O—CHR—C4), wherein R is as described in the present disclosure. In some embodiments, a 2'-modification is ($C_2$—O—(R)—CHR—C4), wherein R is as described in the present disclosure and is not hydrogen. In some embodiments, a 2'-modification is ($C_2$—O—(S)—CHR—C4), wherein R is as described in the present disclosure and is not hydrogen. In some embodiments, R is optionally substituted $C_{1-6}$ aliphatic. In some embodiments, R is optionally substituted $C_{1-6}$ alkyl. In some embodiments, R is unsubstituted $C_{1-6}$ alkyl. In some embodiments, R is methyl. In some embodiments, R is ethyl. In some embodiments, a 2'-modification is ($C_2$—O—CHR—C4), wherein R is optionally substituted $C_{1-6}$ aliphatic. In some embodiments, a 2'-modification is ($C_2$—O—CHR—C4), wherein R is optionally substituted $C_{1-6}$ alkyl. In some embodiments, a 2'-modification is ($C_2$—O—CHR—C4), wherein R is methyl. In some embodiments, a 2'-modification is ($C_2$—O—CHR—C4), wherein R is ethyl. In some embodiments, a 2'-modification is ($C_2$—O—(R)—CHR—C4), wherein R is optionally substituted $C_{1-6}$ aliphatic. In some embodiments, a 2'-modification is ($C_2$—O—(R)—CHR—C4), wherein R is optionally substituted $C_{1-6}$ alkyl. In some embodiments, a 2'-modification is ($C_2$—O—(R)—CHR—C4), wherein R is methyl. In some embodiments, a 2'-modification is ($C_2$—O—(R)—CHR—C4), wherein R is ethyl. In some embodiments, a 2'-modification is ($C_2$—O—(S)—CHR—C4), wherein R is optionally substituted $C_{1-6}$ aliphatic. In some embodiments, a 2'-modification is ($C_2$—O—(S)—CHR—C4), wherein R is optionally substituted $C_{1-6}$ alkyl. In some embodiments, a 2'-modification is ($C_2$—O—(S)—CHR—C4), wherein R is methyl. In some embodiments, a 2'-modification is ($C_2$—O—(S)—CHR—C4), wherein R is ethyl. In some embodiments, a 2'-modification is $C_2$—O—(R)—$CH(CH_2CH_3)$—C4. In some embodiments, a 2'-modification is $C_2$—O—(S)—$CH(CH_2CH_3)$—C4. In some embodiments, a sugar moiety is a natural DNA sugar moiety. In some embodiments, a sugar moiety is a natural DNA sugar moiety modified at 2' (2'-modification). In some embodiments, a sugar moiety is an optionally substituted natural DNA sugar moiety. In some embodiments, a sugar moiety is an 2'-substituted natural DNA sugar moiety.

Many modified sugars can be incorporated within oligonucleotides of the present disclosure. In some embodiments, a modified sugar contains one or more substituents at the 2' position including one of the following: —F; —$CF_3$, —CN, —$N_3$, —NO, —$NO_2$, —OR', —SR', or —$N(R')_2$, wherein each R' is independently as described in the present disclosure; —O—($C_1$-$C_{10}$ alkyl), —S—($C_1$-$C_{10}$ alkyl), —NH—($C_1$-$C_{10}$ alkyl), or —N($C_1$-$C_{10}$ alkyl)$_2$; —O—($C_2$-$C_{10}$ alkenyl), —S—($C_2$-$C_{10}$ alkenyl), —NH—($C_2$-$C_{10}$ alkenyl), or —N($C_2$-$C_{10}$ alkenyl)$_2$; —O—($C_2$-$C_{10}$ alkynyl), —S—($C_2$-$C_{10}$ alkynyl), —NH—($C_2$-$C_{10}$ alkynyl), or —N($C_2$-$C_{10}$ alkynyl)$_2$; or —O—($C_1$-$C_{10}$ alkylene)-O—($C_1$-$C_{10}$ alkyl), —O—($C_1$-$C_{10}$ alkylene)-NH—($C_1$-$C_{10}$ alkyl) or —O—($C_1$-$C_{10}$ alkylene)-NH($C_1$-$C_{10}$ alkyl)$_2$, —NH—($C_1$-$C_{10}$ alkylene)-O—($C_1$-$C_{10}$ alkyl), or —N($C_1$-$C_{10}$ alkyl)-($C_1$-$C_{10}$ alkylene)-O—($C_1$-$C_{10}$ alkyl), wherein the alkyl, alkylene, alkenyl and alkynyl may be substituted or unsubstituted. Examples of substituents include, and are not limited to, —$O(CH_2)_nOCH_3$, and —$O(CH_2)_nNH_2$, wherein n is from 1 to about 10, MOE, DMAOE, and DMAEOE. Certain modified sugars are described in WO 2001/088198, WO/2017/062862, and Martin et al., *Helv. Chim. Acta,* 1995, 78, 486-504. In some embodiments, a modified sugar comprises one or more groups selected from a substituted silyl group, an RNA cleaving group, a reporter group, a fluorescent label, an intercalator, a group for improving the pharmacokinetic properties of an oligonucleotide, a group for improving the pharmacodynamic properties of an oligonucleotide, or other substituents having similar properties. In some embodiments, modifications are made at one or more of the the 2', 3', 4', 5', or 6' positions of a sugar, including the 3' position of a sugar on the 3'-terminal nucleoside or in the 5' position of the 5'-terminal nucleoside. In some embodiments, a RNA comprises a sugar which has, at the 2' position, a 2'-OH, or 2'-$OR^1$, wherein $OR^1$ is optionally substituted alkyl, including 2'-OMe.

In some embodiments, a 2'-modification is 2'-F.

In some embodiments, the 2'-OH of a ribose is replaced with a substituent (e.g., $R^{2s}$) including one of the following: —H, —F; —$CF_3$, —CN, —$N_3$, —NO, —$NO_2$, —OR', —SR', or —$N(R')_2$, wherein each R' is independently as defined above and described herein; —O—($C_1$-$C_{10}$ alkyl), —S—($C_1$-$C_{10}$ alkyl), —NH—($C_1$-$C_{10}$ alkyl), or —N($C_1$-$C_{10}$ alkyl)$_2$; —O—($C_2$-$C_{10}$ alkenyl), —S—($C_2$-$C_{10}$ alkenyl), —NH—($C_2$-$C_{10}$ alkenyl), or —N($C_2$-$C_{10}$ alkenyl)$_2$; —O—($C_2$-$C_{10}$ alkynyl), —S—($C_2$-$C_{10}$ alkynyl), —NH—($C_2$-$C_{10}$ alkynyl), or —N($C_2$-$C_{10}$ alkynyl)$_2$; or —O—($C_1$-$C_{10}$ alkylene)-O—($C_1$-$C_{10}$ alkyl), —O—($C_1$-$C_{10}$ alkylene)-NH—($C_1$-$C_{10}$ alkyl) or —O—($C_1$-$C_{10}$ alkylene)-NH($C_1$-$C_{10}$ alkyl)$_2$, —NH—($C_1$-$C_{10}$ alkylene)-O—($C_1$-$C_{10}$ alkyl), or —N($C_1$-$C_{10}$ alkyl)-($C_1$-$C_{10}$ alkylene)-O—($C_1$-$C_{10}$ alkyl), wherein the alkyl, alkylene, alkenyl and alkynyl may be substituted or unsubstituted. In some embodiments, the 2'-OH is replaced with —H (deoxyribose). In some embodiments, the 2'-OH is replaced with —F. In some embodiments, the 2'-OH is replaced with —OR'. In some embodiments, the 2'-OH is replaced with —OMe. In some embodiments, the 2'-OH is replaced with —$OCH_2CH_2OMe$.

In some embodiments, a modified sugars is a sugar in locked nucleic acids (LNAs). In some embodiments, two substituents on sugar carbon atoms are taken together to form a bivalent moiety. In some embodiments, two substituents are on two different sugar carbon atoms. In some embodiments, a formed bivalent moiety has the structure of -L- as defined herein. In some embodiments, -L- is —O—$CH_2$—, wherein —$CH_2$— is optionally substituted. In some embodiments, -L- is —O—$CH_2$—. In some embodiments, -L- is —O—CH(Me)-. In some embodiments, -L- is —O—CH(Et)-. In some embodiments, -L- is between $C_2$ and $C_4$ of a sugar moiety. In some embodiments, a locked nucleic acid sugar has the structure indicated below, wherein $R^{2s}$ is —$OCH_2C4'$-:

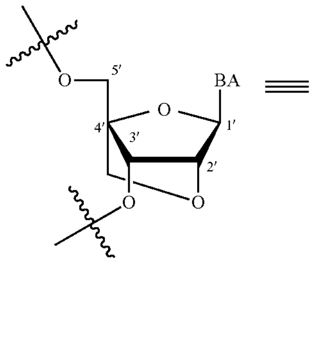

-continued

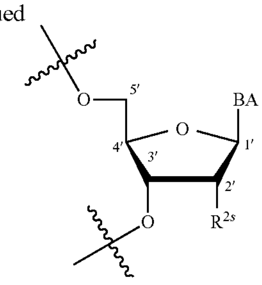

$R^{2s}$ = $OCH_2C4'$

In some embodiments, a modified sugar is an ENA sugar or modified ENA sugar such as those described in, e.g., Seth et al., J Am Chem Soc. 2010 Oct. 27; 132 (42): 14942-14950. In some embodiments, a modified sugar is any of those found in an XNA (xenonucleic acid), for instance, arabinose, anhydrohexitol, threose, 2'fluoroarabinose, or cyclohexene.

In some embodiments, a modified sugar is one described in WO 2017/062862.

In some embodiments, modified sugars are sugar mimetics such as cyclobutyl or cyclopentyl moieties in place of pentofuranosyl. Representative United States patents that teach preparation of such modified sugar structures include, but are not limited to, U.S. Pat. Nos. 4,981,957; 5,118,800; 5,319,080; and 5,359,044. In some embodiments, modified sugars are sugars in which the oxygen atom within the ribose ring is replaced by nitrogen, sulfur, selenium, or carbon. In some embodiments, a modified sugar is a modified ribose wherein the oxygen atom within the ribose ring is replaced with nitrogen, and wherein the nitrogen is optionally substituted with an alkyl group (e.g., methyl, ethyl, isopropyl, etc).

Non-limiting examples of modified sugars include glycerol, which form glycerol nucleic acid (GNA) analogues. In some embodiments, an GNA analogue is described in Zhang, R et al., *J. Am. Chem. Soc.,* 2008, 130, 5846-5847; Zhang L, et al., *J. Am. Chem. Soc.,* 2005, 127, 4174-4175 and Tsai C H et al., *PNAS,* 2007, 14598-14603.

In some embodiments, another example of a GNA derived analogue, flexible nucleic acid (FNA) based on the mixed acetal aminal of formyl glycerol, is described in Joyce G F et al., *PNAS,* 1987, 84, 4398-4402 and Heuberger B D and Switzer C, *J. Am. Chem. Soc.,* 2008, 130, 412-413.

Additional non-limiting examples of modified sugars include hexopyranosyl (6' to 4'), pentopyranosyl (4' to 2'), pentopyranosyl (4' to 3'), or tetrofuranosyl (3' to 2') sugars.

In some embodiments, one or more hydroxyl group in a sugar moiety is optionally and independently replaced with halogen, R' —$N(R')_2$, —OR', or —SR', wherein each R' is independently as defined above and described herein.

In some embodiments, at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more (e.g., 55%, 60%, 65%, 70%, 75%, 80%, 85%, 90%, 95% or more), inclusive, of the sugars in an oligonucleotide, e.g., a chirally controlled oligonucleotide, an oligonucleotide of a plurality of oligonucleotide of an oligonucleotide composition, etc. are modified. In some embodiments, sugars of purine nucleosides and in some embodiments, only purine nucleosides, are modified (e.g., about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the purine nucleosides are modified). In some embodiments, sugars of pyrimidine nucleosides and in some embodiments, only pyrimidine nucleosides, are modified (e.g., about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the pyrimidine nucleosides are modified). In some embodiments, both purine and pyrimidine nucleosides are modified.

In some embodiments, modified sugars include those described in: A. Eschenmoser, Science (1999), 284:2118; M. Bohringer et al, Helv. Chim. Acta (1992), 75:1416-1477; M. Egli et al, J. Am. Chem. Soc. (2006), 128 (33): 10847-56; A. Eschenmoser in *Chemical Synthesis: Gnosis to Prognosis*, C. Chatgilialoglu and V. Sniekus, Ed., (Kluwer Academic, Netherlands, 1996), p.293; K.-U. Schoning et al, Science (2000), 290:1347-1351; A. Eschenmoser et al, Helv. Chim. Acta (1992), 75:218; J. Hunziker et al, Helv. Chim. Acta (1993), 76:259; G. Otting et al, Helv. Chim. Acta (1993), 76:2701; K. Groebke et al, Helv. Chim. Acta (1998), 81:375; and A. Eschenmoser, Science (1999), 284:2118. Modifications to the 2' modifications can be found in Verma, S. et al. *Annu. Rev. Biochem.* 1998, 67, 99-134 and all references therein. In some embodiments, a modified sugar is one described in WO2012/030683. In some embodiments, a modified sugar is any modified sugar described in any of: Gryaznov, S; Chen, J.-K. J. Am. Chem. Soc. 1994, 116, 3143; Hendrix et al. 1997 Chem. Eur. J. 3: 110; Hyrup et al. 1996 Bioorg. Med. Chem. 4: 5; Jepsen et al. 2004 Oligo. 14: 130-146; Jones et al. J. Org. Chem. 1993, 58, 2983; Koizumi et al. 2003 Nuc. Acids Res. 12: 3267-3273; Koshkin et al. 1998 Tetrahedron 54: 3607-3630; Kumar et al. 1998 Bioo. Med. Chem. Let. 8: 2219-2222; Lauritsen et al. 2002 Chem. Comm. 5: 530-531; Lauritsen et al. 2003 Bioo. Med. Chem. Lett. 13: 253-256; Mesmaeker et al. Angew. Chem., Int. Ed. Engl. 1994, 33, 226; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Nielsen et al. 1997 Chem. Soc. Rev. 73; Nielsen et al. 1997 J. Chem. Soc. Perkins Transl. 1: 3423-3433; Obika et al. 1997 Tetrahedron Lett. 38 (50): 8735-8; Obika et al. 1998 Tetrahedron Lett. 39: 5401-5404; Pallan et al. 2012 Chem. Comm. 48: 8195-8197; Petersen et al. 2003 TRENDS Biotech. 21: 74-81; Rajwanshi et al. 1999 Chem. Commun. 1395-1396; Schultz et al. 1996 Nucleic Acids Res. 24: 2966; Seth et al. 2009 J. Med. Chem. 52: 10-13; Seth et al. 2010 J. Med. Chem. 53: 8309-8318; Seth et al. 2010 J. Org. Chem. 75: 1569-1581; Seth et al. 2012 Bioo. Med. Chem. Lett. 22: 296-299; Seth et al. 2012 Mol. Ther-Nuc. Acids. 1, e47; Seth, Punit P; Siwkowski, Andrew; Allerson, Charles R; Vasquez, Guillermo; Lee, Sam; Prakash, Thazha P; Kinberger, Garth; Migawa, Michael T; Gaus, Hans; Bhat, Balkrishen; et al. From Nucleic Acids Symposium Series (2008), 52 (1), 553-554; Singh et al. 1998 Chem. Comm. 1247-1248; Singh et al. 1998 J. Org. Chem. 63: 10035-39; Singh et al. 1998 J. Org. Chem. 63: 6078-6079; Sorensen 2003 Chem. Comm. 2130-2131; Ts'o et al. Ann. N. Y. Acad. Sci. 1988, 507, 220; Van Aerschot et al. 1995 Angew. Chem. Int. Ed. Engl. 34: 1338; Vasseur et al. J. Am. Chem. Soc. 1992, 114, 4006; WO 20070900071; WO 20070900071; or WO 2016/079181.

In some embodiments, a modified sugar moiety is an optionally substituted pentose or hexose moiety. In some embodiments, a modified sugar moiety is an optionally substituted pentose moiety. In some embodiments, a modified sugar moiety is an optionally substituted hexose moiety. In some embodiments, a modified sugar moiety is an optionally substituted ribose or hexitol moiety. In some embodiments, a modified sugar moiety is an optionally substituted ribose moiety. In some embodiments, a modified sugar moiety is an optionally substituted hexitol moiety.

In some embodiments, a sugar is D-2-deoxyribose. In some embodiments, a sugar is beta-D-deoxyribofuranose. In some embodiments, a sugar moiety is a beta-D-deoxyribofuranose moiety. In some embodiments, a sugar is D-ribose. In some embodiments, a sugar is beta-D-ribofuranose. In some embodiments, a sugar moiety is a beta-D-ribofuranose moiety. In some embodiments, a sugar is optionally substituted beta-D-deoxyribofuranose or beta-D-ribofuranose. In some embodiments, a sugar moiety is an optionally substituted beta-D-deoxyribofuranose or beta-D-ribofuranose moiety. In some embodiments, a sugar moiety/unit in an oligonucleotide, nucleic acid, etc. is a sugar which comprises one or more carbon atoms each independently connected to an internucleotidic linkage, e.g., optionally substituted beta-D-deoxyribofuranose or beta-D-ribofuranose whose 5'-C and/or 3'-C are each independently connected to an internucleotidic linkage (e.g., a natural phosphate linkage, a modified internucleotidic linkage, a chirally controlled internucleotidic linkage, etc.).

In some embodiments, each nucleoside of a provided oligonucleotide comprises a 2'-O-methoxyethyl sugar modification.

In some embodiments, the oligonucleotide composition comprises at least one locked nucleic acid (LNA)nucleotide. In some embodiments, the oligonucleotide composition comprises at least one modified nucleotide comprising a modified sugar moiety which is modified at the 2'-position.

In some embodiments, the oligonucleotide composition comprises modified sugar moiety which comprises a 2'-substituent selected from the group consisting of: H, OR, R, halogen, SH, SR, $NH_2$, NHR, $NR_2$, and ON, wherein R is an optionally substituted $C_1$-$C_6$ alkyl, alkenyl, or alkynyl and halogen is F, Cl, Br or I.

In some embodiments, a modified nucleobase, sugar, nucleoside, nucleotide, and/or modified internucleotidic linkage is selected from those described in Ts'o et al. Ann. N. Y. Acad. Sci. 1988, 507, 220; Gryaznov, S.; Chen, J.-K. J. Am. Chem. Soc. 1994, 116, 3143; Mesmaeker et al. Angew. Chem., Int. Ed. Engl. 1994, 33, 226; Jones et al. J. Org. Chem. 1993, 58, 2983; Vasseur et al. J. Am. Chem. Soc. 1992, 114, 4006; Van Aerschot et al. 1995 Angew. Chem. Int. Ed. Engl. 34: 1338; Hendrix et al. 1997 Chem. Eur. J. 3: 110; Koshkin et al. 1998 Tetrahedron 54: 3607-3630; Hyrup et al. 1996 Bioorg. Med. Chem. 4: 5; Nielsen et al. 1997 Chem. Soc. Rev. 73; Schultz et al. 1996 Nucleic Acids Res. 24: 2966; Obika et al. 1997 Tetrahedron Lett. 38 (50): 8735-8; Obika et al. 1998 Tetrahedron Lett. 39: 5401-5404; Singh et al. 1998 Chem. Comm. 1247-1248; Kumar et al. 1998 Bioo. Med. Chem. Let. 8: 2219-2222; Nielsen et al. 1997 J. Chem. Soc. Perkins Transl. 1: 3423-3433; Singh et al. 1998 J. Org. Chem. 63: 6078-6079; Seth et al. 2010 J. Org. Chem. 75: 1569-1581; Singh et al. 1998 J. Org. Chem. 63: 10035-39; Sorensen 2003 Chem. Comm. 2130-2131; Petersen et al. 2003 TRENDS Biotech. 21: 74-81; Rajwanshi et al. 1999 Chem. Commun. 1395-1396; Jepsen et al. 2004 Oligo. 14: 130-146; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Koizumi et al. 2003 Nuc. Acids Res. 12: 3267-3273; Lauritsen et al. 2002 Chem. Comm. 5: 530-531; Lauritsen et al. 2003 Bioo. Med. Chem. Lett. 13: 253-256; WO 20070900071; Seth et al., Nucleic Acids Symposium Series (2008), 52 (1), 553-554; Seth et al. 2009 J. Med. Chem. 52: 10-13; Seth et al. 2012 Mol. Ther-Nuc. Acids. 1, e47; Pallan et al. 2012 Chem. Comm. 48: 8195-8197; Seth et al. 2010 J. Med. Chem. 53: 8309-8318; Seth et al. 2012 Bioo. Med. Chem. Lett. 22: 296-299; WO 2016/079181; U.S. Pat. Nos. 6,326,199; 6,066,500; and 6,440,739.

In some embodiments, sugars and nucleosides include 6'-modified bicyclic sugars and nucleosides, respectively, that have either (R) or (S)-chirality at the 6'-position, e.g., those described in U.S. Pat. No. 7,399,845. In other embodiments, sugars and nucleosides include 5'-modified bicyclic sugars and nucleosides, respectively, that have either (R) or (S)-chirality at the 5'-position, e.g., those described in US Patent Application Publication No. 20070287831.

In some embodiments, modified sugars, nucleobases, nucleosides, nucleotides, and/or internucleotidic linkages are described in U.S. Pat. No. 3,687,808, as well as U.S. Pat. Nos. 4,845,205; 5,130,30; 5,134,066; 5,175,273; 5,367,066; 5,432,272; 5,457,187; 5,457,191; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the sugars, nucleobases, nucleosides, nucleotides, and internucleotidic linkages of each of which are incorporated by reference.

In some embodiments, modified sugars, nucleobases, nucleosides, nucleotides, and/or internucleotidic linkages are those described in any of: Gryaznov, S; Chen, J.-K. J. Am. Chem. Soc. 1994, 116, 3143; Hendrix et al. 1997 Chem. Eur. J. 3: 110; Hyrup et al. 1996 Bioorg. Med. Chem. 4: 5; Jepsen et al. 2004 Oligo. 14: 130-146; Jones et al. J. Org. Chem. 1993, 58, 2983; Koizumi et al. 2003 Nuc. Acids Res. 12: 3267-3273; Koshkin et al. 1998 Tetrahedron 54: 3607-3630; Kumar et al. 1998 Bioo. Med. Chem. Let. 8: 2219-2222; Lauritsen et al. 2002 Chem. Comm. 5: 530-531; Lauritsen et al. 2003 Bioo. Med. Chem. Lett. 13: 253-256; Mesmaeker et al. Angew. Chem., Int. Ed. Engl. 1994, 33, 226; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Nielsen et al. 1997 Chem. Soc. Rev. 73; Nielsen et al. 1997 J. Chem. Soc. Perkins Transl. 1: 3423-3433; Obika et al. 1997 Tetrahedron Lett. 38 (50): 8735-8; Obika et al. 1998 Tetrahedron Lett. 39: 5401-5404; Pallan et al. 2012 Chem. Comm. 48: 8195-8197; Petersen et al. 2003 TRENDS Biotech. 21: 74-81; Rajwanshi et al. 1999 Chem. Commun. 1395-1396; Schultz et al. 1996 Nucleic Acids Res. 24: 2966; Seth et al. 2009 J. Med. Chem. 52: 10-13; Seth et al. 2010 J. Med. Chem. 53: 8309-8318; Seth et al. 2010 J. Org. Chem. 75: 1569-1581; Seth et al. 2012 Bioo. Med. Chem. Lett. 22: 296-299; Seth et al. 2012 Mol. Ther-Nuc. Acids. 1, e47; Seth, Punit P; Siwkowski, Andrew; Allerson, Charles R; Vasquez, Guillermo; Lee, Sam; Prakash, Thazha P; Kinberger, Garth; Migawa, Michael T; Gaus, Hans; Bhat, Balkrishen; et al. From Nucleic Acids Symposium Series (2008), 52 (1), 553-554; Singh et al. 1998 Chem. Comm. 1247-1248; Singh et al. 1998 J. Org. Chem. 63: 10035-39; Singh et al. 1998 J. Org. Chem. 63: 6078-6079; Sorensen 2003 Chem. Comm. 2130-2131; Ts'o et al. Ann. N. Y. Acad. Sci. 1988, 507, 220; Van Aerschot et al. 1995 Angew. Chem. Int. Ed. Engl. 34: 1338; Vasseur et al. J. Am. Chem. Soc. 1992, 114, 4006; WO 20070900071; WO 20070900071; and WO 2016/079181.

In some embodiments, modified sugars, nucleobases, nucleosides, nucleotides, and/or internucleotidic linkages include, or include those in, HNA, PNA, 2'-Fluoro N3'-P5'-phosphoramidate, LNA, beta-D-oxy-LNA, 2'-O,3'-C-linked bicyclic, PS-LNA, beta-D-thio-LNA, beta-D-amino-LNA, xylo-LNA [c], alpha-L-LNA, ENA, beta-D-ENA, amide-linked LNA, methylphosphonate-LNA, (R, S)-cEt, (R, S)-cMOE, (R, S)-5'-Me-LNA, S-Me cLNA, Methylene-cLNA, 3'-Me-alpha-L-LNA, R-6'-Me-alpha-L-LNA, S-5'-Me-alpha-L-LNA, or R-5'-Me-alpha-L-LNA. Certain modified sugars, nucleobases, nucleosides, nucleotides, and/or internucleotidic linkages are described in U.S. Pat. Nos. 9,394,333, 9,744,183, 9,605,019, US20130178612, US20150211006, U.S. Pat. No. 9,598,458, US20170037399, WO 2017/015555, WO 2017/062862, the modified sugars, nucleobases, nucleosides, nucleotides, and internucleotidic linkages of each of which are incorporated herein by reference.

Dystrophin

In some embodiments, the present disclosure provides technologies, e.g., oligonucleotides, compositions, methods, etc., related to the dystrophin (DMD) gene or a product encoded thereby (a transcript, a protein (e.g., various variants of the dystrophin protein), etc.). In some embodiments, the base sequence of an oligonucleotide is or comprise a sequence which sequence is, or is complementary (e.g., 85%, 90%, 95%, 100%; in many embodiments, 100%) to, a sequence in the DMD gene or a product thereof (e.g., a transcript, mRNA, etc.) (such an oligonucleotide-DMD oligonucleotide). In some embodiments, such a sequence in the DMD gene or a product thereof comprises 5, 6, 7, 8, 9, 10, 11, 12, 13, 14, 15, 16, 17, 18, 19, 20, 21, 22, 23, 24, 25, 26, 27, 28, 29, 20, 31, 32, 33, 34, 35 or more nucleobases. In some embodiments, such a sequence in the DMD gene or a product thereof comprises at least 10 nucleobases. In some embodiments, such a sequence in the DMD gene or a product thereof comprises at least 15 nucleobases. In some embodiments, such a sequence in the DMD gene or a product thereof comprises at least 16 nucleobases. In some embodiments, such a sequence in the DMD gene or a product thereof comprises at least 17 nucleobases. In some embodiments, such a sequence in the DMD gene or a product thereof comprises at least 18 nucleobases. In some embodiments, such a sequence in the DMD gene or a product thereof comprises at least 19 nucleobases. In some embodiments, such a sequence in the DMD gene or a product thereof comprises at least 20 nucleobases. In some embodiments, the present disclosure provides technologies, including DMD oligonucleotides and compositions an d methods of use thereof, for treatment of muscular dystrophy, including but not limited to, Duchenne Muscular Dystrophy (also abbreviated as DMD) and Becker Muscular Dystrophy (BMD). In some embodiments, DMD comprises one or more mutations. In some embodiments, such mutations are associated with reduced biological functions of dystrophin protein in a subject suffering from or susceptible to muscular dystrophy.

In some embodiments, the dystrophin (DMD) gene or a product thereof, or a variant or portion thereof, may be referred to as DMD, BMD, CMD3B, DXS142, DXS164, DXS206, DXS230, DXS239, DXS268, DXS269, DXS270, DXS272, MRX85, or dystrophin; External IDs: OMIM: 300377 MGI: 94909; HomoloGene: 20856; GeneCards:

DMD; In Human: Entrez: 1756; Ensembl: ENSG00000198947; UniProt: P11532; RefSeq (mRNA): NM_000109; NM_004006; NM_004007; NM_004009; NM_004010; RefSeq (protein): NP_000100; NP_003997; NP_004000; NP_004001; NP_004002; Location (UCSC): Chr X: 31.1-33.34 Mb; In Mouse: Entrez: 13405; Ensembl: ENSMUSG00000045103; UniProt: P11531; RefSeq (mRNA): NM_007868; NM_001314034; NM_001314035; NM_001314036; NM_001314037; RefSeq (protein): NP_001300963; NP_001300964; NP 001300965; NP_001300966; NP_001300967; Location (UCSC): Chr X: 82.95-85.21 Mb.

The DMD gene reportedly contains 79 exons distributed over 2.3 million bp of genetic real estate on the X chromosome; however, only approximately 14,000 bp (<1%) is reported to be used for translation into protein (coding sequence). It is reported that about 99.5% of the genetic sequence, the intronic sequences, is spliced out of the 2.3 million bp initial heteronuclear RNA transcript to provide a mature 14,000 bp mRNA that includes all key information for dystrophin protein production. In some embodiments, patients with DMD have mutation(s) in the DMD gene that prevent the appropriate construction of the wild-type DMD mRNA and/or the production of the wild-type dystrophin protein, and patients with DMD often show marked dystrophin deficiency in their muscle.

In some embodiments, a dystrophin transcript, e.g., mRNA, or protein encompasses those related to or produced from alternative splicing. For example, sixteen alternative transcripts of the dystrophin gene were reported following an analysis of splicing patterns of the DMD gene in skeletal muscle, brain and heart tissues. Sironi et al. 2002 FEBS Letters 517: 163-166.

It is reported that dystrophin has several isoforms. In some embodiments, dystrophin refers to a specific isoform. At least three full-length dystrophin isoforms have been reported, each controlled by a tissue-specific promoter. Klamut et al. 1990 Mol. Cell. Biol. 10: 193-205; Nudel et al. 1989 Nature 337: 76-78; Gorecki et al. 1992 Hum. Mol. Genet. 1: 505-510. The muscle isoform is reportedly mainly expressed in skeletal muscle but also in smooth and cardiac muscles [Bies, R. D., Phelps, S. F., Cortez, M. D., Roberts, R., Caskey, C. T. and Chamberlain, J. S. 1992 Nucleic Acids Res. 20: 1725-1731], the brain dystrophin is reportedly specific for cortical neurons but can also be detected in heart and cerebellar neurons, while the Purkinje-cell type reportedly accounts for nearly all cerebellar dystrophin [Gorecki et al. 1992 Hum. Mol. Genet. 1: 505-510]. Alternative splicing reportedly provides a means for dystrophin diversification: the 3' region of the gene reportedly undergoes alternative splicing resulting in tissue-specific transcripts in brain neurons, cardiac Purkinje fibers, and smooth muscle cells [Bies et al. 1992 Nucleic Acids Res. 20: 1725-1731; and Feener et al. 1989 Nature 338: 509-511] while 12 patterns of alternative splicing have been reported in the 5' region of the gene in skeletal muscle [Surono et al. 1997 Biochem. Biophys. Res. Commun. 239: 895-899].

In some embodiments, a dystrophin mRNA, gene or protein is a revertant version. Among others, revertant dystrophins were reported in, for example: Hoffman et al. 1990 J. Neurol. Sci. 99: 9-25; Klein et al. 1992 Am. J. Hum. Genet. 50: 950-959; and Chelly et al. 1990 Cell 63: 1239-1348; Arahata et al. 1998 Nature 333: 861-863; Bonilla et al. 1988 Cell 54: 447-452; Fanin et al. 1992 Neur. Disord. 2: 41-45; Nicholson et al. 1989 J. Neurol. Sci. 94: 137-146; Shimizu et al. 1988 Proc. Jpn. Acad. Sci. 64: 205-208; Sicinzki et al. 1989 Science 244: 1578-1580; and Sherratt et al. Am. J. Hum. Genet. 53: 1007-1015.

Various mutations in the DMD gene can and/or were reported to cause muscular dystrophy.

Muscular Dystrophy

Compositions comprising one or more DMD oligonucleotides described herein can be used to treat muscular dystrophy. In some embodiments, muscular dystrophy (MD) is any of a group of muscle conditions, diseases, or disorders that results in (increasing) weakening and breakdown of skeletal muscles over time. The conditions, diseases, or disorders differ in which muscles are primarily affected, the degree of weakness, when symptoms begin, and how quickly symptoms worsen. Many MD patients will eventually become unable to walk. In many cases musuclar dystrophy is fatal. Some types are also associated with problems in other organs, including the central nervous system. In some embodiments, the muscular dystrophy is Duchenne (Duchenne's) Muscular Dystrophy (DMD) or Becker (Becker's) Muscular Dystrophy (BMD).

In some embodiments, a symptom of Duchenne Muscular Dystrophy is muscle weakness associated with muscle wasting, with the voluntary muscles being first affected, especially those of the hips, pelvic area, thighs, shoulders, and calves. Muscle weakness can also occur later, in the arms, neck, and other areas. Calves are often enlarged. Symptoms usually appear before age six and may appear in early infancy. Other physical symptoms are: awkward manner of walking, stepping, or running (in some cases, patients tend to walk on their forefeet, because of an increased calf muscle tone), frequent falls, fatigue, difficulty with motor skills (e.g., running, hopping, jumping), lumbar hyperlordosis, possibly leading to shortening of the hip-flexor muscles, unusual overall posture and/or manner of walking, stepping, or running, muscle contractures of Achilles tendon and hamstrings impair functionality, progressive difficulty walking, muscle fiber deformities, pseudohypertrophy (enlarging) of tongue and calf muscles, higher risk of neurobehavioral disorders (e.g., ADHD), learning disorders (e.g., dyslexia), and non-progressive weaknesses in specific cognitive skills (e.g., short-term verbal memory), which are believed to be the result of absent or dysfunctional dystrophin in the brain, eventual loss of ability to walk (usually by the age of 12), skeletal deformities (including scoliosis in some cases), and trouble getting up from lying or sitting position.

In some embodiments, Becker muscular dystrophy (BMD) is caused by mutations that give rise to shortened but in-frame transcripts resulting in the production of truncated but partially functional protein(s). Such partially functional protein(s) were reported to retain the critical amino terminal, cysteine rich and C-terminal domains but usually lack elements of the central rod domains which were reported to be of less functional significance. England et al. 1990 Nature, 343, 180-182.

In some embodiments, BMD phenotypes range from mild DMD to virtually asymptomatic, depending on the precise mutation and the level of dystrophin produced. Yin et al. 2008 Hum. Mol. Genet. 17: 3909-3918.

In some embodiments, dystrophy patients with out-of-frame mutations are generally diagnosed with the more severe Duchenne Muscular Dystrophy, and dystrophy patients with in-frame mutations are generally diagnosed with the less severe Becker Muscular Dystrophy. However, a minority of patients with in-frame deletions are diagnosed with Duchenne Muscular Dystrophy, including those with deletion mutations starting or ending in exons 50 or 51, which encode part of the hinge region, such as deletions of exons 47 to 51, 48 to 51, and 49 to 53. Without wishing to be bound by any particular theory, the present disclosure notes that the patient-to-patient variability in disease severity despite the presence of the same exon deletion reportedly may be related to the effect of the specific deletion breakpoints on mRNA splicing efficiency and/or patterns; translation or transcription efficiency after genome rearrangement; and stability or function of the truncated protein structure. Yokota et al. 2009 Arch. Neurol. 66: 32.

Exon Skipping as a Treatment for Muscular Dystrophy

In some embodiments, a treatment for muscular dystrophy comprises the use of a DMD oligonucleotide which is capable of mediating skipping of one or more Dystrophin exons. In some embodiments, the present disclosure provides methods for treatment of muscular dystrophy comprising administering to a subject suffering therefrom or susceptible thereto an DMD oligonucleotide, or a composition comprising a DMD oligonucleotide. Particularly, among other things, the present disclosure demonstrates that chirally controlled oligonucleotide/chirally controlled oligonucleotide compositions are unexpectedly effective for modulating exon skipping compared to otherwise identical but non-chirally controlled oligonucleotide/oligonucleotide compositions. In some embodiments, the present disclosure demonstrates incorporation of one or more non-negatively charged internucleotidic linkage can greatly improve delivery and/or overall exon skipping efficiency.

In some embodiments, a treatment for muscular dystrophy employs the use of a DMD oligonucleotide, wherein the oligonucleotide is capable of providing skipping of one or more exons. Skipping of one or more (e.g., multiple) DMD exons can, for example, remove a mutated exon(s), or compensate for a mutation(s) (e.g., restoring the reading frame if the mutation is a frameshift mutation) in an exon which is not skipped. In some embodiments, a DMD oligonucleotide is capable of mediating the skipping of an exon which comprises a mutation (e.g., a frameshift, insertion, deletion, missense, or nonsense mutation, or other mutation), wherein the skipping of the exon maintains (or restores) the proper reading frame of the DMD gene, and translation produces a truncated but functional (or largely functional) DMD protein. In some embodiments, a DMD oligonucleotide compensates for an exon comprising a frameshift mutation by providing skipping of a different exon (not the one comprising the frameshift mutation), and thus restoring the reading frame of the DMD gene. In some embodiments, a patient having muscular dystrophy has a frameshift mutation in one exon of the DMD gene; and this patient is treated with a DMD oligonucleotide which does not cause skipping of the exon having the mutation, but causes skipping of a different exon, which restores the reading frame of the DMD gene, so that a functional DMD protein is produced (and, if the deleted exon is 3' to the exon which has the frameshift mutation, this functional DMD protein will generally have an amino acid of a normal DMD protein, except for a sequence of amino acids not normally found in DMD, spanning from the frameshift mutation to the exon which is 3' to the deleted exon).

In some embodiments, a composition comprising a DMD oligonucleotide is useful for treatment of a Dystrophin-related disorder of the central nervous system. In some embodiments, the present disclosure pertains to a method of treatment of a Dystrophin-related disorder of the central nervous system, wherein the method comprises the step of administering a therapeutically effective amount of a DMD oligonucleotide to a patient suffering from a Dystrophin-related disorder of the central nervous system. In some embodiments, a DMD oligonucleotide is administered outside the central nervous system (as non-limiting examples, intravenously or intramuscularly) to a patient suffering from a Dystrophin-related disorder of the central nervous system, and the DMD oligonucleotide is capable of passing through the blood-brain barrier into the central nervous system. In some embodiments, a DMD oligonucleotide is administered directly into the central nervous system (as non-limiting example, via intrathecal, intraventricular, intracranial, etc., delivery).

In some embodiments, a Dystrophin-related disorder of the central nervous system, or a symptom thereof, can be any one or more of: decreased intelligence, decreased long term memory, decreased short term memory, language impairment, epilepsy, autism spectrum disorder, attention deficit hyperactivity disorder (ADHD), obsessive-compulsive disorder, learning problem, behavioral problem, a decrease in brain volume, a decrease in grey matter volume, lower white matter fractional anisotropy, higher white matter radial diffusivity, an abnormality of skull shape, or a deleterious change in the volume or structure of the hippocampus, globus pallidus, caudate putamen, hypothalamus, anterior commissure, periaqueductal gray, internal capsule, amygdala, corpus callosum, septal nucleus, nucleus accumbens, fimbria, ventricle, or midbrain thalamus. In some embodiments, a patient exhibiting muscle-related symptoms of muscular dystrophy also exhibits symptoms of a Dystrophin-related disorder of the central nervous system.

In some embodiments, a Dystrophin-related disorder of the central nervous system is related to, associated with and/or caused by an abnormality in the level, activity, expression and/or distribution of a gene product of the Dystrophin gene, such as full-length Dystrophin or a smaller isoform of Dystrophin, including, but not limited to, Dp260, Dp140, Dp116, Dp71 or Dp40. In some embodiments, a DMD oligonucleotide is administered into the central nervous system of a muscular dystrophy patient in order to ameliorate one or more systems of a Dystrophin-related disorder of the central nervous system. In some embodiments, a Dystrophin-related disorder of the central nervous system is related to, associated with and/or caused by an abnormality in the level, activity, expression and/or distribution of a gene product of the Dystrophin gene, such as full-length Dystrophin or a smaller isoform of Dystrophin, including, but not limited to, Dp260, Dp140, Dp116, Dp71 or Dp40. In some embodiments, administration of a DMD oligonucleotide to a patient suffering from a Dystrophin-related disorder of the central nervous system increases the level, activity, and/or expression and/or improves the distribution of a gene product of the Dystrophin gene.

In some embodiments, the present disclosure provides technologies for modulating dystrophin pre-mRNA splicing, whereby selected exons are excised to either remove nonsense mutations or restore the reading frame around frame-shifting mutations from the mature mRNA. In some embodiments, a DMD oligonucleotide capable of skipping an exon is capable of restoring the reading frame.

As a non-limiting example, in a patient with Duchenne Muscular Dystrophy who has a deletion of exon 50, an out-of-frame transcript is generated in which exon 49 is spliced to exon 51. As a result, a stop codon is generated in exon 51, which prematurely aborts dystrophin synthesis. In some embodiments, the present disclosure provides oligonucleotides that can mediate skipping of exon 51, restore the open reading frame of the transcript, and allow the production of a truncated dystrophin similar to that in patients with Becker muscular dystrophy (BMD).

In some embodiments, in a DMD patient, a DMD gene comprises an exon comprising a mutation, and the disorder is at least partially treated by skipping of one or more exons (e.g., the exon comprising the mutation, or an exon adjacent to the exon comprising the mutation, or a set of consecutive exons, including the exon comprising the mutation).

In some embodiments, in a DMD patient, a DMD gene or transcript has a mutation in an exon(s), which is a missense or nonsense mutation and/or deletion, insertion, inversion, translocation or duplication. In some embodiments, in a DMD patient, a DMD gene or transcript has a mutation in an exon(s) which results in a frameshift, premature stop codon, or otherwise perturbation of the proper reading frame.

In some embodiments, in a treatment for muscular dystrophy, an exon of DMD is skipped, wherein the exon encodes a string of amino acids not essential for DMD protein function, or whose skipping can provide a fully or partially functional DMD protein. In some embodiments, in a treatment for muscular dystrophy, an exon of DMD is skipped, wherein the exon(s) skipped include an exon which comprises a mutation or is adjacent to (e.g., flanking) an exon comprising a mutation, or wherein multiple exons are skipped, the skipped exons optionally include an exon comprising a mutation. In some embodiments, in a treatment for muscular dystrophy, two or more exons are skipped, wherein the exons skipped include an exon which comprises a mutation or is adjacent to (e.g., flanking) an exon comprising a mutation. In some embodiments, in a treatment for muscular dystrophy, an exon comprises a frameshift mutation, and the skipping of a different exon (while leaving the exon with the frameshift mutation in place) restores the proper reading frame.

In some embodiments, in a treatment for muscular dystrophy, a DMD oligonucleotide is capable of mediating skipping of one or more DMD exons, thereby either restoring or maintaining the proper reading frame, and/or creating an artificially internally truncated DMD which provides at least partially improved or fully restored biological activity.

In some embodiments, an DMD oligonucleotide skips an exon(s) which is not exon 64 and exon 70, portions of which are reportedly important for protein function, and/or which is not first or the last exon. In some embodiments, an DMD oligonucleotide skips an exon(s), but skipping of the exon(s) does not cause deletion of one or more or all actin-binding sites in the N-terminal region.

In some embodiments, an internally truncated DMD protein produced from a dystrophin transcript with a skipped exon(s) is more functional than a terminally truncated DMD protein e.g., produced from a dystrophin transcript with an out-of-frame deletion.

In some embodiments, an internally truncated DMD protein produced from a dystrophin transcript with a skipped exon(s) is more resistant to nonsense-mediated decay, which can degrade a terminally truncated DMD protein, e.g., produced from a dystrophin transcript with an out-of-frame deletion.

In some embodiments, a treatment for muscular dystrophy employs the use of a DMD oligonucleotide, wherein the oligonucleotide is capable of providing skipping of one or more exons. Skipping of one or more (e.g., multiple) DMD exons can, for example, remove a mutated exon, or compensate for a mutation (e.g., restoring from for a frameshift mutation) in an exon which is not skipped.

In some embodiments, the present disclosure encompasses the recognition that the nature and location of a DMD mutation may be utilized to design exon-skipping strategy. In some embodiments, if a DMD patient has a mutation in an exon, skipping of the mutated exon can produce an internally truncated (internally shortened) but at least partially functional DMD protein product.

In some embodiments, a DMD patient has a mutation which alters splicing of a DMD transcript, e.g., by inactivating a site required for splicing, or activating a cryptic site so that it becomes active for splicing, or by creating an alternative (e.g., unnatural) splice site. In some embodiments, such a mutation causes production of proteins with low or no activities. In some embodiments, splicing modulation, e.g., exon skipping, suppression of such a mutation, etc., can be employed to remove or reduce effects of such a mutation, e.g., by restoring proper splicing to produce proteins with restored activities, or producing an internally truncated dystrophin protein with improved or restored activities, etc.

In some embodiments, a DMD patient has a mutation which is a duplication of one or several exons, and the present disclosure provides exon skipping technologies to delete the duplication and/or to restore the reading frame.

In some embodiments, a DMD patient has a mutation which causes the skipping of an exon, which in turn can cause a frameshift. In some embodiments, the present disclosure provides technologies that can provide skipping of an additional exon(s) to restore the reading frame. For example, deletion of exon 51, which causes a frame shift, may be addressed by skipping of exon 50 or 52, which restores the reading frame. In some embodiments, a DMD patient has a mutation in one exon which causes a frame shift, and a deletion of a different exon(s) (e.g., a different exon, or an adjacent or flanking exon(s) immediately 5' or 3' to the mutated exon) restores the reading frame.

In some embodiments, restoring the reading frame can convert an out-of-frame mutation to an in-frame mutation; in some embodiments, in humans, such a change can transform severe Duchenne Muscular Dystrophy into milder Becker Muscular Dystrophy.

In some embodiments, a DMD patient or a patient suspected to have DMD is analyzed for DMD genotype prior to administration of a composition comprising a DMD oligonucleotide.

In some embodiments, a DMD patient or a patient suspected to have DMD is analyzed for DMD phenotype prior to administration of a composition comprising a DMD oligonucleotide.

In some embodiments, a DMD patient is analyzed for genotype and phenotype to determine the relationship of DMD genotype and DMD phenotype prior to administration of a composition comprising a DMD oligonucleotide.

In some embodiments, a patient is genetically verified to have dystrophy prior to administration of a composition comprising a DMD oligonucleotide.

In some embodiments, analysis of DMD genotype or genetic verification of DMD or a patient comprises determining if the patient has one or more deleterious mutations in DMD.

In some embodiments, analysis of DMD genotype or genetic verification of DMD or a patient comprises determining if the patient has one or more deleterious mutations in DMD and/or analyzing DMD splicing and/or detecting splice variants of DMD, wherein a splice variant is produced by an abnormal splicing of DMD.

In some embodiments, analysis of DMD genotype or genetic verification of DMD informs the selection of a composition comprising a DMD oligonucleotide useful for treatment.

In some embodiments, an abnormal or mutant DMD gene or a portion thereof is removed or copied from a patient or a patient's cell(s) or tissue(s) and the abnormal or mutant DMD gene, or a portion thereof comprising the abnormality or mutation, or a copy thereof, is inserted into a cell. In some embodiments, this cell can be used to test various compositions comprising a DMD oligonucleotide to predict if such a composition would be useful as a treatment for the patient. In some embodiments, the cell is a myoblast or myotubule.

In some embodiments, an individual or patient can produce, prior to treatment with a DMD oligonucleotide, one or more splice variants of DMD, often each variant being produced at a very low level. In some embodiments, a method such as that described in Example 20 can be used to detect low levels of splice variants being produced in a patient prior to, during or after administration of a DMD oligonucleotide.

In some embodiments, a patient and/or the tissues thereof are analyzed for production of various splicing variants of a DMD gene prior to administration of a composition comprising a DMD oligonucleotide.

In some embodiments, the present disclosure provides methods for designing a DMD oligonucleotide (e.g., an oligonucleotide capable of mediating skipping of one or more exons of DMD). In some embodiments, the present disclosure utilizes rationale design described herein and optionally sequence walks to design oligonucleotides, e.g., for testing exon skipping in one or more assays and/or conditions. In some embodiments, an efficacious oligonucleotide is developed following rational design, including using various information of a given biological system.

In some embodiments, in a method for developing DMD oligonucleotides, oligonucleotides are designed to anneal to one or more potential splicing-related motifs and then tested for their ability to mediate exon skipping. In some embodiments, splicing-related motifs include, but are not limited to, any one or more of: an acceptor, exon recognition sequence (ERS), exonic splice enhancer (ESE) site, splicing enhancer sequence (SES), branch point sequence, and donor splice site of a target exon. Certain sequences that may be involved in splicing were reported in, for example: Disset et al. 2006 Human Mol. Gen. 15: 999-1013.

In some embodiments, software packages, such as RESCUE-ESE, ESEfinder, and the PESX server, may be utilized to predict putative ESE sites (Fairbrother et al. 2002 Science 297: 1007-1013; Cartegni et al. 2003 Nat. Struct. Biol. 120-125; Zhang and Chasin 2004 Gen. Dev. 18: 1241-1250; Smith et al. 2006 Hum. Mol. Genet. 15: 2490-2508).

In some embodiments, a DMD oligonucleotide which targets or interacts with an acceptor, exon recognition sequence (ERS), exonic splice enhancer (ESE) site, or donor splice site of a DMD exon does not interact or significantly interact with a sequence in another (e.g., off-target) gene.

In some embodiments, in a rational approach to DMD oligonucleotide design, oligonucleotides are designed with consideration of secondary structures of dystrophin transcripts, e.g., mRNA. Designed oligonucleotide can then be assessed for exon skipping. A number of effective DMD oligonucleotides have been designed using rational approaches described in the present disclosure.

In some embodiments, alternatively or additionally, sequence walk, e.g., of an exon sequence can be performed to search for efficacious DMD oligonucleotide sequences.

In some embodiments, provided methods comprise sequence walking. In some embodiments, a set of overlapping oligonucleotides is generated. In some embodiments, oligonucleotides in a set have the same length, and the 5' ends of the oligonucleotides in the set are evenly spaced apart. In some embodiments, a set of overlapping oligonucleotides encompasses an entire exon or a portion(s) thereof. The 5' ends of the oligonucleotides in a walk can be evenly spaced at a suitable distance, e.g., 1 base apart, 2 bases apart, 3 bases apart, etc. Among other things, the present disclosure demonstrates that sequences can be optimized and in combination with chemistry and/or stereochemistry technologies of the present disclosure, highly effective oligonucleotides (and compositions and methods of use thereof) can be prepared.

Example Technologies for Assessing Oligonucleotides and Oligonucleotide Compositions Various technologies for assessing properties and/or activities of oligonucleotides can be utilized in accordance with the present disclosure, e.g., US20170037399, WO 2017/015555, WO 2017/015575, WO 2017/192664, WO 2017/062862, WO 2017/192679, WO 2017/210647, etc.

For example, DMD oligonucleotides can be evaluated for their ability to mediate exon skipping in various assays, including in vitro and in vivo assays, in accordance with the present disclosure. In vitro assays can be performed in various test cells described herein or known in the art, including but not limited to, A48-50 Patient-Derived Myoblast Cells. In vivo tests can be performed in test animals described herein or known in the art, including but not limited to, a mouse, rat, cat, pig, dog, monkey, or non-human primate.

As non-limiting examples, a number of assays are described below for assessing properties/activities of DMD oligonucleotides. Various other suitable assays are available and may be utilized to assess oligonucleotide properties/activities, including those of oligonucleotides not designed for exon skipping (e.g., for oligonucleotides that may involve RNase H for reducing levels of target transcripts, assays described in US20170037399, WO 2017/015555, WO 2017/015575, WO 2017/192664, WO 2017/192679, WO 2017/210647, etc.).

A DMD oligonucleotide can be evaluated for its ability to mediate skipping of an exon in the Dystrophin RNA, which can be tested, as non-limiting examples, using nested PCR, qRT-PCR, and/or sequencing.

A DMD oligonucleotide can be evaluated for its ability to mediate protein restoration (e.g., production of an internally truncated protein lacking the amino acids corresponding to the codons encoded in the skipped exon, which has improved functions compared to proteins (if any) produced prior to exon skipping), which can be evaluated by a number of methods for protein detection and/or quantification, such as western blot, immunostaining, etc. Antibodies to dystrophin are commercially available or if desired, can be developed for desired purposes.

A DMD oligonucleotide can be evaluated for its ability to mediate production of a stable restored protein. Stability of restored protein can be tested, in non-limiting examples, in assays for serum and tissue stability.

A DMD oligonucleotide can be evaluated for its ability to bind protein, such as albumin. Example related technologies include those described, e.g., in WO 2017/015555, WO 2017/015575, etc.

A DMD oligonucleotide can be evaluated for immuno activity, e.g., through assays for cytokine activation, complement activation, TLR9 activity, etc. Example related technologies include those described, e.g., in WO 2017/015555, WO 2017/015575, WO 2017/192679, WO 2017/210647, etc.

In some embodiments, efficacy of a DMD oligonucleotide can be tested, e.g., in in silico analysis and prediction, a cell-free extract, a cell transfected with artificial constructs, an animal such as a mouse with a human Dystrophin transgene or portion thereof, normal and dystrophic human myogenic cell lines, and/or clinical trials. It may be desirable to utilize more than one assay, as normal and dystrophic human myogenic cell lines may sometimes produce different efficacy results under certain conditions (Mitrpant et al. 2009 Mol. Ther. 17: 1418).

In some embodiments, DMD oligonucleotides can be tested in vitro in cells. In some embodiments, testing in vitro in cells involves gymnotic delivery of the oligonucleotide(s), or delivery using a delivery agent or transfectant, many of which are known in the art and may be utilized in accordance with the present disclosure.

In some embodiments, DMD oligonucleotides can be tested in vitro in normal human skeletal muscle cells (hSkMCs). See, for example, Arechavala et al. 2007 Hum. Gene Ther. 18: 798-810.

In some embodiments, DMD oligonucleotides can be tested in a muscle explant from a DMD patient. Muscle explants from DMD patients are reported in, for example, Fletcher et al. 2006 J. Gene Med. 8: 207-216; McClorey et al. 2006 Neur. Dis. 16: 583-590; and Arechavala et al. 2007 Hum. Gene Ther. 18: 798-810.

In some embodiments, cells are or comprise cultured muscle cells from DMD patients. See, for example: Aartsma-Rus et al. 2003 Hum. Mol. Genet. 8: 907-914.

In some embodiments, an individual DMD oligonucleotide may demonstrate experiment-to-experiment variability in its ability to skip an exon under certain circumstances. In some embodiments, an individual DMD oligonucleotide can demonstrate variability in its ability to skip an exon(s) depending on which cells are used, the growth conditions, and other experimental factors. To control variations, typically oligonucleotides to be tested and control oligonucleotides are assayed under the same or substantially the same conditions.

In vitro experiments also include those conducted with patient-derived myoblasts. Certain results from such experiments were described herein. In certain such experiments, cells were cultured in skeletal growth media to keep them in a dividing/immature myoblast state. The media was then changed to 'differentiation' media (containing insulin and 2% horse serum) concurrent with spiking oligonucleotides in the media for dosing. The cells differentiated into myotubes as they were getting dosed for a suitable period of time, e.g., a total of 4d for RNA experiments and 6d for protein experiments (such conditions referenced as 'Od pre-differentiation' (0d+4d for RNA, 0d+6d for protein)).

Without wishing to be bound by any particular theory, the present disclosure notes that it may be desirable to know if DMD oligonucleotides are able to enter mature myotubes and induce skipping in these cells as well as 'immature' cells. In some embodiments, the present disclosure provided assays to test effects of DMD oligonucleotides in myotubes. In some embodiments, a dosing schedule different from the 'Od pre-differentiation' was used, wherein the myoblasts were pre-differentiated into myotubes in differentiation media for several days (4d or 7d or 10d) and then DMD oligonucleotides were administered. Certain related protocols are described in Example 19.

In some embodiments, the present disclosure demonstrated that, in the pre-differentiation experiments, DMD oligonucleotides (excluding those which are PMOs) usually give about the same level of RNA skipping and dystrophin protein restoration, regardless of the number of days cells were cultured in differentiation media prior to dosing. In some embodiments, the present disclosure provides oligonucleotides that may be able to enter and be active in myoblasts and in myotubes. In some embodiments, a DMD oligonucleotide is tested in vitro in Δ45-52 DMD patient cells (also designated D45-52 or del45-52) or Δ52 DMD patient cells (also designated D52 or del52) with 0, 4 or 7 days of pre-differentiation.

In some embodiments, DMD oligonucleotides can be tested in any one or more of various animal models, including non-mammalian and mammalian models; including, as non-limiting examples, *Caenorhabditis, Drosophila*, zebrafish, mouse, rat, cat, dog and pig. See, for example, a review in McGreevey et al. 2015 Dis. Mod. Mech. 8:195-213.

Example use of mdx mice is reported in, for example: Lu et al. 2003 Nat. Med. 9: 1009; Jearawiriyapaisarn et al. 2008 Mol. Ther., 16, 1624-1629; Yin et al. 2008 Hum. Mol. Genet., 17, 3909-3918; Wu et al. 2009 Mol. Ther., 17, 864-871; Wu et al. 2008 Proc. Natl Acad. Sci. USA, 105, 14814-14819; Mann et al. 2001 Proc. Nat. Acad. Sci. USA 98: 42-47; and Gebski et al. 2003 Hum. Mol. Gen. 12: 1801-1811.

Efficacy of DMD oligonucleotides can be tested in dogs, such as the Golden Retriever Muscular Dystrophy (GRMD) animal model. Lu et al. 2005 Proc. Natl. Acad. Sci. USA 102: 198-203; Alter et al. 2006 Nat. Med. 12: 175-7; McClorey et al. 2006 Gene Ther. 13: 1373-81; and Yokota et al. 2012 Nucl. Acid Ther. 22: 306.

A DMD oligonucleotide can be evaluated in vivo in a test animal for efficient delivery to various tissues (e.g., skeletal, heart and/or diaphragm muscle); this can be tested, in non-limiting examples, by hybridization ELISA and tests for distribution in animal tissue.

A DMD oligonucleotide can be evaluated in vivo in a test animal for plasma PK; this can be tested, as non-limiting examples, by assaying for AUC(area under the curve) and half-life.

In some embodiments, DMD oligonucleotides can be tested in vivo, via an intramuscular administration a muscle of a test animal.

In some embodiments, DMD oligonucleotides can be tested in vivo, via an intramuscular administration into the gastrocnemius muscle of a test animal.

In some embodiments, DMD oligonucleotides can be tested in vivo, via an intramuscular administration into the gastrocnemius muscle of a mouse.

In some embodiments, DMD oligonucleotides can be tested in vivo, via an intramuscular administration into the gastrocnemius muscle of a mouse model transgenic for the entire human dystrophin locus. See, for example: Bremmer-Bout et al. 2004 Mol. Ther. 10, 232-240.

Additional tests which can be performed to evaluate the efficacy of DMO oligonucleotides include centrally nucleated fiber counts and dystrophin-positive fiber counts, and functional grip strength analysis. See, as non-limiting examples, experimental protocols reported in: Yin et al. 2009 Hum. Mol. Genet. 18: 4405-4414.

Additional methods of testing DMD oligonucleotides include, as non-limiting example, methods reported in: Kinali et al. 2009 Lancet 8: 918; Bertoni et al. 2003 Hum. Mol. Gen. 12: 1087-1099.

Certain Embodiments of Oligonucleotides and Compositions Thereof

Among other things, the present disclosure provides oligonucleotides, and compositions and methods of use thereof, useful for targeting various genes, including products encoded thereby and/or conditions, diseases and/or disorders associated therewith. In some embodiments, the present disclosure provides oligonucleotides, and compositions and methods of use thereof, for DMD. In some embodiments, the present disclosure provides a DMD oligonucleotide, wherein the base sequence of the DMD oligonucleotide is or comprises at least 15 contiguous bases of the sequence of any DMD oligonucleotide listed herein. In some embodiments, the present disclosure provides a DMD oligonucleotide, wherein the base sequence of the DMD oligonucleotide is or comprises at least 15 contiguous bases of the sequence of any DMD oligonucleotide listed herein, and wherein the DMD oligonucleotide is less than about 50 bases long. In some embodiments, the present disclosure provides an oligonucleotide or an oligonucleotide composition which comprises a non-negatively charged internucleotidic linkage.

In some embodiments, the present disclosure provides a chirally controlled composition of a DMD oligonucleotide (a plurality of DMD oligonucleotides), wherein the base sequence of the DMD oligonucleotide is or comprises at least 15 contiguous bases of the sequence of any DMD oligonucleotide listed herein. In some embodiments, the present disclosure provides a chirally controlled composition of a DMD oligonucleotide, wherein the base sequence of the DMD oligonucleotide is or comprises at least 15 contiguous bases of the sequence of any DMD oligonucleotide listed herein, and wherein the DMD oligonucleotide is less than about 50 bases long.

In some embodiments, the present disclosure provides a chirally controlled oligonucleotide having a sequence consisting of or comprising a sequence or a 15 base portion thereof found in any oligonucleotide listed in Table A1, wherein one or more U may be optionally and independently replaced with T or vice versa.

In some embodiments, the present disclosure provides a chirally controlled oligonucleotide comprising a sequence of UCAAGGAAGAUGGCAUUUCU (SEQ ID NO: 1), CUCCGGUUCUGAAGGUGUUC(SEQ ID NO: 18), or UUCUGAAGGUGUUCUUGUAC(SEQ ID NO: 40), or a portion thereof at least 15 bases long, wherein each U can be optionally and independently replaced by T, wherein at least one internucleotidic linkage is a chirally controlled internucleotidic linkage. In some embodiments, the present disclosure provides a chirally controlled oligonucleotide comprising a sequence of UCAAGGAAGAUGGCAUUUCU (SEQ ID NO: 1), CUCCGGUUCUGAAGGUGUUC(SEQ ID NO: 18), or UUCUGAAGGUGUUCUUGUAC(SEQ ID NO: 40), or a portion thereof at least 15 bases long, wherein each U can be optionally and independently replaced by T, wherein at least one chirally controlled internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof. In some embodiments, the present disclosure provides a chirally controlled oligonucleotide comprising a sequence of UCAAGGAAGAUGGCAUUUCU (SEQ ID NO: 1), CUCCGGUUCUGAAGGUGUUC(SEQ ID NO: 18), or UUCUGAAGGUGUUCUUGUAC(SEQ ID NO: 40), or a portion thereof at least 15 bases long, wherein each U can be optionally and independently replaced by T, wherein at least one chirally controlled internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, the present disclosure provides a chirally controlled oligonucleotide comprising a sequence of UCAAGGAAGAUGGCAUUUCU (SEQ ID NO: 1), CUCCGGUUCUGAAGGUGUUC(SEQ ID NO: 18), or UUCUGAAGGUGUUCUUGUAC(SEQ ID NO: 40), or a portion thereof at least 15 bases long, wherein each U can be optionally and independently replaced by T, wherein each internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, the present disclosure provides a chirally controlled oligonucleotide comprising a sequence of UCAAGGAAGAUGGCAUUUCU (SEQ ID NO: 1), CUCCGGUUCUGAAGGUGUUC (SEQ ID NO: 18), or UUCUGAAGGUGUUCUUGUAC(SEQ ID NO: 40), or a portion thereof at least 15 bases long, wherein each U can be optionally and independently replaced by T, wherein at least one internucleotidic linkage has the structure of formula I-c or a salt form thereof. In some embodiments, the present disclosure provides a chirally controlled oligonucleotide comprising a sequence of UCAAGGAAGAUGGCAUUUCU (SEQ ID NO: 1), CUCCGGUUCUGAAGGUGUUC(SEQ ID NO: 18), or UUCUGAAGGUGUUCUUGUAC(SEQ ID NO: 40), or a portion thereof at least 15 bases long, wherein each U can be optionally and independently replaced by T, wherein at least one internucleotidic linkage has the structure of formula I-c or a salt form thereof, and at least one internucleotidic linkage is a non-negatively charged internucleotidic linkage. In some embodiments, the present disclosure provides a chirally controlled oligonucleotide comprising a sequence of UCAAGGAAGAUGGCAUUUCU (SEQ ID NO: 1), CUCCGGUUCUGAAGGUGUUC(SEQ ID NO: 18), or UUCUGAAGGUGUUCUUGUAC (SEQ ID NO: 40), or a portion thereof at least 15 bases long, wherein each U can be optionally and independently replaced by T, wherein at least one internucleotidic linkage is a chirally controlled phosphorothioate internucleotidic linkage, and at least one internucleotidic linkage is a non-negatively charged internucleotidic linkage having the structure of formula I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, the present disclosure provides chirally a controlled oligonucleotide comprising a sequence of UCAAGGAAGAUGGCAUUUCU (SEQ ID NO: 1), CUCCGGUUCUGAAGGUGUUC(SEQ ID NO: 18), or UUCUGAAGGUGUUCUUGUAC(SEQ ID NO: 40), or a portion thereof at least 15 bases long, wherein each U can be optionally and independently replaced by T, wherein each internucleotidic linkage is a phosphodiester.

In some embodiments, an oligonucleotide comprises one or more internucleotidic linkages which comprise a phosphorus modification prone to "autorelease" under certain conditions. That is, under certain conditions, a particular phosphorus modification is designed such that it self-cleaves from the oligonucleotide to provide, e.g., a phosphate diester such as those found in naturally occurring DNA and RNA. In some embodiments, such a phosphorus modification has a structure of —O-L-$R^1$, wherein each of L and $R^1$ is independently as described in the present disclosure.

In some embodiments, a provided oligonucleotide of the present disclosure comprises chemical modifications and/or stereochemistry that delivers desirable properties, e.g., delivery to target cells/tissues/organs, pharmacodynamics, pharmacokinetics, etc.

In some embodiments, an oligonucleotide comprises a modification at a linkage phosphorus which can be transformed to a natural phosphate linkage by one or more esterases, nucleases, and/or cytochrome P450 enzymes, including but not limited to: CYP1A1, CYP1A2, CYP1B1, CYP2A6, CYP2A7, CYP2A13, CYP2B6, CYP2C8, CYP2C9, CYP2C18, CYP2C19, CYP2D6, CYP2E1, CYP2F1, CYP2J2, CYP2R1, CYP2S1, CYP2U1, CYP2W1, CYP3A4, CYP3A5, CYP3A7, CYP3A43, CYP4A11, CYP4A22, CYP4B1, CYP4F2, CYP4F3, CYP4F8, CYP4F11, CYP4F12, CYP4F22, CYP4V2, CYP4X1, CYP4Z1, CYP5A1, CYP7A1, CYP7B1, CYP8A1 (prostacyclin synthase), CYP8B1 (bile acid biosynthesis), CYP11A1, CYP11B1, CYP11B2, CYP17A1, CYP19A1, CYP20A1, CYP21A2, CYP24A1, CYP26A1, CYP26B1, CYP26C1, CYP27A1 (bile acid biosynthesis), CYP27B1 (vitamin D3 1-alpha hydroxylase, activates vitamin D3), CYP27C1 (unknown function), CYP39A1, CYP46A1, and CYP51A1 (lanosterol 14-alpha demethylase).

In some embodiments, an oligonucleotide comprises a modification at a linkage phosphorus that is a pro-drug moiety, e.g., a P-modification moiety facilitates delivery of an oligonucleotide to a desired location prior to removal. For instance, in some embodiments, a P-modification moiety results from PEGylation at the linkage phosphorus. One of skill in the relevant arts will appreciate that various PEG chain lengths are useful and that the selection of chain length will be determined in part by the result that is sought to be achieved by PEGylation. For instance, in some embodiments, PEGylation is effected in order to reduce RES uptake and extend in vivo circulation lifetime of an oligonucleotide.

In some embodiments, a PEGylation reagent for use in accordance with the present disclosure is of a molecular weight of about 300 g/mol to about 100,000 g/mol. In some embodiments, a PEGylation reagent is of a molecular weight of about 300 g/mol to about 10,000 g/mol. In some embodiments, a PEGylation reagent is of a molecular weight of about 300 g/mol to about 5,000 g/mol. In some embodiments, a PEGylation reagent is of a molecular weight of about 500 g/mol. In some embodiments, a PEGylation reagent of a molecular weight of about 1000 g/mol. In some embodiments, a PEGylation reagent is of a molecular weight of about 3000 g/mol. In some embodiments, a PEGylation reagent is of a molecular weight of about 5000 g/mol.

In certain embodiments, a PEGylation reagent is PEG500. In certain embodiments, a PEGylation reagent is PEG1000. In certain embodiments, a PEGylation reagent is PEG3000. In certain embodiments, a PEGylation reagent is PEG5000.

In some embodiments, an oligonucleotide comprises a P-modification moiety that acts as a PK enhancer, e.g., lipids, PEGylated lipids, etc.

In some embodiments, oligonucleotides of the present disclosure, e.g., DMD oligonucleotides, comprise a P-modification moiety that promotes cell entry and/or endosomal escape, such as a membrane-disruptive lipid or peptide.

In some embodiments, an oligonucleotide comprises a P-modification moiety that acts as a targeting moiety. In some embodiments, a P-modification moiety is or comprises a targeting moiety. In some embodiments, a target moiety is an entity that is associates with a payload of interest (e.g., with an oligonucleotide or oligonucleotide composition) and also interacts with a target site of interest so that the payload of interest is targeted to the target site of interest when associated with the targeting moiety to a materially greater extent than is observed under otherwise comparable conditions when the payload of interest is not associated with the targeting moiety. A targeting moiety may be, or comprise, any of a variety of chemical moieties, including, for example, small molecule moieties, nucleic acids, polypeptides, carbohydrates, etc. Targeting moieties are described, e.g., in Adarsh et al., "Organelle Specific Targeted Drug Delivery—A Review," International Journal of Research in Pharmaceutical and Biomedical Sciences, 2011, p. 895.

Examples of such targeting moieties include, but are not limited to, proteins (e.g. Transferrin), oligopeptides (e.g., cyclic and acyclic RGD-containing oligopeptides), antibodies (monoclonal and polyclonal antibodies, e.g. IgG, IgA, IgM, IgD, IgE antibodies), sugars/carbohydrates (e.g., monosaccharides and/or oligosaccharides (mannose, mannose-6-phosphate, galactose, and the like)), vitamins (e.g., folate), or other small biomolecules. In some embodiments, a targeting moiety is a steroid molecule (e.g., bile acids including cholic acid, deoxycholic acid, dehydrocholic acid; cortisone; digoxigenin; testosterone; cholesterol; cationic steroids such as cortisone having a trimethylaminomethyl hydrazide group attached via a double bond at the 3-position of the cortisone ring, etc.). In some embodiments, a targeting moiety is a lipophilic molecule (e.g., alicyclic hydrocarbons, saturated and unsaturated fatty acids, waxes, terpenes, and polyalicyclic hydrocarbons such as adamantine and buckminsterfullerenes). In some embodiments, a lipophilic molecule is a terpenoid such as vitamin A, retinoic acid, retinal, or dehydroretinal. In some embodiments, a targeting moiety is a peptide.

In some embodiments, a P-modification moiety is a targeting moiety having the structure of —X-L-$R^1$ wherein each of X, L, and $R^1$ is independently as described in the present disclosure.

In some embodiments, a P-modification moiety facilitates cell specific delivery.

In some embodiments, a P-modification moiety may perform one or more than one functions. For instance, in some embodiments, a P-modification moiety acts as a PK enhancer and a targeting ligand. In some embodiments, a P-modification moiety acts as a pro-drug and an endosomal escape agent. Numerous other such combinations are possible and are included in the present disclosure.

Certain Examples of Oligonucleotides and Compositions

In some embodiments, the present disclosure provides oligonucleotides and/or oligonucleotide compositions that are useful for various purposes, e.g., modulating skipping, reducing levels of transcripts, improving levels of beneficial proteins, treating conditions, diseases and disorders, etc. In some embodiments, the present disclosure provides oligonucleotide compositions with improved properties, e.g., increased activities, reduced toxicities, etc. Among other things, oligonucleotides of the present disclosure comprise chemical modifications, stereochemistry, and/or combinations thereof which can improve various properties and activities of oligonucleotides. Non-limiting examples are listed in Table A1. In some embodiments, an oligonucleotide type is a type as defined by the base sequence, pattern of backbone linkages, pattern of backbone chiral centers and pattern of backbone phosphorus modifications of an oligonucleotide in Table A1, wherein the oligonucleotide comprises at least one chirally controlled internucleotidic linkage (at least one R or S in "Stereochemistry/Linkage"). In some embodiments, a plurality of oligonucleotides of a particular oligonucleotide type is a plurality of an oligonucleotide in Table A1 (e.g., a plurality of oligonucleotides is a plurality of WV-1095). In some embodiments, a plurality of oligonucleotides in a chirally controlled oligonucleotide composition is a plurality of an oligonucleotide in Table A1 (e.g., a plurality of oligonucleotides is a plurality of WV-1095), wherein the oligonucleotide comprises at least one chirally controlled internucleotidic linkage (at least one R or S in "Stereochemistry/Linkage").

Table A1 lists non-limiting examples of DMD oligonucleotides. All of the oligonucleotides in Table A1 are DMD oligonucleotides, except for WV-12915, WV-12914, WV-12913, WV-12912, WV-12911, WV-12910, WV-12909, WV-12908, WV-12907, WV-12906, WV-12905, WV-12904, WV-15887, WV-24100, WV-24101, WV-24102, WV-24103, WV-24104, WV-24105, WV-24106, WV-24107, WV-24108, WV-24109, WV-24110, WV-XBD108, WV-XBD 109, WV-XBD 110, WV-XKCD108, WV-XKCD 109, WV-XKCD 110, which all target Malat-1, which is a gene target different than DMD.

In some embodiments, the present disclosure pertains to an oligonucleotide or oligonucleotide composition, wherein the base sequence of the oligonucleotide comprises at least 15 contiguous bases, with 1-3 mismatches, of the base sequence of a DMD oligonucleotide disclosed in Table A1. In some embodiments, the present disclosure pertains to an oligonucleotide or oligonucleotide composition, wherein the base sequence of the oligonucleotide comprises at least 15 contiguous bases of the base sequence of a DMD oligonucleotide disclosed in Table A1. In some embodiments, the present disclosure pertains to an oligonucleotide or oligonucleotide composition, wherein the base sequence of the oligonucleotide comprises the base sequence of a DMD oligonucleotide disclosed in Table A1. In some embodiments, the present disclosure pertains to an oligonucleotide or oligonucleotide composition, wherein the base sequence of the oligonucleotide is the base sequence of a DMD oligonucleotide disclosed in Table A1.

In some embodiments, the present disclosure pertains to an oligonucleotide or oligonucleotide composition, wherein the base sequence of the oligonucleotide comprises at least 15 contiguous bases, with 1-3 mismatches, of the base sequence of a DMD oligonucleotide disclosed in Table A1, or wherein the base sequence of the oligonucleotide comprises at least 15 contiguous bases of the base sequence of a DMD oligonucleotide disclosed in Table A1, or wherein the base sequence of the oligonucleotide comprises the base sequence of a DMD oligonucleotide disclosed in Table A1, or wherein the base sequence of the oligonucleotide is the base sequence of a DMD oligonucleotide disclosed in Table A1; and wherein the oligonucleotide is stereorandom (e.g., not chirally controlled), or the oligonucleotide is chirally controlled, and/or the oligonucleotide comprises at least one internucleotidic linkage which is chirally controlled, and/or the oligonucleotide optionally comprises a sugar modification which is a LNA, and/or the oligonucleotide comprises a sugar which is a natural deoxyribose, a 2'-OMe or a 2'-MOE. In some embodiments, the present disclosure pertains to an oligonucleotide capable of mediating skipping of a DMD exon, wherein the oligonucleotide comprises at least one LNA.

In the following table ID indicates identification or oligonucleotide number; and Description indicates the modified sequence.

TABLE A1

| ID | Description | SEQ ID NO: | Naked Base Sequence | Linkage / Stereochemistry |
|---|---|---|---|---|
| ONT -395 | mU*S mC*S mA*S mA*S mG*S mG*S mA*S mA*S mG*S mA*S mU*S mG*S mG*S mC*S mA*S mU*S mU*S mU*S mC*S mU | 61 | UCAAGGAAGAUGGCA UUUCU | SSSSSSSSSSSSSSS SSSS |
| WV-1093 | G * G * C * C * A * A * A * C * C * T * C * G * G * C * T * T * A * C * C * T | 62 | GGCCAAACCTCGGCT TACCT | XXXXX XXXXX XXXXX XXXX |
| WV-1094 | mG mG mC mC mA mA mA mC mC mU mC mG mG mC mU mU mA mC mC mU | 63 | GGCCAAACCUCGGCU UACCU | OOOOO OOOOO OOOOOOOOO |
| WV-1095 | G * RG * RC * RC * RA * RA * RA * RC * RC * RT * RC * RG * RG * RC * RT * RT * RA * RC * RC * RT | 64 | GGCCAAACCUCGGCU TACCT | RRRRRRRRRRRRR RRRRRR |
| WV-1096 | G * SG * SC * SC * SA * SA * SA * SC * SC * ST * SC * SG * SG * SC * ST * ST * SA * SC * SC * ST | 65 | GGCCAAACCTCGGCT TACCT | SSSSSSSSSSSSSSS SSSS |
| WV-1097 | G * SG * SC * SC * SA * S mA mA mC mC mU mC mG mG mCT * ST * SA * SC * SC * ST | 66 | GGCCAAACCUCGGCT TACCT | SSSSSOOOOOOOO OSSSSS |
| WV-1098 | mG mG mC mCA * SA * SA * S mCC * ST * SC * SG * S mGC * ST * ST * S mA mC mC mU | 67 | GGCCAAACCUCGGCT TACCU | OOOOSSSOSSSSOS SSOOO |
| WV-1099 | G * S mGC * S mCA * S mAA * S mCC * S mUC * S mGG * S mCT * S mUA * S mCC * S mU | 68 | GGCCAAACCUCGGCT UACCU | SOSOSOSOSOSOS OSOSOS |
| WV-1100 | mGG * S mCC * S mAA * S mAC * S mCT * S mCG * S mGC * S mUT * S mAC * S mC mU | 69 | GGCCAAACCTCGGCU TACCU | OSOSOSOSOSOSO SOSOSO |
| WV-1101 | G * SG * S mC mCA * SA * S mA mCC * ST * SC * S mG mGC * ST * S mU mAC * SC * S mU | 70 | GGCCAAACCTCGGCT UACCU | SSOOSSOOSSSOOS SOOSS |
| WV-1102 | G * SG * SC * S mC mA mAA * SC * S mC mU mCG * SG * S mC mU mUA * SC * SC * S mU | 71 | GGCCAAACCUCGGCU UACCU | SSSOOOSSOOOSS OOOSSS |
| WV-1103 | G * SG * SC * SC * S mA mA mA mCC * ST * SC * S mG mG mC mUT * SA * SC * SC * S mU | 72 | GGCCAAACCTCGGCU TACCU | SSSSOOOOSSSOO OOSSSS |
| WV-1104 | G * SG * SC * S mCA * SA * SA * S mCC * ST * SC * S mGG * SC * ST * S mUA * SC * SC * S mU | 73 | GGCCAAACCTCGGCT UACCU | SSSOSSSOSSSOSS SOSSS |
| WV-1105 | mG mG mC mCA * SA * SA * SC * SC * S mU mC mG mG mCT * ST * SA * SC * SC * S mU | 74 | GGCCAAACCUCGGCT TACCU | OOOOSSSSSOOOO OSSSSS |
| WV-1106 | G * SG * S mC mC mA mA mA mC mC mUC * S mG mGC * S mUT * SA * SC * SC * S mU | 75 | GGCCAAACCUCGGCU TACCU | SSOOOOOOOOSO OSOSSSS |
| WV-1107 | T * C * A * A * G * G * A * A * G * A * T * G * G * C * A * T * T * T * C * T | 76 | TCAAGGAAGATGGCA TTTCT | XXXXX XXXXX XXXXX XXXX |

TABLE A1-continued

| | | | | |
|---|---|---|---|---|
| WV-1108 | mU mC mA mA mG mG mA mA mG mA mU mG mG mC mA mU mU mU mC mU | 77 | UCAAGGAAGAU GGCAUUUCU | OOOOO OOOOO O OOOOOOOO |
| WV-1109 | T * RC * RA * RA * RG * RG * RA * RA * RG * RA * RT * RG * RG * RC * RA * RT * RT * RT* RC * RT | 78 | TCAAGGAAGATGGCA TTTCT | RRRRRRRRRRRRR RRRRRR |
| WV-1110 | T * SC * SA * SA * SG * SG * SA * SA * SG * SA * ST * SG * SG * SC * SA * ST * ST * ST * SC * ST | 79 | TCAAGGAAGATGGCA TTTCT | SSSSSSSSSSSSSSS SSSS |
| WV-1111 | T * SC * SA * SA * SG * S mG mA mA mG mA mU mG mG mCA * ST * ST * ST * SC * ST | 80 | TCAAGGAAGAUGGCA TTTCT | SSSSSOOOOOOOOO OSSSSS |
| WV-1112 | mU mC mA mAG * SG * SA * S mAG * SA * ST * SG * S mGC * SA * ST * S mU mU mC mU | 81 | UCAAGGAAGATGGCA TUUCU | OOOOSSSOSSSSOSSS OOO |
| WV-1113 | T * S mCA * S mAG * S mGA * S mAG * S mAT * S mGG * S mCA * S mUT * S mUC * S mU | 82 | TCAAGGAAGATGGCA UTUCU | SOSOSOSOSOSOS OSOSOS |
| WV-1114 | mUC * S mAA * S mGG * S mAA * S mGA * S mUG * S mGC * S mAT * S mUT * S mC mU | 83 | UCAAGGAAGAUGGCA TUTCU | OSOSOSOSOSOSO SOSOSO |
| WV-1115 | T * SC * S mA mAG * SG * S mA mAG * SA * ST * S mG mGC * SA * S mU mUT * SC * S mU | 84 | TCAAGGAAGATGGCA UUTCU | SSOOSSOOSSSOOS SOOSS |
| WV-1116 | T * SC * SA * S mA mG mGA * SA * S mG mA mUG * SG * S mC mA mUT * ST * SC * S mU | 85 | TCAAGGAAGAUGGCA UTTCU | SSSOOOSSOOOSS OOOSSS |
| WV-1117 | T * SC * SA * SA * S mG mG mA mAG * SA * ST * S mG mG mC mAT * ST * ST * SC * S mU | 86 | TCAAGGAAGATGGCA TTTCU | SSSSOOOOSSSOO OOSSSS |
| WV-1118 | T * SC * SA * S mAG * SG * SA * S mAG * SA * ST * S mGG * SC * SA * S mUT * ST * SC * S mU | 87 | TCAAGGAAGATGGCA UTTCU | SSSOSSSOSSSOSS SOSSS |
| WV-1119 | mU mC mA mAG * SG * SA * SA * SG * S mA mU mG mG mCA * ST * ST * ST * SC * S mU | 88 | UCAAGGAAGAUGGCA TTTCU | OOOOSSSSSOOOO OSSSSS |
| WV-1120 | T * SC * S mA mA mG mG mA mA mG mAT * S mG mGC * S mAT * ST * ST * SC * S mU | 89 | TCAAGGAAGATGGCA TTTCU | SSOOOOOOOOSO OSOSSSS |
| WV-1121 | G * G * C * C * A * mA mA mC mC mU mC mG mG mCT * T * A * C * C * T | 90 | GGCCAAACCUCGGCT TACCT | XXXXXOOOOOOO OOXXXXX |
| WV-1122 | mG mG mC mCA * A * A * mCC * T * C * G * mGC * T * T * mA mC mC mU | 91 | GGCCAAACCTCGGCT TACCU | OOOOXXXOXXXX OXXXOOO |
| WV-1123 | G * mGC * mCA * mAA * mCC * mUC * mGG * mCT * mUA * mCC * mU | 92 | GGCCAAACCUCGGCT UACCU | XOXOXOXOXOXO XOXOXOX |
| WV-1124 | mGG * mCC * mAA * mAC * mCT * mCG * mGC * mUT * mAC * mC mU | 93 | GGCCAAACCTCGGCU TACCU | OXOXOXOXOXOX OXOXOXO |

TABLE A1-continued

| | | | | |
|---|---|---|---|---|
| WV-1125 | G * G * mC mCA * A * mA mC mCT * C * mG mGC * T * mU mAC * C * mU | 94 | GGCCAAACCTCGGCTUACCU | XXOOXXOOOXXOOXXOOXX |
| WV-1126 | G * G * C * mC mA mAA * C * mC mU mCG * G * mC mU mUA * C * C * mU | 95 | GGCCAAACCUCGGCUUACCU | XXXOOOXXOOOXXOOOXXX |
| WV-1127 | G * G * C * C * mA mA mA mCC * T * C * mG mG mC mUT * A * C * C * mU | 96 | GGCCAAACCTCGGCUTACCU | XXXXOOOOXXXOOOOXXXX |
| WV-1128 | G * G * C * mCA * A * A * mCC * T * C * mGG * C * T * mUA * C * C * mU | 97 | GGCCAAACCTCGGCTUACCU | XXXOXXXOXXXOXXXOXXX |
| WV-1129 | mG mG mC mCA * A * A * C * C * mU mC mG mG mCT * T * A * C * C * mU | 98 | GGCCAAACCUCGGCTTACCU | OOOOXXXXXOOOOOXXXXX |
| WV-1130 | G * G * mC mC mA mA mA mC mC mUC * mG mGC * mUT * A * C * C * mU | 99 | GGCCAAACCUCGGCUTACCU | XXOOOOOOOOXOOXOXXXX |
| WV-1131 | T * C * A * A * G * mG mA mA mG mA mU mG mG mCA * T * T * T * C * T | 100 | TCAAGGAAGAUGGCATTTCT | XXXXXOOOOOOOOOXXXXX |
| WV-1132 | mU mC mA mAG * G * A * mAG * A * T * G * mGC * A * T * mU mU mC mU | 101 | UCAAGGAAGATGGCAUUUCU | OOOOXXXOXXXXOXXXOOO |
| WV-1133 | T * mCA * mAG * mGA * mAG * mAT * mGG * mCA * mUT * mUC * mU | 102 | TCAAGGAAGATGGCAUTUCU | XOXOXOXOXOXOXOXOXOX |
| WV-1134 | mUC * mAA * mGG * mAA * mGA * mUG * mGC * mAT * mUT * mC mU | 103 | UCAAGGAAGAUGGCATUTCU | OXOXOXOXOXOXOXOXOXO |
| WV-1135 | T * C * mA mAG * G * mA mAG * A * T * mG mGC * A * mU mUT * C * mU | 104 | TCAAGGAAGATGGCAUUTCU | XXOOXXOOXXXOOXXOOXX |
| WV-1136 | T * C * A * mA mG mGA * A * mG mA mUG * G * mC mA mUT * T * C * mU | 105 | TCAAGGAAGAUGGCAUTTCU | XXXOOOXXOOOXXOOOXXX |
| WV-1137 | T * C * A * A * mG mG mA mAG * A * T * mG mG mC mAT * T * T * C * mU | 106 | TCAAGGAAGATGGCATTTCU | XXXXOOOOXXXOOOOXXXX |
| WV-1138 | T * C * A * mAG * G * A * mAG * A * T * mGG * C * A * mUT * T * C * mU | 107 | TCAAGGAAGATGGCAUTTCU | XXXOXXXOXXXOXXXOXXX |
| WV-1139 | mU mC mA mAG * G * A * A * G * mA mU mG mG mCA * T * T * T * C * mU | 108 | UCAAGGAAGAUGGCATTTCU | OOOOXXXXXOOOOOXXXXX |
| WV-1140 | T * C * mA mA mG mG mA mA mG mAT * mG mGC * mAT * T * T * C * mU | 109 | TCAAGGAAGATGGCATTTCU | XXOOOOOOOOXOOXOXXXX |
| WV-1141 | mG * mG * mC * mC * mA * mA mA mC mC mU mC mG mG mC mU * mU * mA * mC * mC * mU | 110 | GGCCAAACCUCGGCUUACCU | XXXXXOOOOOOOOOXXXXX |

TABLE A1-continued

| | | | | |
|---|---|---|---|---|
| WV-1142 | mG mG mC mC mA * mA * mA * mC mC * mU * mC * mG * mG mC * mU * mU * mA mC mC mU | 111 | GGCCAAACCUCGGCUUACCU | OOOOXXXOXXXXOXXXOOO |
| WV-1143 | mG * mG mC * mC mA * mA mA * mC mC * mU mC * mG mG * mC mU * mU mA * mC mC * mU | 112 | GGCCAAACCUCGGCUUACCU | XOXOXOXOXOXOXOXOXOX |
| WV-1144 | mG mG * mC mC * mA mA * mA mC * mC mU * mC mG * mG mC * mU mU * mA mC * mC mU | 113 | GGCCAAACCUCGGCUUACCU | OXOXOXOXOXOXOXOXOXO |
| WV-1145 | mG * mG * mC mC mA * mA * mA mC mC mU * mC * mG mG mC * mU * mU mA mC * mC * mU | 114 | GGCCAAACCUCGGCUUACCU | XXOOXXOOOXXOOXXOOXX |
| WV-1146 | mG * mG * mC * mC mA mA mA * mC * mC mU mC mG * mG * mC mU mU mA * mC * mC * mU | 115 | GGCCAAACCUCGGCUUACCU | XXXOOOXXOOOXXOOOXXX |
| WV-1147 | mG * mG * mC * mC * mA mA mA mC mC * mU * mC * mG mG mC mU mU * mA * mC * mC * mU | 116 | GGCCAAACCUCGGCUUACCU | XXXXOOOOXXXOOOOXXXX |
| WV-1148 | mG * mG * mC * mC mA * mA * mA * mC mC * mU * mC * mG mG * mC * mU * mU mA * mC * mC * mU | 117 | GGCCAAACCUCGGCUUACCU | XXXOXXXOXXXOXXXOXXX |
| WV-1149 | mG mG mC mC mA * mA * mA * mC * mC * mU mC mG mG mC mU * mU * mA * mC * mC * mU | 118 | GGCCAAACCUCGGCUUACCU | OOOOXXXXXOOOOOXXXXX |
| WV-1150 | mG * mG * mC mC mA mA mA mC mC mU mC * mG mG mC * mU mU * mA * mC * mC * mU | 119 | GGCCAAACCUCGGCUUACCU | XXOOOOOOOOXOOXOXXXX |
| WV-1151 | mU * mC * mA * mA * mG * mG mA mA mG mA mU mG mG mC mA * mU * mU * mU * mC * mU | 120 | UCAAGGAAGAUGGCAUUUCU | XXXXXOOOOOOOOOXXXXX |
| WV-1152 | mU mC mA mA mG * mG * mA * mA mG * mA * mU * mG * mG mC * mA * mU * mU mU mC mU | 121 | UCAAGGAAGAUGGCAUUUCU | OOOOXXXOXXXXOXXXOOO |
| WV-1153 | mU * mC mA * mA mG * mG mA * mA mG * mA mU * mG mG * mC mA * mU mU * mU mC * mU | 122 | UCAAGGAAGAUGGCAUUUCU | XOXOXOXOXOXOXOXOXOX |
| WV-1154 | mU mC * mA mA * mG mG * mA mA * mG mA * mU mG * mG mC * mA mU * mU mU * mC mU | 123 | UCAAGGAAGAUGGCAUUUCU | OXOXOXOXOXOXOXOXOXO |
| WV-1155 | mU * mC * mA mA mG * mG * mA mA mG * mA * mU * mG mG mC * mA * mU mU mU * mC * mU | 124 | UCAAGGAAGAUGGCAUUUCU | XXOOXXOOXXXOOXXOOXX |
| WV-1156 | mU * mC * mA * mA mG mG mA * mA * mG mA mU mG * mG * mC mA mU mU * mU * mC * mU | 125 | UCAAGGAAGAUGGCAUUUCU | XXXOOOXXOOOXXOOOXXX |
| WV-1157 | mU * mC * mA * mA * mG mG mA mA mG * mA * mU * mG mG mC mA mU * mU * mU * mC * mU | 126 | UCAAGGAAGAUGGCAUUUCU | XXXXOOOOXXXOOOOXXXX |
| WV-1158 | mU * mC * mA * mA mG * mG * mA * mA mG * mA * mU * mG mG * mC * mA * mU mU * mU * mC * mU | 127 | UCAAGGAAGAUGGCAUUUCU | XXXOXXXOXXXOXXXOXXX |

TABLE A1-continued

| | | | | |
|---|---|---|---|---|
| WV-1159 | mU mC mA mA mG * mG * mA * mA * mG * mA mU mG mG mC mA * mU * mU * mU * mC * mU | 128 | UCAAGGAAGAUGGCAUUUCU | OOOOXXXXXOOOOOXXXXX |
| WV-1160 | mU * mC * mA mA mG mG mA mA mG mA mU * mG mG mC * mA mU * mU * mU * mC * mU | 129 | UCAAGGAAGAUGGCAUUUCU | XXOOOOOOOOXOOXOXXXX |
| WV-1678 | fG * fG * fC * fC * fA * fA * fA * fC * fC * fU * fC * fG * fG * fC * fU * fU * fA * fC * fC * fU | 130 | GGCCAAACCUCGGCUUACCU | XXXXX XXXXXXXXXX XXXX |
| WV-1679 | mG * mG * fC * fC * mA * mA * mA * fC * fC * fU * fC * mG * mG * fC * fU * fU * mA * fC * fC * fU | 131 | GGCCAAACCUCGGCUUACCU | XXXXX XXXXXXXXXX XXXX |
| WV-1680 | fG * fG * mC * mC * fA * fA * fA * mC * mC * mU * mC * fG * fG * mC * mU * mU * fA * mC * mC * mU | 132 | GGCCAAACCUCGGCUUACCU | XXXXX XXXXXXXXXX XXXX |
| WV-1681 | mG * fG * mC * fC * mA * fA * mA * fC * mC * fU * mC * fG * mG * fC * mU * fU * mA * fC * mC * fU | 133 | GGCCAAACCUCGGCUUACCU | XXXXX XXXXXXXXXX XXXX |
| WV-1682 | mG * mG * mC * mC * mA * mA * fA * fC * fC * fU * fC * fG * fG * fC * mU * mU * mA * mC * mC * mU | 134 | GGCCAAACCUCGGCUUACCU | XXXXX XXXXXXXXXX XXXX |
| WV-1683 | fG * fG * fC * fC * fA * fA * mA * mC * mC * mU * mC * mG * mG * mC * fU * fU * fA * fC * fC * fU | 135 | GGCCAAACCUCGGCUUACCU | XXXXX XXXXXXXXXX XXXX |
| WV-1684 | fG * fU * fC * fC * mA * mA * mA * fC * fC * mU * fC * fG * fG * fC * mU * mU * mA * fC * fC * mU | 136 | GGCCAAACCUCGGCUUACCU | XXXXX XXXXXXXXXX XXXX |
| WV-1685 | mG * mG * mC * mC * fA * fA * fA * mC * mC * fu * mC * mG * mG * mC * fU * fU * fA * mC * mC * fU | 137 | GGCCAAACCUCGGCUUACCU | XXXXX XXXXXXXXXX XXXX |
| WV-1687 | rA rG rA rA rA rU rG rC rC rA rU rC rU rU rC rC rU rU rG rA | 138 | AGAAAUGCCAUCUUCCUUGA | OOOOO OOOOOOOOOOOOOO |
| WV-1709 | fU * fC * fA * fA * fG * fG * fA * fA * fG * fA * fU * fG * fG * fC * fA * fU * fU * fU * fC * fU | 139 | UCAAGGAAGAUGGCAUUUCU | XXXXX XXXXXXXXXX XXXX |
| WV-1710 | fU * fC * mA * mA * mG * mG * mA * mA * mG * mA * fU * mG * mG * fC * mA * fU * fU * fU * fC * fU | 140 | UCAAGGAAGAUGGCAUUUCU | XXXXX XXXXXXXXXX XXXX |
| WV-1711 | mU * mC * fA * fA * fG * fG * fA * fA * fG * fA * mU * fG * fG * mC * fA * mU * mU * mU * mC * mU | 141 | UCAAGGAAGAUGGCAUUUCU | XXXXX XXXXXXXXXX XXXX |
| WV-1712 | mU * fC * mA * fA * mG * fG * mA * fA * mG * fA * mU * fG * mG * fC * mA * fU * mU * fU * mC * fU | 142 | UCAAGGAAGAUGGCAUUUCU | XXXXX XXXXXXXXXX XXXX |
| WV-1713 | mU * mC * mA * mA * mG * mG * fA * fA * fG * fA * fU * fG * fG * fC * mA * mU * mU * mU * mC * mU | 143 | UCAAGGAAGAUGGCAUUUCU | XXXXX XXXXXXXXXX XXXX |
| WV-1714 | fU * fC * fA * fA * fG * fG * mA * mA * mG * mA * mU * mG * mG * mC * fA * fU * fU * fU * fC * fU | 144 | UCAAGGAAGAUGGCAUUUCU | XXXXX XXXXXXXXXX XXXX |

TABLE A1-continued

| | | | | |
|---|---|---|---|---|
| WV-1715 | mU * fC * mA * mA * fG * fG * mA * mA * fG * mA * mU * fG * fG * fC * mA * mU * mU * mU * fC * mU | 145 | UCAAGGAAGAUGGCAUUUCU | XXXXX XXXXXXXXXX XXXX |
| WV-1716 | fU * mC * fA * fA * mG * mG * fA * fA * mG * fA* fU * mG * mG * mC * fA * fU * fU * fU * mC * fU | 146 | UCAAGGAAGAUGGCAUUUCU | XXXXX XXXXXXXXXX XXXX |
| WV-2095 | fU * fC * fA * fA * fG * mG * mA * mA * mG * mA * mU * mG * mG * mC * mA * fU * fU * fU * fC * fU | 147 | UCAAGGAAGAUGGCAUUUCU | XXXXX XXXXXXXXXX XXXX |
| WV-2096 | fU * fC * fA * fA * mG * mG * mA * mA * mG * mA * mU * mG * mG * mC * mA * mU * fU * fU * fC * fU | 148 | UCAAGGAAGAUGGCAUUUCU | XXXXX XXXXXXXXXX XXXX |
| WV-2097 | fU * fC * fA * mA * mG * mG * mA * mA * mG * mA * mU * mG * mG * mC * mA * mU * mU * fU * fC * fU | 149 | UCAAGGAAGAUGGCAUUUCU | XXXXX XXXXXXXXXX XXXX |
| WV-2098 | fU * fC * mA * mA * mG * mG * mA * mA * mG * mA * mU * mG * mG * mC * mA * mU * mU * mU * fC * fU | 150 | UCAAGGAAGAUGGCAUUUCU | XXXXX XXXXXXXXXX XXXX |
| WV-2099 | fU * mC * mA * mA * mG * mG * mA * mA * mG * mA * mU * mG * mG * mC * mA * mU * mU * mU * mC * fU | 151 | UCAAGGAAGAUGGCAUUUCU | XXXXX XXXXXXXXXX XXXX |
| WV-2100 | fU * fC * fA * fA * fG * fG mA * mA * mG * mA * mU * mG * mG * mCfA * fU * fU * fU * fC * fU | 152 | UCAAGGAAGAUGGCAUUUCU | XXXXXOXXXXXXXOXXXXXX |
| WV-2101 | fU * fC * fA * fA * fGfG mA * mA * mG * mA * mU * mG * mG * mCfAfU * fU * fU * fC * fU | 153 | UCAAGGAAGAUGGCAUUUCU | XXXXOOXXXXXXXOOXXXX |
| WV-2102 | fU * fC * fA * fAfGfG mA * mA * mG * mA * mU * mG * mG * mCfAfUfU * fU * fC * fU | 154 | UCAAGGAAGAUGGCAUUUCU | XXXOOOXXXXXXXOOOXXX |
| WV-2103 | fU * fC * fAfAfGfG mA * mA * mG * mA * mU * mG * mG * mCfAfUfUfU * fC * fU | 155 | UCAAGGAAGAUGGCAUUUCU | XXOOOOXXXXXXXOOOOXX |
| WV-2104 | fU * fCfAfAfGfG mA * mA * mG * mA * mU * mG * mG * mCfAfUfUfUfC * fU | 156 | UCAAGGAAGAUGGCAUUUCU | XOOOOOXXXXXXXOOOOOX |
| WV-2105 | fUfCfAfAfGfG mA * mA * mG * mA * mU * mG * mG * mCfAfUfUfUfCfU | 157 | UCAAGGAAGAUGGCAUUUCU | OOOOOOXXXXXXXOOOOOO |
| WV-2106 | fU * fC * fA * fA * fG * fG * fA * fA * fG * fA * mU * mG * mG *mC * mA * mU * mU * mU * mC * mU | 158 | UCAAGGAAGAUGGCAUUUCU | XXXXX XXXXXXXXXX XXXX |
| WV-2107 | mU * mC * mA * mA * mG * mG * mA * mA * mG * mA * fU * fG * fG * fC * fA * fU * fU * fU * fC * fU | 159 | UCAAGGAAGAUGGCAUUUCU | XXXXX XXXXXXXXXX XXXX |
| WV-2108 | fU * fC * fA * fA * fG * fG * mA * mA * mG * mA * mU * mG * mG * mC * mA * mU * mU * mU * mC * mU | 160 | UCAAGGAAGAUGGCAUUUCU | XXXXX XXXXXXXXXX XXXX |
| WV-2109 | mU * mC * mA * mA * mG * mG * mA * mA * mG * mA * mU * mG * mG * mC * fA * fU * fU * fU * fC * fU | 161 | UCAAGGAAGAUGGCAUUUCU | XXXXX XXXXXXXXXX XXXX |

TABLE A1-continued

| | | | | |
|---|---|---|---|---|
| WV-2165 | mC * mU * mC * mC * mA * mA * mC * mA * mU * mC * mA * mA * mG * mG * mA * mA * mG * mA * mU * mG * mG * mC * mA * mU * mU * mU * mC * mU * mA * mG | 162 | CUCCAACAUCAAGGAAGAUGGCAUUUCUAG | XXXXX XXXXX XXXXX XXXXX XXXXX XXXX |
| WV-2179 | mA * mC * mC * mA * mG * mA * mG * mU * mA * mA * mC * mA * mG * mU * mC * mU * mG * mA * mG * mU * mA * mG * mG * mA * mG | 163 | ACCAGAGUAACAGUCUGAGUAGGAG | XXXXX XXXXX XXXXX XXXXX XXXX |
| WV-2180 | mC * mA * mC * mC * mA * mG * mA * mG * mU * mA * mA * mC * mA * mG * mU * mC * mU * mG * mA * mG * mU * mA * mG * mG * mA | 164 | CACCAGAGUAACAGUCUGAGUAGGA | XXXXX XXXXX XXXXX XXXXX XXXX |
| WV-2181 | mU * mC * mA * mC * mC * mA * mG * mA * mG * mU * mA * mA * mC * mA * mG * mU * mC * mU * mG * mA * mG * mU * mA * mG * mG | 165 | UCACCAGAGUAACAGUCUGAGUAGG | XXXXX XXXXX XXXXX XXXXX XXXX |
| WV-2182 | mG * mU * mC * mA * mC * mC * mA * mG * mA * mG * mU * mA * mA * mC * mA * mG * mU * mC * mU * mG * mA * mG * mU * mA * mG | 166 | GUCACCAGAGUAACAGUCUGAGUAG | XXXXX XXXXX XXXXX XXXXX XXXX |
| WV-2183 | mG * mU * mU * mG * mU * mG * mU * mC * mA * mC * mC * mA * mG * mA * mG * mU * mA * mA * mC * mA * mG * mU * mC * mU * mG | 167 | GUUGUGUCACCAGAGUAACAGUCUG | XXXXX XXXXX XXXXX XXXXX XXXX |
| WV-2184 | mG * mG * mU * mU * mG * mU * mG * mU * mC * mA * mC * mC * mA * mG * mA * mG * mU * mA * mA * mC * mA * mG * mU * mC * mU | 168 | GGUUGUGUCACCAGAGUAACAGUCU | XXXXX XXXXX XXXXX XXXXX XXXX |
| WV-2185 | mA * mG * mG * mU * mU * mG * mU * mG * mU * mC * mA * mC * mC * mA * mG * mA * mG * mU * mA * mA * mC * mA * mG * mU * mC | 169 | AGGUUGUGUCACCAGAGUAACAGUC | XXXXX XXXXX XXXXX XXXXX XXXX |
| WV-2186 | mC * mA * mG * mG * mU * mU * mG * mU * mG * mU * mC * mA * mC * mC * mA * mG * mA * mG * mU * mA * mA * mC * mA * mG * mU | 170 | CAGGUUGUGUCACCAGAGUAACAGU | XXXXX XXXXX XXXXX XXXXX XXXX |
| WV-2187 | mA * mC * mA * mG * mG * mU * mU * mG * mU * mG * mU * mC * mA * mC * mC * mA * mG * mA * mG * mU * mA * mA * mC * mA * mG | 171 | ACAGGUUGUGUCACCAGAGUAACAG | XXXXX XXXXX XXXXX XXXXX XXXX |
| WV-2188 | mC * mC * mA * mC * mA * mG * mG * mU * mU * mG * mU * mG * mU * mC * mA * mC * mC * mA * mG * mA * mG * mU * mA * mA * mC | 172 | CCACAGGUUGUGUCACCAGAGUAAC | XXXXX XXXXX XXXXX XXXXX XXXX |
| WV-2189 | mA * mC * mC * mA * mC * mA * mG * mG * mU * mU * mG * mU * mG * mU * mC * mA * mC * mC * mA * mG * mA * mG * mU * mA * mA | 173 | ACCACAGGUUGUGUCACCAGAGUAA | XXXXX XXXXX XXXXX XXXXX XXXX |
| WV-2190 | mA * mA * mC * mC * mA * mC * mA * mG * mG * mU * mU * mG * mU * mG * mU * mC * mA * mC * mC * mA * mG * mA * mG * mU * mA | 174 | AACCACAGGUUGUGUCACCAGAGUA | XXXXX XXXXX XXXXX XXXXX XXXX |

TABLE A1-continued

| | | | | |
|---|---|---|---|---|
| WV-2191 | mU * mA * mA * mC * mC * mA * mC * mA * mG * mG * mU * mU * mG * mU * mG * mU * mC * mA * mC * mC * mA * mG * mA * mG * mU | 175 | UAACCACAGGUUGUGUCACCAGAGU | XXXXX XXXXX XXXXX XXXXX XXXX |
| WV-2192 | mG * mU * mA * mA * mC * mC * mA * mC * mA * mG * mG * mU * mU * mG * mU * mG * mU * mC * mA * mC * mC * mA * mG * mA * mG | 176 | GUAACCACAGGUUGUGUCACCAGAG | XXXXX XXXXX XXXXX XXXXX XXXX |
| WV-2193 | mA * mG * mU * mA * mA * mC * mC * mA * mC * mA * mG * mG * mU * mU * mG * mU * mG * mU * mC * mA * mC * mC * mA * mG * mA | 177 | AGUAACCACAGGUUGUGUCACCAGA | XXXXX XXXXX XXXXX XXXXX XXXX |
| WV-2194 | mU * mA * mG * mU * mA * mA * mC * mC * mA * mC * mA * mG * mG * mU * mU * mG * mU * mG * mU * mC * mA * mC * mC * mA * mG | 178 | UAGUAACCACAGGUUGUGUCACCAG | XXXXX XXXXX XXXXX XXXXX XXXX |
| WV-2195 | mU * mU * mA * mG * mU * mA * mA * mC * mC * mA * mC * mA * mG * mG * mU * mU * mG * mU * mG * mU * mC * mA * mC * mC * mA | 179 | UUAGUAACCACAGGUUGUGUCACCA | XXXXX XXXXX XXXXX XXXXX XXXX |
| WV-2196 | mC * mU * mU * mA * mG * mU * mA * mA * mC * mC * mA * mC * mA * mG * mG * mU * mU * mG * mU * mG * mU * mC * mA * mC * mC | 180 | CUUAGUAACCACAGGUUGUGUCACC | XXXXX XXXXX XXXXX XXXXX XXXX |
| WV-2197 | mC * mC * mU * mU * mA * mG * mU * mA * mA * mC * mC * mA * mC * mA * mG * mG * mU * mU * mG * mU * mG * mU * mC * mA * mC | 181 | CCUUAGUAACCACAGGUUGUGUCAC | XXXXX XXXXX XXXXX XXXXX XXXX |
| WV-2198 | mU * mC * mC * mU * mU * mA * mG * mU * mA * mA * mC * mC * mA * mC * mA * mG * mG * mU * mU * mG * mU * mG * mU * mC * mA | 182 | UCCUUAGUAACCACAGGUUGUGUCA | XXXXX XXXXX XXXXX XXXXX XXXX |
| WV-2199 | mG * mU * mU * mU * mC * mC * mU * mU * mA * mG * mU * mA * mA * mC * mC * mA * mC * mA * mG * mG * mU * mU * mG * mU * mG | 183 | GUUUCCUUAGUAACCACAGGUUGUG | XXXXX XXXXX XXXXX XXXXX XXXX |
| WV-2200 | mA * mG * mU * mU * mU * mC * mC * mU * mU * mA * mG * mU * mA * mA * mC * mC * mA * mU * mA * mG * mG * mU * mU * mG * mU | 184 | AGUUUCCUUAGUAACCACAGGUUGU | XXXXX XXXXX XXXXX XXXXX XXXX |
| WV-2201 | mC * mA * mG * mU * mU * mU * mC * mC * mU * mU * mA * mG * mU * mA * mA * mC * mC * mA * mC * mA * mG * mG * mU * mU * mG | 185 | CAGUUUCCUUAGUAACCACAGGUUG | XXXXX XXXXX XXXXX XXXXX XXXX |
| WV-2202 | mG * mC * mA * mG * mU * mU * mU * mC * mC * mU * mU * mA * mG * mU * mA * mA * mC * mC * mA * mC * mA * mG * mG * mU * mU | 186 | GCAGUUUCCUUAGUAACCACAGGUU | XXXXX XXXXX XXXXX XXXXX XXXX |
| WV-2203 | mG * mG * mC * mA * mG * mU * mU * mU * mC * mC *mU * mU * mA * mG * mU * mA * mA * mC * mC * mA * mC * mA * mG * mG * mU | 187 | GGCAGUUUCCUUAGUAACCACAGGU | XXXXX XXXXX XXXXX XXXXX XXXX |
| WV- | mU * mG * mG * mC * mA * mG * mU * mU * mU * mC * mC * mU * | 188 | UGGCAGUUUCCUUA | XXXXX XXXXX |

TABLE A1-continued

| | | | | |
|---|---|---|---|---|
| 2204 | mU * mA * mG * mU * mA * mA * mC * mC * mA * mC * mA * mG * mG | | GUAACCACAGG | XXXXX XXXXX XXXX |
| WV-2205 | mA * mU * mG * mG * mC * mA * mG * mU * mU * mU * mC * mC * mU * mU * mA * mG * mU * mA * mA * mC * mC * mA * mC * mA * mG | 189 | AUGGCAGUUUCCUUAGUAACCACAG | XXXXX XXXXX XXXXX XXXXX XXXX |
| WV-2206 | mA * mG * mA * mU * mG * mG * mC * mA * mG * mU * mU * mU * mC * mC * mU * mU * mA * mG * mU * mA * mA * mC * mC * mA * mC | 190 | AGAUGGCAGUUUCCUUAGUAACCAC | XXXXX XXXXX XXXXX XXXXX XXXX |
| WV-2207 | mG * mA * mG * mA * mU * mG * mG * mC * mA * mG * mU * mU * mU * mC * mC * mU * mU * mA * mG * mU * mA * mA * mC * mC * mA | 191 | GAGAUGGCAGUUUCCUUAGUAACCA | XXXXX XXXXX XXXXX XXXXX XXXX |
| WV-2208 | mG * mG * mA * mG * mA * mU * mG * mG * mC * mA * mG * mU * mU * mU * mC * mC * mU * mU * mA * mG * mU * mA * mA * mC * mC | 192 | GGAGAUGGCAGUUUCCUUAGUAACC | XXXXX XXXXX XXXXX XXXXX XXXX |
| WV-2209 | mU * mG * mG * mA * mG * mA * mU * mG * mG * mC * mA * mG * mU * mU * mU * mC * mC * mU * mU * mA * mG * mU * mA * mA * mC | 193 | UGGAGAUGGCAGUUUCCUUAGUAAC | XXXXX XXXXX XXXXX XXXXX XXXX |
| WV-2210 | mU * mU * mG * mG * mA * mG * mA * mU * mG * mG * mC * mA * mG * mU * mU * mU * mC * mC * mU * mU * mA * mG * mU * mA * mA | 194 | UUGGAGAUGGCAGUUUCCUUAGUAA | XXXXX XXXXX XXXXX XXXXX XXXX |
| WV-2211 | mU * mU * mU * mG * mG * mA * mG * mA * mU * mG * mG * mC * mA * mG * mU * mU * mU * mC * mC * mU * mU * mA * mG * mU * mA | 195 | UUUGGAGAUGGCAGUUUCCUUAGUA | XXXXX XXXXX XXXXX XXXXX XXXX |
| WV-2212 | mA * mG * mU * mU * mU * mG * mG * mA * mG * mA * mU * mG * mG * mC * mA * mG * mU * mU * mU * mC * mC * mU * mU * mA * mG | 196 | AGUUUGGAGAUGGCAGUUUCCUUAG | XXXXX XXXXX XXXXX XXXXX XXXX |
| WV-2213 | mU * mA * mG * mU * mU * mU * mG * mG * mA * mG * mA * mU * mG * mG * mC * mA * mG * mU * mU * mU * mC * mC * mU * mU * mA | 197 | UAGUUUGGAGAUGGCAGUUUCCUUA | XXXXX XXXXX XXXXX XXXXX XXXX |
| WV-2214 | mC * mU * mA * mG * mU * mU * mU * mG * mG * mA * mG * mA * mU * mG * mG * mC * mA * mG * mU * mU * mU * mC * mC * mU * mU | 198 | CUAGUUUGGAGAUGGCAGUUUCCUU | XXXXX XXXXX XXXXX XXXXX XXXX |
| WV-2215 | mU * mC * mU * mA * mG * mU * mU * mU * mG * mG * mA * mG * mA * mU * mG * mG * mC * mA * mG * mU * mU * mU * mC * mC * mU | 199 | UCUAGUUUGGAGAUGGCAGUUUCCU | XXXXX XXXXX XXXXX XXXXX XXXX |
| WV-2216 | mU * mU * mC * mU * mA * mG * mU * mU * mU * mG * mG * mA * mG * mA * mU * mG * mG * mC * mA * mG * mU * mU * mU * mC * mC | 200 | UUCUAGUUUGGAGAUGGCAGUUUCC | XXXXX XXXXX XXXXX XXXXX XXXX |

TABLE A1-continued

| | | | | |
|---|---|---|---|---|
| WV-2217 | mC * mA * mU * mU * mU * mC * mU * mA * mG * mU * mU * mU * mG * mG * mA * mG * mA * mU * mG * mG * mC * mA * mG * mU * mU | 201 | CAUUUCUAGUUUGGA GAUGGCAGUU | XXXXX XXXXX XXXXX XXXXX XXXX |
| WV-2218 | mG * mC * mA * mU * mU * mU * mC * mU * mA * mG * mU * mU * mU * mG * mG * mA * mG * mA * mU * mG * mG * mC * mA * mG * mU | 202 | GCAUUUCUAGUUUGG AGAUGGCAGU | XXXXX XXXXX XXXXX XXXXX XXXX |
| WV-2219 | mA * mU * mG * mG * mC * mA * mU * mU * mU * mC * mU * mA * mG * mU * mU * mU * mG * mG * mA * mG * mA * mU * mG * mG * mC | 203 | AUGGCAUUUCUAGUU UGGAGAUGGC | XXXXX XXXXX XXXXX XXXXX XXXX |
| WV-2220 | mG * mA * mA * mG * mA * mU * mG * mG * mC * mA * mU * mU * mU * mC * mU * mA * mG * mU * mU * mU * mG * mG * mA * mG * mA | 204 | GAAGAUGGCAUUUCU AGUUUGGAGA | XXXXX XXXXX XXXXX XXXXX XXXX |
| WV-2221 | mA * mG * mG * mA * mA * mG * mA * mU * mG * mG * mC * mA * mU * mU * mU * mC * mU * mA * mG * mU * mU * mU * mG * mG * mA | 205 | AGGAAGAUGGCAUUU CUAGUUUGGA | XXXXX XXXXX XXXXX XXXXX XXXX |
| WV-2222 | mA * mA * mG * mG * mA * mA * mG * mA * mU * mG * mG * mC * mA * mU * mU * mU * mC * mU * mA * mG * mU * mU * mU * mG * mG | 206 | AAGGAAGAUGGCAUU U CUAGUUUGG | XXXXX XXXXX XXXXX XXXXX XXXX |
| WV-2223 | mC * mA * mA * mG * mG * mA * mA * mG * mA * mU * mG * mG * mC * mA * mU * mU * mU * mC * mU * mA * mG * mU * mU * mU * mG | 207 | CAAGGAAGAUGGCAU UU CUAGUUUG | XXXXX XXXXX XXXXX XXXXX XXXX |
| WV-2224 | mC * mA * mU * mC * mA * mA * mG * mG * mA * mA * mG * mA * mU * mG * mG * mC * mA * mU * mU * mU * mC * mU * mA * mG * mU | 208 | CAUCAAGGAAGAUGG CAU UUCUAGU | XXXXX XXXXX XXXXX XXXXX XXXX |
| WV-2225 | mA * mC * mA * mU * mC * mA * mA * mG * mG * mA * mA * mG * mA * mU * mG * mG * mC * mA * mU * mU * mU * mC * mU * mA * mG | 209 | ACAUCAAGGAAGAUG GCA UUUCUAG | XXXXX XXXXX XXXXX XXXXX XXXX |
| WV-2226 | mA * mA * mC * mA * mU * mC * mA * mA * mG * mG * mA * mA * mG * mA * mU * mG * mG * mC * mA * mU * mU * mU * mC * mU * mA | 210 | AACAUCAAGGAAGAU GGC AUUUCUA | XXXXX XXXXX XXXXX XXXXX XXXX |
| WV-2227 | mC * mA * mA * mC * mA * mU * mC * mA * mA * mG * mG * mA * mA * mG * mA * mU * mG * mG * mC * mA * mU * mU * mU * mC * mU | 211 | CAACAUCAAGGAAGA UGG CAUUUCU | XXXXX XXXXX XXXXX XXXXX XXXX |
| WV-2228 | mC * mU * mC * mC * mA * mA * mC * mA * mU * mC * mA * mA * mG * mG * mA * mA * mG * mA * mU * mG * mG * mC * mA * mU * mU | 212 | CUCCAACAUCAAGGA AGAU GGCAUU | XXXXX XXXXX XXXXX XXXXX XXXX |
| WV-2229 | mA * mC * mC * mU * mC * mC * mA * mA * mC * mA * mU * mC * mA * mA * mG * mG * mA * mA * mG * mA * mU * mG * mG * mC * mA | 213 | ACCUCCAACAUCAAG GAAGAUGGCA | XXXXX XXXXX XXXXX XXXXX XXXX |

TABLE A1-continued

| | | | | |
|---|---|---|---|---|
| WV-2230 | mG * mU * mA * mC * mC * mU * mC * mC * mA * mA * mC * mA * mU * mC * mA * mA * mG * mG * mA * mA * mG * mA * mU * mG * mG | 214 | GUACCUCCAACAUCAAGGAAGAUGG | XXXXX XXXXX XXXXX XXXXX XXXX |
| WV-2231 | mA * mG * mG * mU * mA * mC * mC * mU * mC * mC * mA * mA * mC * mA * mU * mC * mA * mA * mG * mG * mA * mA * mG * mA * mU | 215 | AGGUACCUCCAACAUCAAGGAAGAU | XXXXX XXXXX XXXXX XXXXX XXXX |
| WV-2232 | mA * mG * mA * mG * mC * mA * mG * mG * mU * mA * mC * mC * mU * mC * mC * mA * mA * mC * mA * mU * mC * mA * mA * mG * mG | 216 | AGAGCAGGUACCUCCAACAUCAAGG | XXXXX XXXXX XXXXX XXXXX XXXX |
| WV-2233 | mC * mA * mG * mA * mG * mC * mA * mG * mG * mU * mA * mC * mC * mU * mC * mC * mA * mA * mC * mA * mU * mC * mA * mA * mG | 217 | CAGAGCAGGUACCUCCAACAUCAAG | XXXXX XXXXX XXXXX XXXXX XXXX |
| WV-2234 | mC * mU * mG * mC * mC * mA * mG * mA * mG * mC * mA * mG * mG * mU * mA * mC * mC * mU * mC * mC * mA * mA * mC * mA * mU | 218 | CUGCCAGAGCAGGUACCUCCAACAU | XXXXX XXXXX XXXXX XXXXX XXXX |
| WV-2235 | mU * mC * mU * mG * mC * mC * mA * mG * mA * mG * mC * mA * mG * mG * mU * mA * mC * mC * mU * mC * mC * mA * mA * mC * mA | 219 | UCUGCCAGAGCAGGUACCUCCAACA | XXXXX XXXXX XXXXX XXXXX XXXX |
| WV-2236 | mA * mU * mC * mU * mG * mC * mC * mA * mG * mA * mG * mC * mA * mG * mG * mU * mA * mC * mC * mU * mC * mC * mA * mA * mC | 220 | AUCUGCCAGAGCAGGUACCUCCAAC | XXXXX XXXXX XXXXX XXXXX XXXX |
| WV-2237 | mA * mA * mU * mC * mU * mG * mC * mC * mA * mG * mA * mG * mC * mA * mG * mG * mU * mA * mC * mC * mU * mC * mC * mA * mA | 221 | AAUCUGCCAGAGCAGGUACCUCCAA | XXXXX XXXXX XXXXX XXXXX XXXX |
| WV-2238 | mA * mA * mA * mU * mC * mU * mG * mC * mC * mA * mG * mA * mG * mC * mA * mG * mG * mU * mA * mC * mC * mU * mC * mC * mA | 222 | AAAUCUGCCAGAGCAGGUACCUCCA | XXXXX XXXXX XXXXX XXXXX XXXX |
| WV-2239 | mG * mA * mA * mA * mU * mC * mU * mG * mC * mC * mA * mG * mA * mG * mC * mA * mG * mG * mU * mA * mC * mC * mU * mC * mC | 223 | GAAAUCUGCCAGAGCAGGUACCUCC | XXXXX XXXXX XXXXX XXXXX XXXX |
| WV-2240 | mU * mG * mA * mA * mA * mU * mC * mU * mG * mC * mC * mA * mG * mA * mG * mC * mA * mG * mG * mU * mA * mC * mC * mU * mC | 224 | UGAAAUCUGCCAGAGCAGGUACCUC | XXXXX XXXXX XXXXX XXXXX XXXX |
| WV-2241 | mU * mU * mG * mA * mA * mA * mU * mC * mU * mG * mC * mC * mA * mG * mA * mG * mC * mA * mG * mG * mU * mA * mC * mC * mU | 225 | UUGAAAUCUGCCAGAGCAGGUACCU | XXXXX XXXXX XXXXX XXXXX XXXX |
| WV-2242 | mC * mC * mC * mG * mG * mU * mU * mG * mA * mA * mA * mU * mC * mU * mG * mC * mC * mA * mG * mA * mG * mC * mA * mG * mG | 226 | CCCGGUUGAAAUCUGCCAGAGCAGG | XXXXX XXXXX XXXXX XXXXX XXXX |
| WV- | mC * mC * mA * mA * mG * mC * mC * mC * mG * mG * mU * mU * | 227 | CCAAGCCCGGUUGAA | XXXXX XXXXX |

TABLE A1-continued

| | | | | |
|---|---|---|---|---|
| 2243 | mG * mA * mA * mA * mU * mC * mU * mG * mC * mC * mA * mG * mA | | AUCUGCCAGA | XXXXX XXXXX XXXX |
| WV-2244 | mU * mC * mC * mA * mA * mG * mC * mC * mC * mG * mG * mU * mU * mG * mA * mA * mA * mU * mC * mU * mG * mC * mC * mA * mG | 228 | UCCAAGCCCGGUUGA AAUCUGCCAG | XXXXX XXXXX XXXXX XXXXX XXXX |
| WV-2245 | mG * mU * mC * mC * mA * mA * mG * mC * mC * mC * mG * mG * mU * mU * mG * mA * mA * mA * mU * mC * mU * mG * mC * mC * mA | 229 | GUCCAAGCCCGGUU GAAAUCUGCCA | XXXXX XXXXX XXXXX XXXXX XXXX |
| WV-2246 | mU * mC * mU * mG * mU * mC * mC * mA * mA * mG * mC * mC * mC * mG * mG * mU * mU * mG * mA * mA * mA * mU * mC * mU * mG | 230 | UCUGUCCAAGCCCGG UUGAAAUCUG | XXXXX XXXXX XXXXX XXXXX XXXX |
| WV-2247 | mU * mU * mC * mU * mG * mU * mC * mC * mA * mA * mG * mC * mC * mC * mG * mG * mU * mU * mG * mA * mA * mA * mU * mC * mU | 231 | UUCUGUCCAAGCCCG GUUGAAAUCU | XXXXX XXXXX XXXXX XXXXX XXXX |
| WV-2248 | mG * mU * mU * mC * mU * mG * mU * mC * mC * mA * mA * mG * mC * mC * mC * mG * mG * mU * mU * mG * mA * mA * mA * mU * mC | 232 | GUUCUGUCCAAGCCC GGUUGAAAUC | XXXXX XXXXX XXXXX XXXXX XXXX |
| WV-2249 | mA * mG * mU * mU * mC * mU * mG * mU * mC * mC * mA * mA * mG * mC * mC * mC * mG * mG * mU * mU * mG * mA * mA * mA * mU | 233 | AGUUCUGUCCAAGC CCGGUUGAAAU | XXXXX XXXXX XXXXX XXXXX XXXX |
| WV-2250 | mA * mA * mG * mU * mU * mC * mU * mG * mU * mC * mC * mA * mA * mG * mC * mC * mC * mG * mG * mU * mU * mG * mA * mA * mA | 234 | AAGUUCUGUCCAA GCCCGGUUGAAA | XXXXX XXXXX XXXXX XXXXX XXXX |
| WV-2251 | mU * mA * mA * mG * mU * mU * mC * mU * mG * mU * mC * mC * mA * mA * mG * mC * mC * mC * mG * mG * mU * mU * mG * mA * mA | 235 | UAAGUUCUGUCC AGCCCGGUUGAA | XXXXX XXXXX XXXXX XXXXX XXXX |
| WV-2252 | mG * mU * mA * mA * mG * mU * mU * mC * mU * mG * mU * mC * mC * mA * mA * mG * mC * mC * mC * mG * mG * mU * mU * mG * mA | 236 | GUAAGUUCUGU CCAAGCCCGGUUGA | XXXXX XXXXX XXXXX XXXXX XXXX |
| WV-2253 | mG * mG * mU * mA * mA * mG * mU * mU * mC * mU * mG * mU * mC * mC * mA * mA * mG * mC * mC * mC * mG * mG * mU * mU * mG | 237 | GGUAAGUUCUGUCCA AGCCCGGUUG | XXXXX XXXXX XXXXX XXXXX XXXX |
| WV-2254 | mC * mG * mG * mU * mA * mA * mG * mU * mU * mC * mU * mG * mU * mC * mC * mA * mA * mG * mC * mC * mC * mG * mG * mU * mU | 238 | CGGUAAGUUCUGUCC AAGCCCGGUU | XXXXX XXXXX XXXXX XXXXX XXXX |
| WV-2255 | mU * mC * mG * mG * mU * mA * mA * mG * mU * mU * mC * mU * mG * mU * mC * mC * mA * mA * mG * mC * mC * mC * mG * mG * mU | 239 | UCGGUAAGUUCUGUC CAAGCCCGGU | XXXXX XXXXX XXXXX XXXXX XXXX |

TABLE A1-continued

| | | | | |
|---|---|---|---|---|
| WV-2256 | mG * mU * mC * mG * mG * mU * mA * mA * mG * mU * mU * mC * mU * mG * mU * mC * mC * mA * mA * mG * mC * mC * mC * mG * mG | 240 | GUCGGUAAGUUCUGUCCAAGCCCGG | XXXXX XXXXX XXXXX XXXXX XXXX |
| WV-2257 | mA * mG * mU * mC * mG * mG * mU * mA * mA * mG * mU * mU * mC * mU * mG * mU * mC * mC * mA * mA * mG * mC * mC * mC * mG | 241 | AGUCGGUAAGUUCUGUCCAAGCCCG | XXXXX XXXXX XXXXX XXXXX XXXX |
| WV-2258 | mC * mA * mG * mU * mC * mG * mG * mU * mA * mA * mG * mU * mU * mC * mU * mG * mU * mC * mC * mA * mA * mG * mC * mC * mC | 242 | CAGUCGGUAAGUUCUGUCCAAGCCC | XXXXX XXXXX XXXXX XXXXX XXXX |
| WV-2259 | mA * mA * mA * mG * mC * mC * mA * mG * mU * mC * mG * mG * mU * mA * mA * mG * mU * mU * mC * mU * mG * mG * mC * mC * mA | 243 | AAAGCCAGUCGGUAAGUUCUGUCCA | XXXXX XXXXX XXXXX XXXXX XXXX |
| WV-2260 | mG * mA * mA * mA * mG * mC * mC * mA * mG * mU * mC * mG * mG * mU * mA * mA * mG * mU * mU * mC * mU * mG * mU * mC * mC | 244 | GAAAGCCAGUCGGUAAGUUCUGUCC | XXXXX XXXXX XXXXX XXXXX XXXX |
| WV-2261 | mG * mU * mC * mA * mC * mC * mC * mA * mC * mC * mA * mU * mC * mA * mC * mC * mC * mU * mC * mU * mG * mU * mG * mA * mU | 245 | GUCACCCACCAUCACCCUCUGUGAU | XXXXX XXXXX XXXXX XXXXX XXXX |
| WV-2262 | mG * mG * mU * mC * mA * mC * mC * mC * mA * mC * mC * mA * mU * mC * mA * mC * mC * mC * mU * mC * mU * mG * mU * mG * mA | 246 | GGUCACCCACCAUCACCCUCUGUGA | XXXXX XXXXX XXXXX XXXXX XXXX |
| WV-2263 | mA * mA * mG * mG * mU * mC * mA * mC * mC * mC * mA * mC * mC * mA * mU * mC * mA * mC * mC * mC * mU * mC * mU * mG * mU | 247 | AAGGUCACCCACCAUCACCCUCUGU | XXXXX XXXXX XXXXX XXXXX XXXX |
| WV-2264 | mC * mA * mA * mG * mG * mU * mC * mA * mC * mC * mC * mA * mC * mC * mA * mU * mC * mA * mC * mC * mC * mU * mC * mU * mG | 248 | CAAGGUCACCCACCAUCACCCUCUG | XXXXX XXXXX XXXXX XXXXX XXXX |
| WV-2265 | mU * mC * mA * mA * mG * mG * mU * mC * mA * mC * mC * mC * mA * mC * mC * mA * mU * mC * mA * mC * mC * mC * mU * mC * mU | 249 | UCAAGGUCACCCACCAUCACCCUCU | XXXXX XXXXX XXXXX XXXXX XXXX |
| WV-2266 | mC * mU * mC * mA * mA * mG * mG * mU * mC * mA * mC * mC * mC * mA * mC * mC * mA * mU * mC * mA * mC * mC * mC * mU * mC | 250 | CUCAAGGUCACCCACCAUCACCCUC | XXXXX XXXXX XXXXX XXXXX XXXX |
| WV-2267 | mC * mU * mU * mG * mA * mU * mC * mA * mA * mG * mC * mA * mG * mA * mG * mA * mA * mA * mG * mC * mC * mA * mG * mU * mC | 251 | CUUGAUCAAGCAGAGAAAGCCAGUC | XXXXX XXXXX XXXXX XXXXX XXXX |
| WV-2268 | mA * mU * mA * mA * mC * mU * mU * mG * mA * mU * mC * mA * mA * mG * mC * mA * mG * mA * mG * mA * mA * mA * mG * mC * mC | 252 | AUAACUUGAUCAAGCAGAGAAAGCC | XXXXX XXXXX XXXXX XXXXX XXXX |

TABLE A1-continued

| | | | | |
|---|---|---|---|---|
| WV-2273 | mA * mG * mU * mA * mA * mC * mA * mG * mU * mC * mU * mG * mA * mG * mU * mA * mG * mG * mA * mG | 253 | AGUAACAGUCUGAGUAGGAG | XXXXX XXXXX XXXXX XXXX |
| WV-2274 | mG * mA * mG * mU * mA * mA * mC * mA * mG * mU * mC * mU * mG * mA * mG * mU * mA * mG * mG * mA | 254 | GAGUAACAGUCUGAGUAGGA | XXXXX XXXXX XXXXX XXXX |
| WV-2275 | mA * mG * mA * mG * mU * mA * mA * mC * mA * mG * mU * mC * mU * mG * mA * mG * mU * mA * mG * mG | 255 | AGAGUAACAGUCUGAGUAGG | XXXXX XXXXX XXXXX XXXX |
| WV-2276 | mC * mA * mG * mA * mG * mU * mA * mA * mC * mA * mG * mU * mC * mU * mG * mA * mG * mU * mA * mG | 256 | CAGAGUAACAGUCUGAGUAG | XXXXX XXXXX XXXXX XXXX |
| WV-2277 | mG * mU * mC * mA * mC * mC * mA * mG * mA * mG * mU * mA mA * mC * mA * mG * mU * mC * mU * mG | 257 | GUCACCAGAGUAACAGUCUG | XXXXX XXXXX XXXXX XXXX |
| WV-2278 | mU * mG * mU * mC * mA * mC * mC * mA * mG * mA * mG * mU * mA * mA * mC * mA * mG * mU * mC * mU | 258 | UGUCACCAGAGUAACAGUCU | XXXXX XXXXX XXXXX XXXX |
| WV-2279 | mG * mU * mG * mU * mC * mA * mC * mC * mA * mG * mA * mG * mU * mA * mA * mC * mA * mG * mU *mC | 259 | GUGUCACCAGAGUAACAGUC | XXXXX XXXXX XXXXX XXXX |
| WV-2280 | mU * mG * mU * mG * mU * mC * mA * mC * mC * mA * mG * mA * mG * mU * mA * mA * mC * mA * mG * mU | 260 | UGUGUCACCAGAGUAACAGU | XXXXX XXXXX XXXXX XXXX |
| WV-2281 | mU * mU * mG * mU * mG * mU * mC * mA * mC * mC * mA * mG * mA * mG * mU * mA * mA * mC * mA * mG | 261 | UUGUGUCACCAGAGUAACAG | XXXXX XXXXX XXXXX XXXX |
| WV-2282 | mG * mG * mU * mU * mG * mU * mG * mU * mC * mA * mC * mC * mA * mG * mA * mG * mU * mA * mA * mC | 262 | GGUUGUGUCACCAGAGUAAC | XXXXX XXXXX XXXXX XXXX |
| WV-2283 | mA * mG * mG * mU * mU * mG * mU * mG * mU * mC * mA * mC * mC * mA * mG * mA * mG * mU * mA * mA | 263 | AGGUUGUGUCACCAGAGUAA | XXXXX XXXXX XXXXX XXXX |
| WV-2284 | mC * mA * mG * mG * mU * mU * mG * mU * mG * mU * mC * mA * mC * mC * mA * mG * mA * mG * mU * mA | 264 | CAGGUUGUGUCACCAGAGUA | XXXXX XXXXX XXXXX XXXX |
| WV-2285 | mA * mC * mA * mG * mG * mU * mU * mG * mU * mG * mU * mC * mA * mC * mC * mA * mG * mA * mG * mU | 265 | ACAGGUUGUGUCACCAGAGU | XXXXX XXXXX XXXXX XXXX |
| WV-2286 | mC * mA * mC * mA * mG * mG * mU * mU * mG * mU * mG * mU * mC * mA * mC * mC * mA * mG * mA * mG | 266 | CACAGGUUGUGUCACCAGAG | XXXXX XXXXX XXXXX XXXX |
| WV-2287 | mC * mC * mA * mC * mA * mG * mG * mU * mU * mG * mU * mG * mU * mC * mA * mC * mC * mA * mG * mA | 267 | CCACAGGUUGUGUCACCAGA | XXXXX XXXXX XXXXX XXXX |
| WV-2288 | mA * mC * mC * mA * mC * mA * mG * mG * mU * mU * mG * mU * mG * mU * mC * mA * mC * mC * mA * mG | 268 | ACCACAGGUUGUGUCACCAG | XXXXX XXXXX XXXXX XXXX |
| WV-2289 | mA * mA * mC * mC * mA * mC * mA * mG * mG * mU * mU * mG * mU * mG * mU * mC * mA * mC * mC * mA | 269 | AACCACAGGUUGUGUCACCA | XXXXX XXXXX XXXXX XXXX |
| WV-2290 | mU * mA * mA * mC * mC * mA * mC * mA * mG * mG * mU * mU * mG * mU * mG * mU * mC * mA * mC * mC | 270 | UAACCACAGGUUGUGUCACC | XXXXX XXXXX XXXXX XXXX |

TABLE A1-continued

| | | | | |
|---|---|---|---|---|
| WV-2291 | mG * mU * mA * mA * mC * mC * mA * mC * mA * mG * mG * mU * mU * mG * mU * mG * mU * mC * mA * mC | 271 | GUAACCACAGGUUGUGUCAC | XXXXX XXXXX XXXXX XXXX |
| WV-2292 | mA * mG * mU * mA * mA * mC * mC * mA * mC * mA * mG * mG * mU * mU * mG * mU * mG * mU * mC * mA | 272 | AGUAACCACAGGUUGUGUCA | XXXXX XXXXX XXXXX XXXX |
| WV-2293 | mC * mU * mU * mA * mG * mU * mA * mA * mC * mC * mA * mC * mA * mG * mG * mU * mU * mG * mU * mG | 273 | CUUAGUAACCACAGGUUGUG | XXXXX XXXXX XXXXX XXXX |
| WV-2294 | mC * mC * mU * mU * mA * mG * mU * mA * mA * mC * mC * mA * mC * mA * mG * mG * mU * mU * mG * mU | 274 | CCUUAGUAACCACAGGUUGU | XXXXX XXXXX XXXXX XXXX |
| WV-2295 | mU * mC * mC * mU * mU * mA * mG * mU * mA * mA * mC * mC * mA * mC * mA * mG * mG * mU * mU * mG | 275 | UCCUUAGUAACCACAGGUUG | XXXXX XXXXX XXXXX XXXX |
| WV-2296 | mU * mU * mC * mC * mU * mU * mA * mG * mU * mA * mA * mC * mC * mA * mC * mA * mG * mG * mU * mU | 276 | UUCCUUAGUAACCACAGGUU | XXXXX XXXXX XXXXX XXXX |
| WV-2297 | mU * mU * mU * mC * mC * mU * mU * mA * mG * mU * mA * mA * mC * mC * mA * mC * mA * mG * mG * mU | 277 | UUUCCUUAGUAACCACAGGU | XXXXX XXXXX XXXXX XXXX |
| WV-2298 | mG * mU * mU * mU * mC * mC * mU * mU * mA * mG * mU * mA * mA * mC * mC * mA * mC * mA * mG * mG | 278 | GUUUCCUUAGUAACCACAGG | XXXXX XXXXX XXXXX XXXX |
| WV-2299 | mA * mG * mU * mU * mU * mC * mC * mU * mU * mA * mG * mU * mA * mA * mC * mC * mA * mC * mA * mG | 279 | AGUUUCCUUAGUAACCACAG | XXXXX XXXXX XXXXX XXXX |
| WV-2300 | mG * mC * mA * mG * mU * mU * mU * mC * mC * mU * mU * mA * mG * mU * mA * mA * mC * mC * mA * mC | 280 | GCAGUUUCCUUAGUAACCAC | XXXXX XXXXX XXXXX XXXX |
| WV-2301 | mG * mG * mC * mA * mG * mU * mU * mU * mC * mC * mU * mU * mA * mG * mU * mA * mA * mC * mC * mA | 281 | GGCAGUUUCCUUAGUAACCA | XXXXX XXXXX XXXXX XXXX |
| WV-2302 | mU * mG * mG * mC * mA * mG * mU * mU * mU * mC * mC * mU * mU * mA * mG * mU * mA * mA * mC * mC | 282 | UGGCAGUUUCCUUAGUAACC | XXXXX XXXXX XXXXX XXXX |
| WV-2303 | mA * mU * mG * mG * mC * mA * mG * mU * mU * mU * mC * mC * mU * mU * mA * mG * mU * mA * mA * mC | 283 | AUGGCAGUUUCCUUAGUAAC | XXXXX XXXXX XXXXX XXXX |
| WV-2304 | mG * mA * mU * mG * mG * mC * mA * mG * mU * mU * mU * mC * mC * mU * mU * mA * mG * mU * mA * mA | 284 | GAUGGCAGUUUCCUUAGUAA | XXXXX XXXXX XXXXX XXXX |
| WV-2305 | mA * mG * mA * mU * mG * mG * mC * mA * mG * mU * mU * mU * mC * mC * mU * mU * mA * mG * mU * mA | 285 | AGAUGGCAGUUUCCUUAGUA | XXXXX XXXXX XXXXX XXXX |
| WV-2306 | mG * mG * mA * mG * mA * mU * mG * mG * mC * mA * mG * mU * mU * mU * mC * mC * mU * mU * mA * mG | 286 | GGAGAUGGCAGUUUCCUUAG | XXXXX XXXXX XXXXX XXXX |
| WV-2307 | mU * mG * mG * mA * mG * mA * mU * mG * mG * mC * mA * mG * mU * mU * mU * mC * mC * mU * mU * mA | 287 | UGGAGAUGGCAGUUUCCUUA | XXXXX XXXXX XXXXX XXXX |
| WV- | mU * mU * mG * mG * mA * mG * mA * mU * mG * mG * mC * mA * | 288 | UUGGAGAUGGCAGU | XXXXX XXXXX |

TABLE A1-continued

| | | | | |
|---|---|---|---|---|
| 2308 | mG * mU * mU * mU * mC * mC * mU * mU | | UUCCUU | XXXXX XXXX |
| WV-2309 | mU * mU * mU * mG * mG * mA * mG * mA * mU * mG * mG * mC * mA * mG * mU * mU * mU * mC * mC * mU | 289 | UUUGGAGAUGGCAG UUUCCU | XXXXX XXXXX XXXXX XXXX |
| WV-2310 | mG * mU * mU * mU * mG * mG * mA * mG * mA * mU * mG * mG * mC * mA * mG * mU * mU * mU * mC * mC | 290 | GUUUGGAGAUGGCA GUUUCC | XXXXX XXXXX XXXXX XXXX |
| WV-2311 | mC * mU * mA * mG * mU * mU * mU * mG * mG * mA * mG * mA * mU * mG * mG * mC * mA * mG * mU * mU | 291 | CUAGUUUGGAGAUG GCAGUU | XXXXX XXXXX XXXXX XXXX |
| WV-2312 | mU * mC * mU * mA * mG * mU * mU * mU * mG * mG * mA * mG * mA * mU * mG * mG * mC * mA * mG * mU | 292 | UCUAGUUUGGAGAU GGCAGU | XXXXX XXXXX XXXXX XXXX |
| WV-2313 | mA * mU * mU * mU * mC * mU * mA * mG * mU * mU * mU * mG * mG * mA * mG * mA * mU * mG * mG * mC | 293 | AUUUCUAGUUUGGA GAUGGC | XXXXX XXXXX XXXXX XXXX |
| WV-2314 | mU * mG * mG * mC * mA * mU * mU * mU * mC * mU * mA * mG * mU * mU * mU * mG * mG * mA * mG * mA | 294 | UGGCAUUUCUAGUUU GGAGA | XXXXX XXXXX XXXXX XXXX |
| WV-2315 | mG * mA * mU * mG * mG * mC * mA * mU * mU * mU * mC * mU * mA * mG * mU * mU * mU * mG * mG * mA | 295 | GAUGGCAUUUCUAGU UUGGA | XXXXX XXXXX XXXXX XXXX |
| WV-2316 | mA * mG * mA * mU * mG * mG * mC * mA * mU * mU * mU * MC * mU * mA * mG * mU * mU * mU * mG * mG | 296 | AGAUGGCAUUUCUAG UUUGG | XXXXX XXXXX XXXXX XXXX |
| WV-2317 | mA * mA * mG * mA * mU * mG * mG * mC * mA * mU * mU * mU * mC * mU * mA * mG * mU * mU * mU * mG | 297 | AAGAUGGCAUUUCUA GUUUG | XXXXX XXXXX XXXXX XXXX |
| WV-2318 | mA * mG * mG * mA * mA * mG * mA * mU * mG * mG * mC * mA * mU * mU * mU * mC * mU * mA * mG * mU | 298 | AGGAAGAUGGCAUU UCUAGU | XXXXX XXXXX XXXXX XXXX |
| WV-2319 | mA * mA * mG * mG * mA * mA * mG * mA * mU * mG * mG * mC * mA * mU * mU * mU * mC * mU * mA * mG | 299 | AAGGAAGAUGGCAU UUCUAG | XXXXX XXXXX XXXXX XXXX |
| WV-2320 | mC * mA * mA * mG * mG * mA * mA * mG * mA * mU * mG * mG * mC * mA * mU * mU * mU * mC * mU * mA | 300 | CAAGGAAGAUGGCAU UUCUA | XXXXX XXXXX XXXXX XXXX |
| WV-2321 | mU * mC * mA * mA * mG * mG * mA * mA * mG * mA * mU * mG * mG * mC * mA * mU * mU * mU * mC * mU | 301 | UCAAGGAAGAUGGCA UUUCU | XXXXX XXXXX XXXXX XXXX |
| WV-2322 | mA * mC * mA * mU * mC * mA * mA * mG * mG * mA * mA * mG * mA * mU * mG * mG * mC * mA * mU * mU | 302 | ACAUCAAGGAAGAUG GCAUU | XXXXX XXXXX XXXXX XXXX |
| WV-2323 | mC * mA * mA * mC * mA * mU * mC * mA * mA * mG * mG * mA * mA * mG * mA * mU * mG * mG * mC * mA | 303 | CAACAUCAAGGAAGA UGGCA | XXXXX XXXXX XXXXX XXXX |
| WV-2324 | mU * mC * mC * mA * mA * mC * mA * mU * mC * mA * mA * mG * mG * mA * mA * mG * mA * mU * mG * mG | 304 | UCCAACAUCAAGGAA GAUGG | XXXXX XXXXX XXXXX XXXX |
| WV-2325 | mC * mC * mU * mC * mC * mA * mA * mC * mA * mU * mC * mA * mA * mG * mG * mA * mA * mG * mA * mU | 305 | CCUCCAACAUCAAGG AAGAU | XXXXX XXXXX XXXXX XXXX |

TABLE A1-continued

| | | | | |
|---|---|---|---|---|
| WV-2326 | mA * mG * mG * mU * mA * mC * mC * mU * mC * mC * mA * mA * mC * mA * mU * mC * mA * mA * mG * mG | 306 | AGGUACCUCCAACAUCAAGG | XXXXX XXXXX XXXXX XXXX |
| WV-2327 | mC * mA * mG * mG * mU * mA * mC * mC * mU * mC * mC * mA * mA * mC * mA * mU * mC * mA * mA * mG | 307 | CAGGUACCUCCAACAUCAAG | XXXXX XXXXX XXXXX XXXX |
| WV-2328 | mA * mG * mA * mG * mC * mA * mG * mG * mU * mA * mC * mC * mU * mC * mC * mA * mA * mC * mA * mU | 308 | AGAGCAGGUACCUCCAACAU | XXXXX XXXXX XXXXX XXXX |
| WV-2329 | mC * mA * mG * mA * mG * mC * mA * mG * mG * mU * mA * mC * mC * mU * mC * mC * mA * mA * mC * mA | 309 | CAGAGCAGGUACCUCCAACA | XXXXX XXXXX XXXXX XXXX |
| WV-2330 | mC * mC * mA * mG * mA * mG * mC * mA * mG * mG * mU * mA * mC * mC * mU * mC * mC * mA * mA * mC | 310 | CCAGAGCAGGUACCUCCAAC | XXXXX XXXXX XXXXX XXXX |
| WV-2331 | mG * mC * mC * mA * mG * mA * mG * mC * mA * mG * mG * mU * mA * mC * mC * mU * mC * mC * mA * mA | 311 | GCCAGAGCAGGUACCUCCAA | XXXXX XXXXX XXXXX XXXX |
| WV-2332 | mU * mG * mC * mC * mA * mG * mA * mG * mC * mA * mG * mG * mU * mA * mC * mC * mU * mC * mC * mA | 312 | UGCCAGAGCAGGUACCUCCA | XXXXX XXXXX XXXXX XXXX |
| WV-2333 | mC * mU * mG * mC * mC * mA * mG * mA * mG * mC * mA * mG * mG * mU * mA * mC * mC * mU * mC * mC | 313 | CUGCCAGAGCAGGUACCUCC | XXXXX XXXXX XXXXX XXXX |
| WV-2334 | mU * mC * mU * mG * mC * mC * mA * mG * mA * mG * mC * mA * mG * mG * mU * mA * mC * mC * mU * mC | 314 | UCUGCCAGAGCAGGUACCUC | XXXXX XXXXX XXXXX XXXX |
| WV-2335 | mA * mU * mC * mU * mG * mC * mC * mA * mG * mA * mG * mC * mA * mG * mG * mU * mA * mC * mC * mU | 315 | AUCUGCCAGAGCAGGUACCU | XXXXX XXXXX XXXXX XXXX |
| WV-2336 | mU * mU * mG * mA * mA * mA * mU * mC * mU * mG * mC * mC * mA * mG * mA * mG * mC * mA * mG * mG | 316 | UUGAAAUCUGCCAGAGCAGG | XXXXX XXXXX XXXXX XXXX |
| WV-2337 | mC * mC * mC * mG * mG * mU * mU * mG * mA * mA * mA * mU * mC * mU * mG * mC * mC * mA * mG * mA | 317 | CCCGGUUGAAAUCUGCCAGA | XXXXX XXXXX XXXXX XXXX |
| WV-2338 | mG * mC * mC * mC * mG * mG * mU * mU * mG * mA * mA * mA * mU * mC * mU * mG * mC * mC * mA * mG | 318 | GCCCGGUUGAAAUCUGCCAG | XXXXX XXXXX XXXXX XXXX |
| WV-2339 | mA * mG * mC * mC * mC * mG * mG * mU * mU * mG * mA * mA * mA * mU * mC * mU * mG * mC * mC * mA | 319 | AGCCCGGUUGAAAUCUGCCA | XXXXX XXXXX XXXXX XXXX |
| WV-2340 | mC * mC * mA * mA * mG * mC * mC * mC * mG * mG * mU * mU * mG * mA * mA * mA * mU * mC * mU * mG | 320 | CCAAGCCCGGUUGAAAUCUG | XXXXX XXXXX XXXXX XXXX |
| WV-2341 | mU * mC * mC * mA * mA * mG * mC * mC * mC * mG * mG * mU * mU * mG * mA * mA * mA * mU * mC * mU | 321 | UCCAAGCCCGGUUGAAAUCU | XXXXX XXXXX XXXXX XXXX |
| WV-2342 | mG * mU * mC * mC * mA * mA * mG * mC * mC * mC * mG * mG * mU * mU * mG * mA * mA * mA * mU * mC | 322 | GUCCAAGCCCGGUUGAAAUC | XXXXX XXXXX XXXXX XXXX |
| WV-2343 | mU * mG * mU * mC * mC * mA * mA * mG * mC * mC * mC * mG * mG * mU * mU * mG * mA * mA * mA * mU | 323 | UGUCCAAGCCCGGUUGAAAU | XXXXX XXXXX XXXXX XXXX |

TABLE A1-continued

| | | | | |
|---|---|---|---|---|
| WV-2344 | mC * mU * mG * mU * mC * mC * mA * mA * mG * mC * mC * mC * mG * mG * mU * mU * mG * mA * mA * mA | 324 | CUGUCCAAGCCCGGUUGAAA | XXXXX XXXXX XXXXX XXXX |
| WV-2345 | mU * mC * mU * mG * mU * mC * mC * mA * mA * mG * mC * mC * mC * mG * mG * mU * mU * mG * mA * mA | 325 | UCUGUCCAAGCCCGGUUGAA | XXXXX XXXXX XXXXX XXXX |
| WV-2346 | mU * mU * mC * mU * mG * mU * mC * mC * mA * mA * mG * mC * mC * mC * mG * mG * mU * mU * mG * mA | 326 | UUCUGUCCAAGCCCGGUUGA | XXXXX XXXXX XXXXX XXXX |
| WV-2347 | mG * mU * mU * mC * mU * mG * mU * mC * mC * mA * mA * mG * mC * mC * mC * mG * mG * mU * mU * mG | 327 | GUUCUGUCCAAGCCCGGUUG | XXXXX XXXXX XXXXX XXXX |
| WV-2348 | mA * mG * mU * mU * mC * mU * mG * mU * mC * mC * mA * mA * mG * mC * mC * mC * mG * mG * mU * mU | 328 | AGUUCUGUCCAAGCCCGGUU | XXXXX XXXXX XXXXX XXXX |
| WV-2349 | mA * mA * mG * mU * mU * mC * mU * mG * mU * mC * mC * mA * mA * mG * mC * mC * mC * mG * mG * mU | 329 | AAGUUCUGUCCAAGCCCGGU | XXXXX XXXXX XXXXX XXXX |
| WV-2350 | mU * mA * mA * mG * mU * mU * mC * mU * mG * mU * mC * mC * mA * mA * mG * mC * mC * mC * mG * mG | 330 | UAAGUUCUGUCCAAGCCCGG | XXXXX XXXXX XXXXX XXXX |
| WV-2351 | mG * mU * mA * mA * mG * mU * mU * mC * mU * mG * mU * mC * mC * mA * mA * mG * mC * mC * mC * mG | 331 | GUAAGUUCUGUCCAAGCCCG | XXXXX XXXXX XXXXX XXXX |
| WV-2352 | mG * mG * mU * mA * mA * mG * mU * mU * mC * mU * mG * mU * mC * mC * mA * mA * mG * mC * mC * mC | 332 | GGUAAGUUCUGUCCAAGCCC | XXXXX XXXXX XXXXX XXXX |
| WV-2353 | mC * mA * mG * mU * mC * mG * mG * mU * mA * mA * mG * mU * mU * mC * mU * mG * mU * mC * mC * mA | 333 | CAGUCGGUAAGUUCUGUCCA | XXXXX XXXXX XXXXX XXXX |
| WV-2354 | mC * mC * mA * mG * mU * mC * mG * mG * mU * mA * mA * mG * mU * mU * mC * mU * mG * mU * mC * mC | 334 | CCAGUCGGUAAGUUCUGUCC | XXXXX XXXXX XXXXX XXXX |
| WV-2355 | mC * mC * mA * mC * mC * mA * mU * mC * mA * mC * mC * mC * mU * mC * mU * mG * mU * mG * mA * mU | 335 | CCACCAUCACCCUCUGUGAU | XXXXX XXXXX XXXXX XXXX |
| WV-2356 | mC * mC * mC * mA * mC * mC * mA * mU * mC * mA * mC * mC * mC * mU * mC * mU * mG * mU * mG * mA | 336 | CCCACCAUCACCCUCUGUGA | XXXXX XXXXX XXXXX XXXX |
| WV-2357 | mC * mA * mC * mC * mC * mA * mC * mC * mA * mU * mC * mA * mC * mC * mC * mU * mC * mU * mG * mU | 337 | CACCCACCAUCACCCUCUGU | XXXXX XXXXX XXXXX XXXX |
| WV-2358 | mU * mC * mA * mC * mC * mC * mA * mC * mC * mA * mU * mC * mA * mC * mC * mC * mU * mC * mU * mG | 338 | UCACCCACCAUCACCCUCUG | XXXXX XXXXX XXXXX XXXX |
| WV-2359 | mG * mU * mC * mA * mC * mC * mC * mA * mC * mC * mA * mU * mC * mA * mC * mC * mC * mU * mC * mU | 339 | GUCACCCACCAUCACCCUCU | XXXXX XXXXX XXXXX XXXX |
| WV-2360 | mG * mG * mU * mC * mA * mC * mC * mC * mA * mC * mC * mA * mU * mC * mA * mC * mC * mC * mU * mC | 340 | GGUCACCCACCAUCACCCUC | XXXXX XXXXX XXXXX XXXX |
| WV- | mU * mC * mA * mA * mG * mC * mA * mG * mA * mG * mA * mA * | 341 | UCAAGCAGAGAAAGC | XXXXX XXXXX |

TABLE A1-continued

| | | | | |
|---|---|---|---|---|
| 2361 | mA * mG * mC * mC * mA * mG * mU * mC | | CAGUC | XXXXX XXXX |
| WV-2362 | mU * mU * mG * mA * mU * mC * mA * mA * mG * mC * mA * mG * mA * mG * mA * mA * mA * mG * mC * mC | 342 | UUGAUCAAGCAGAGA AAGCC | XXXXX XXXXX XXXXX XXXX |
| WV-2363 | mU * S mC * S mA * R mA * R mG * R mG * R mA * R mA * R mG * R mA * R mU * R mG * R mG * R mC * R mA * R mU * R mU * R mU * S mC * S mU | 343 | UCAAGGAAGAUGGCA UUUCU | SSRRRRRRRRRR RRRRSS |
| WV-2364 | mU * S mC * S mA * S mA * S mG * R mG * R mA * R mA * R mG * R mA * R mU * R mG * R mG * R mC * R mA * R mU * S mU * S mU * S mC * S mU | 344 | UCAAGGAAGAUGGCA UUUCU | SSSSRRRRRRRR RRSSSS |
| WV-2365 | mU * S mC * S mA * S mA * S mG * S mG * R mA * R mA * R mG * R mA * R mU * R mG * R mG * R mC * R mA * S mU * S mU * S mU * S mC * S mU | 345 | UCAAGGAAGAUGGCA UUUCU | SSSSSRRRRRRR RSSSSS |
| WV-2366 | mU * S mC mA mA mG mG mA mA mG mA mU mG mG mC mA mU mU mU mC * S mU | 346 | UCAAGGAAGAUGGCA UUUCU | SOOOOO OOOOO OOOOOOOS |
| WV-2367 | mU * S mC * S mA mA mG mG mA mA mG mA mU mG mG mC mA mU mU mU * S mC * S mU | 347 | UCAAGGAAGAUGGCA UUUCU | SSOOOOO OOOOO OOOOOSS |
| WV-2368 | mU * S mC * S mA * S mA mG mG mA mA mG mA mU mG mG mC mA mU mU * S mU * S mC * S mU | 348 | UCAAGGAAGAUGGCA UUUCU | SSSOOOOO OOOOO OOOSSS |
| WV-2369 | mU * S mC * S mA * S mA * S mG mG mA mA mG mA mU mG mG mC mA mU * S mU * S mU * S mC * S mU | 349 | UCAAGGAAGAUGGCA UUUCU | SSSSOOOOO OOOOO OSSSS |
| WV-2370 | mU * S mC * S mA * S mA * S mG * S mG mA mA mG mA mU mG mG mC mA * S mU * S mU * S mU * S mC * S mU | 350 | UCAAGGAAGAUGGCA UUUCU | SSSSSOOOOOOOOO OSSSSS |
| WV-2381 | mU * mC mA mA mG mG mA mA mG mA mU mG mG mC mA mU mU mU mC * mU | 351 | UCAAGGAAGAUGGCA UUUCU | XOOOOO OOOOO OOOOOOOX |
| WV-2382 | mU * mU * mA mA mG mG mA mA mG mA mU mG mG mC mA mU mU mU * mC * mU | 352 | UCAAGGAAGAUGGCA UUUCU | XXOOOOO OOOOO OOOOOXX |
| WV-2383 | mU * mC * mA * mA mG mG mA mA mG mA mU mG mG mC mA mU mU * mU * mC * mU | 353 | UCAAGGAAGAUGGCA UUUCU | XXXOOOOO OOOOO OOOXXX |
| WV-2384 | mU * mC * mA * mA * mG mG mA mA mG mA mU mG mG mC mA mU * mU * mU * mC * mU | 354 | UCAAGGAAGAUGGCA UUUCU | XXXXOOOOO OOOOO OXXXX |
| WV-2385 | mU * mC * mA * mA * mG * mG mA mA mG mA mU mG mG mC mA * mU * mU * mU * mC * mU | 355 | UCAAGGAAGAUGGCA UUUCU | XXXXXOOOOOOO OOXXXXX |
| WV-2432 | fU * fC * fA * fA * fG * fG * mA mA mG mA mU mG mG mC * fA * fU * fU * fU * fC * fU | 356 | UCAAGGAAGAUGGCA UUUCU | XXXXXXOOOOOO OXXXXXX |
| WV-2433 | fU * fC * fA * fA * fG * mG mA mA mG mA mU mG mG mC mA * fU * fU * fU * fC * fU | 357 | UCAAGGAAGAUGGCA UUUCU | XXXXXOOOOOOO OOXXXXX |

TABLE A1-continued

| | | | | |
|---|---|---|---|---|
| WV-2434 | fU * fC * fA * fA * mG mG mA mA mG mA mU mG mG mC mA mU * fU * fU * fC * fU | 358 | UCAAGGAAGAUGGCA UUUCU | XXXXOOOOO OOOOO OXXXX |
| WV-2435 | fU * fC * fA * mA mG mG mA mA mG mA mU mG mG mC mA mU mU * fU * fC * fU | 359 | UCAAGGAAGAUGGCA UUUCU | XXXOOOOO OOOOO OOOXXX |
| WV-2436 | fU * fC * mA mA mG mG mA mA mG mA mU mG mG mC mA mU mU mU * fC * fU | 360 | UCAAGGAAGAUGGCA UUUCU | XXOOOOO OOOOO OOOOOXX |
| WV-2437 | fU * mC mA mA mG mG mA mA mG mA mU mG mG mC mA mU mU mU mC * fU | 361 | UCAAGGAAGAUGGCA UUUCU | XOOOOO OOOOO OOOOOOOX |
| WV-2438 | fU * SfC * SfA * SfA * SfG * SfG * S mA mA mG mA mU mG mG mC * SfA * SfU * SfU * SfU * SfC * SfU | 362 | UCAAGGAAGAUGGCA UUUCU | SSSSSSOOOOOOO SSSSSS |
| WV-2439 | fU * SfC * SfA * SfA * SfG * S mG mA mA mG mA mU mG mG mC mA * SfU * SfU * SfU * SfC * SfU | 363 | UCAAGGAAGAUGGCA UUUCU | SSSSSOOOOOOOO OSSSSS |
| WV-2440 | fU * SfC * SfA * SfA * S mG mG mA mA mG mA mU mG mG mC mA mU * SfU * SfU * SfC * SfU | 364 | UCAAGGAAGAUGGCA UUUCU | SSSSOOOOO OOOOO OSSSS |
| WV-2441 | fU * SfC * SfA * S mA mG mG mA mA mG mA mU mG mG mC mA mU mU * SfU * SfC * SfU | 365 | UCAAGGAAGAUGGCA UUUCU | SSSOOOOO OOOOO OOOSSS |
| WV-2442 | fU * SfC * S mA mA mG mG mA mA mG mA mU mG mG mC mA mU mU mU * SfC * SfU | 366 | UCAAGGAAGAUGGCA UUUCU | SSOOOOO OOOOO OOOOOSS |
| WV-2443 | fU * S mC mA mA mG mG mA mA mG mA mU mG mG mC mA mU mU mU mC * SfU | 367 | UCAAGGAAGAUGGCA UUUCU | SOOOOO OOOOO OOOOOOOS |
| WV-2444 | fU * SfC * SfA * SfA * SfG * SfG * S mA * R mA * R mG * R mA * R mU * R mG * R mG * R mC * SfA * SfU * SfU * SfU * SfC * SfU | 368 | UCAAGGAAGAUGGCA UUUCU | SSSSSSRRRRRRRS SSSSS |
| WV-2445 | fU * SfC * SfA * SfA * SfG * S mG * R mA * R mA * R mG * R mA * R mU * R mG * R mG * R mC * R mA * SfU * SfU * SfU * SfC * SfU | 369 | UCAAGGAAGAUGGCA UUUCU | SSSSSRRRRRRRR RSSSSS |
| WV-2446 | fU * SfC * SfA * SfA * S mG * R mG * R mA * R mA * R mG * R mA * R mU * R mG * R mG * R mC * R mA * R mU * SfU * SfU * SfC * SfU | 370 | UCAAGGAAGAUGGCA UUUCU | SSSSRRRRRRRRR RRSSSS |
| WV-2447 | fU * SfC * SfA * S mA * R mG * R mG * R mA * R mA * R mG * R mA * R mU * R mG * R mG * R mC * R mA * R mU * R mU * SfU * SfC * SfU | 371 | UCAAGGAAGAUGGCA UUUCU | SSSRRRRRRRRRR RRRSSS |
| WV-2448 | fU * SfC * S mA * R mA * R mG * R mG * R mA * R mA * R mG * R mA * R mU * R mG * R mG * R mC * R mA * R mU * R mU * R mU * SfC * SfU | 372 | UCAAGGAAGAUGGCA UUUCU | SSRRRRRRRRRRR RRRRSS |
| WV-2449 | fU * S mC * R mA * R mA * R mG * R mG * R mA * R mA * R mG * R mA * R mU * R mG * R mG * R mC * R mA * R mU * R mU * R mU * R mC * SfU | 373 | UCAAGGAAGAUGGCA UUUCU | SRRRRRRRRRRRR RRRRRS |
| WV- | fU * SfC * SfA * SfA * SfG * SfG * SfA * SfA * R mG * R mA * R mU * R | 374 | UCAAGGAAGAUGGCA | SSSSSSSRRRRRSS |

TABLE A1-continued

| | | | | |
|---|---|---|---|---|
| 2526 | mG * R mG * SfC * SfA * SfU * SfU * SfU * SfC * SfU | | UUUCU | SSSSS |
| WV-2527 | fU * SfC * SfA * SfA * SfG * SfG * SfA * SfA * S mG * R mA * R mU * R mG * SfG * SfC * SfA * SfU * SfU * SfU * SfC * SfU | 375 | UCAAGGAAGAUGGCA UUUCU | SSSSSSSSRRRSSSS SSSS |
| WV-2528 | fU * SfC * SfA * SfA * SfG * SfG * SfA * SfA * SfG * S mA * R mU * SfG * SfG * SfC * SfA * SfU * SfU * SfU * SfC * SfU | 376 | UCAAGGAAGAUGGCA UUUCU | SSSSSSSSSRSSSSS SSSS |
| WV-2529 | fU * SfC * SfA * SfA * SfG * SfG * SfA * SfA mG mA mU mG mG * SfC * SfA * SfU * SfU * SfU * SfC * SfU | 377 | UCAAGGAAGAUGGCA UUUCU | SSSSSSSOOOOOSS SSSSS |
| WV-2530 | fU * SfC * SfA * SfA * SfG * SfG * SfA * SfA * S mG mA mU mG * SfG * SfC * SfA * SfU * SfU * SfU * SfC * SfU | 378 | UCAAGGAAGAUGGCA UUUCU | SSSSSSSSOOOSSS SSSSS |
| WV-2531 | fU * SfC * SfA * SfA * SfG * SfG * SfA * SfA * SfG * S mA mU * SfG * SfG * SfC * SfA * SfU * SfU * SfU * SfC * SfU | 379 | UCAAGGAAGAUGGCA UUUCU | SSSSSSSSSOSSSSS SSSS |
| WV-2532 | fU * SfC * SfA * SfA * SfG * SfG * SfA * mA * mG * mA * mU * mG * mG * fC * SfA * SfU * SfU * SfU * SfC * SfU | 380 | UCAAGGAAGAUGGCA UUUCU | SSSSSSXXXXXXX SSSSSS |
| WV-2533 | mU * S mC * S mA * S mA * S mG * S mG * S mA * R mA * R mG * R mA * R mU * R mG * R mG * R mC * S mA * S mU * S mU * S mU * S mC * S mU | 381 | UCAAGGAAGAUGGCA UUUCU | SSSSSSRRRRRRRS SSSSS |
| WV-2534 | mU * S mC * S mA * S mA * S mG * S mG * S mA * S mA * R mG * R mA * R mU * R mG * R mG * S mC * S mA * S mU * S mU * S mU * S mC * S mU | 382 | UCAAGGAAGAUGGCA UUUCU | SSSSSSSRRRRRSS SSSSS |
| WV-2535 | mU * S mC * S mA * S mA * S mG * S mG * S mA * S mA * S mG * R mA * R mU * R mG * S mG * S mC * S mA * S mU * S mU * S mU * S mC * S mU | 383 | UCAAGGAAGAUGGCA UUUCU | SSSSSSSSRRRSSSS SSSS |
| WV-2536 | mU * S mC * S mA * S mA * S mG * S mG * S mA * S mA * S mG * S mA * R mU * S mG * S mG * S mC * S mA * S mU * S mU * S mU * S mC * S mU | 384 | UCAAGGAAGAUGGCA UUUCU | SSSSSSSSSRSSSSS SSSS |
| WV-2537 | mU * S mC * S mA * S mA * S mG * S mG * S mA * mA * mG * mA * mU * mG * mG * mC * S mA * S mU * S mU * S mU * S mC * S mU | 385 | UCAAGGAAGAUGGCA UUUCU | SSSSSSXXXXXXX SSSSSS |
| WV-2538 | L001 * mU * mC * mA * mA * mG * mG * mA * mA * mG * mA * mU * mG * mG * mC * mA * mU * mU * mU * mC * mU | 386 | UCAAGGAAGAUGGCA UUUCU | XXXXX XXXXX XXXXX XXXXX |
| WV-2578 | Mod013L001 * mU * mC * mA * mA * mG * mG * mA * mA * mG * mA * mU * mG * mG * mC * mA * mU * mU * mU * mC * mU | 387 | UCAAGGAAGAUGGCA UUUCU | XXXXX XXXXX XXXXX XXXXX |
| WV-2579 | Mod014L001 * mU * mC * mA * mA * mG * mG * mA * mA * mG * mA * mU * mG * mG * mC * mA * mU * mU * mU * mC * mU | 388 | UCAAGGAAGAUGGCA UUUCU | XXXXX XXXXX XXXXX XXXXX |
| WV-2580 | Mod005L001 * mU * mC * mA * mA * mG * mG * mA * mA * mG * mA * mU * mG * mG * mC * mA * mU * mU * mU * mC * mU | 389 | UCAAGGAAGAUGGCA UUUCU | XXXXX XXXXX XXXXX XXXXX |
| WV-2581 | Mod015L001 * mU * mC * mA * mA * mG * mG * mA * mA * mG * mA * mU * mG * mG * mC * mA * mU * mU * mU * mC * mU | 390 | UCAAGGAAGAUGGCA UUUCU | XXXXX XXXXX XXXXX XXXXX |
| WV-2582 | Mod016L001 * mU * mC * mA * mA * mG * mG * mA * mA * mG * mA * mU * mG * mG * mC * mA * mU * mU * mU * mC * mU | 391 | UCAAGGAAGAUGGCA UUUCU | XXXXX XXXXX XXXXX XXXXX |

TABLE A1-continued

| | | | | |
|---|---|---|---|---|
| WV-2583 | Mod017L001 * mU * mC * mA * mA * mG * mG * mA * mA * mG * mA * mU * mG * mG * mC * mA * mU * mU * mU * mC * mU | 392 | UCAAGGAAGAUGGCA UUUCU | XXXXX XXXXX XXXXX XXXXX |
| WV-2584 | Mod018L001 * mU * mC * mA * mA * mG * mG * mA * mA * mG * mA * mU * mG * mG * mC * mA * mU * mU * mU * mC * mU | 393 | UCAAGGAAGAUGGCA UUUCU | XXXXX XXXXX XXXXX XXXXX |
| WV-2585 | Mod019L001 * mU * mC * mA * mA * mG * mG * mA * mA * mG * mA * mU * mG * mG * mC * mA * mU * mU * mU * mC * mU | 394 | UCAAGGAAGAUGGCA UUUCU | XXXXX XXXXX XXXXX XXXXX |
| WV-2586 | Mod006L001 * mU * mC * mA * mA * mG * mG * mA * mA * mG * mA * mU * mG * mG * mC * mA * mU * mU * mU * mC * mU | 395 | UCAAGGAAGAUGGCA UUUCU | XXXXX XXXXX XXXXX XXXXX |
| WV-2587 | Mod020L001 * mU * mC * mA * mA * mG * mG * mA * mA * mG * mA * mU * mG * mG * mC * mA * mU * mU * mU * mC * mU | 396 | UCAAGGAAGAUGGCA UUUCU | XXXXX XXXXX XXXXX XXXXX |
| WV-2588 | Mod021 * mU * mC * mA * mA * mG * mG * mA * mA * mG * mA * mU * mG * mG * mC * mA * mU * mU * mU * mC * mU | 397 | UCAAGGAAGAUGGCA UUUCU | XXXXX XXXXX XXXXX XXXXX |
| WV-2625 | mC * mA * mA * mA * mG * mA * mA * mG * mA * mU * mG * mG * mC * mA * mU * mU * mU * mC * mU * mA * mG * mU * mU * mU * mG | 398 | CAAAGAAGAUGGCAU UUCUA GUUUG | XXXXX XXXXX XXXXX XXXXX XXXX |
| WV-2627 | mG * mC * mA * mA * mA * mG * mA * mA * mG * mA * mU * mG * mG * mC * mA * mU * mU * mU * mC * mU | 399 | GCAAAGAAGAUGGCA UUUCU | XXXXX XXXXX XXXXX XXXX |
| WV-2628 | fG * fC * fA * fA * fA * fG * mA * mA * mG * mA * mU * mG * mG * mC * fA * fU * fU * fU * fC * fU | 400 | GCAAAGAAGAUGGCA UUUCU | XXXXX XXXXX XXXXX XXXX |
| WV-2660 | mU * mC * mA * mA * mG * mG * mA mA mG mA mU mG mG mC * mA * mU * mU * mU * mC * mU | 401 | UCAAGGAAGAUGGCA UUUCU | XXXXXXOOOOOO OXXXXXX |
| WV-2661 | mU * mC * mA * mA * mG * mG * mA * mA mG mA mU mG mG * mC * mA * mU * mU * mU * mC * mU | 402 | UCAAGGAAGAUGGCA UUUCU | XXXXXXXOOOOO XXXXXXX |
| WV-2662 | mU * mC * mA * mA * mG * mG * mA * mA * mG mA mU mG * mG * mC * mA * mU * mU * mU * mC * mU | 403 | UCAAGGAAGAUGGCA UUUCU | XXXXXXXXOOOX XXXXXXX |
| WV-2663 | mU * mC * mA * mA * mG * mG * mA * mA * mG * mA mU * mG * mG * mC * mA * mU * mU * mU * mC * mU | 404 | UCAAGGAAGAUGGCA UUUCU | XXXXX XXXXOXXXXX XXXX |
| WV-2664 | mU * S mC * S mA * S mA * S mG * S mG * S mA mA mG mA mU mG mG mC * S mA * S mU * S mU * S mU * S mC * S mU | 405 | UCAAGGAAGAUGGCA UUUCU | SSSSSSOOOOOOO SSSSSS |
| WV-2665 | mU * S mC * S mA * S mA * S mG * S mG * S mA * S mA mG mA mU mG mG * S mC * S mA * S mU * S mU * S mU * S mC * S mU | 406 | UCAAGGAAGAUGGCA UUUCU | SSSSSSSOOOOOSS SSSSS |
| WV-2666 | mU * S mC * S mA * S mA * S mG * S mG * S mA * S mA * S mG mA mU mG * S mG * S mC * S mA * S mU * S mU * S mU * S mC * S mU | 407 | UCAAGGAAGAUGGCA UUUCU | SSSSSSSSOOOSSS SSSSS |
| WV-2667 | mU * S mC * S mA * S mA * S mG * S mG * S mA * S mA * S mG * S mA mU * S mG * S mG * S mC * S mA * S mU * S mU * S mU * S mC * S mU | 408 | UCAAGGAAGAUGGCA UUUCU | SSSSSSSSSOSSSSS SSSS |

TABLE A1-continued

| | | | | |
|---|---|---|---|---|
| WV-2668 | fU * fC * fA * fA * fG * fG * fA * mA mG mA mU mG mG * fC * fA * fU * fU * fU * fC * fU | 409 | UCAAGGAAGAUGGCAUUUCU | XXXXXXXOOOOOXXXXXXX |
| WV-2669 | fU * fC * fA * fA * fG * fG * fA * fA * mG mA mU mG * fG * fC * fA * fU * fU * fU * fC * fU | 410 | UCAAGGAAGAUGGCAUUUCU | XXXXXXXXOOOXXXXXXXX |
| WV-2670 | fU * fC * fA * fA * fG * fG * fA * fA * fG * mA mU * fG * fG * fC * fA * fU * fU * fU * fC * fU | 411 | UCAAGGAAGAUGGCAUUUCU | XXXXXXXXXOXXXXXXXXX |
| WV-2733 | L001 * mG * mG * mC * mC * mA * mA * mA * mC * mC * mU * mC * mG * mG * mC * mU * mU * mA * mC * mC * mU | 412 | GGCCAAACCUCGGCUUACCU | XXXXX XXXXX XXXXX XXXXX |
| WV-2734 | L001 * mG * mG * mC * mC * mA * mA * mA * mC * mC * mU * mC * mG * mG * mC * mU * mU * mA * mC * mC * mU * mG * mA * mA * mA * mU | 413 | GGCCAAACCUC GGCUUACCUGAAAU | XXXXX XXXXX XXXXX XXXXX XXXXX |
| WV-2737 | fU * SfC * SfA * SfA * SfG * SfG * S mA mA mG mA * R mU mG mG mC * SfA * SfU * SfU * SfU * SfC * SfU | 414 | UCAAGGAAGAUGGCAUUUCU | SSSSSSOOOROOOSSSSSS |
| WV-2738 | fU * SfC * SfA * SfA * SfG * SfG * S mA mA mG * R mA * R mU * R mG mG mC * SfA * SfU * SfU * SfU * SfC * SfU | 415 | UCAAGGAAGAUGGCAUUUCU | SSSSSSOORRROOSSSSSS |
| WV-2739 | fU * SfC * SfA * SfA * SfG * SfG * S mA mA * R mG * R mA * R mU * R mG * R mG mC * SfA * SfU * SfU * SfU * SfC * SfU | 416 | UCAAGGAAGAUGGCAUUUCU | SSSSSSORRRROSSSSSS |
| WV-2740 | fU * SfC * SfA * SfA * SfG * SfG * S mA * R mA * R mG mA mU mG * R mG * R mC * SfA * SfU * SfU * SfU * SfC * SfU | 417 | UCAAGGAAGAUGGCAUUUCU | SSSSSSRROOORRSSSSSS |
| WV-2741 | fU * SfC * SfA * SfA * SfG * SfG * S mA * R mA mG mA mU mG mG * R mC * SfA * SfU * SfU * SfU * SfC * SfU | 418 | UCAAGGAAGAUGGCAUUUCU | SSSSSSROOOOORSSSSSS |
| WV-2742 | fU * SfC * SfA * SfA * SfG * SfG * S mA * S mA * S mG mA mU mG * S mG * S mC * SfA * SfU * SfU * SfU * SfC * SfU | 419 | UCAAGGAAGAUGGCAUUUCU | SSSSSSSSOOOSSSSSSS |
| WV-2743 | fU * SfC * SfA * SfA * SfG * SfG * S mA * S mA mG mA mU mG mG * S mC * SfA * SfU * SfU * SfU * SfC * SfU | 420 | UCAAGGAAGAUGGCAUUUCU | SSSSSSSOOOOOSSSSSSS |
| WV-2744 | fU * SfC * SfA * SfA * SfG * SfG * S mA * S mA * S mG * S mA * S mU * S mG * S mG * S mC * SfA * SfU * SfU * SfU * SfC * SfU | 421 | UCAAGGAAGAUGGCAUUUCU | SSSSSSSSSSSSSSSSSSS |
| WV-2745 | fU * SfC * SfA * SfA * SfG * SfG * S mA mA mG mA mAfU * S mG mG * SfC * SfA * SfU * SfU * SfU * SfC * SfU | 422 | UCAAGGAAGAUGGCAUUUCU | SSSSSSOOOOSOSSSSSSS |
| WV-2746 | fU * SfC * SfA * SfA * SfG * SfG * S mA * R mA * R mG * R mA * RfU * S mG * R mG * SfC * SfA * SfU * SfU * SfU * SfC * SfU | 423 | UCAAGGAAGAUGGCAUUUCU | SSSSSSRRRRSRSSSSSSS |
| WV-2747 | fU * SfC * SfA * SfA * S mG * S mG * SfAfA mG mAfU * S mG mG * SfC * SfA * SfU * SfU * SfU * SfC * SfU | 424 | UCAAGGAAGAUGGCAUUUCU | SSSSSSOOOOSOSSSSSSS |
| WV-2748 | fU * SfC * SfA * SfA * S mG * S mG * SfA * RfA * R mG * R mA * RfU * S mG * R mG * SfC * SfA * SfU * SfU * SfU * SfU * SfC * SfU | 425 | UCAAGGAAGAUGGCAUUUCU | SSSSSSRRRRSRSSSSSSS |

TABLE A1-continued

| | | | | |
|---|---|---|---|---|
| WV-2749 | fU * SfC * SfA * SfA * SfG * SfG * SfA * S mA mG mA mU mG mG * SfC * SfA * SfU * SfU * SfU * SfC * SfU | 426 | UCAAGGAAGAUGGCA UUUCU | SSSSSSSOOOOOSS SSSSS |
| WV-2750 | fU * SfC * SfA * SfA * SfG * SfG * SfA * S mA * R mG * R mA * R mU * R mG * R mG * SfC * SfA * SfU * SfU * SfU * SfC * SfU | 427 | UCAAGGAAGAUGGCA UUUCU | SSSSSSSRRRRRSS SSSSS |
| WV-2752 | TCAAGGAAGATGGCATTTCT | 428 | TCAAGGAAGATGGCA TTTCT | OOOOO OOOOO OOOOOOOOO |
| WV-2783 | mU * S mC * S mA * S mA * SfG * SfG * S mA * R mA * R mG * R mA * R mU * R mG * R mG * R mC * SfA * SfU * S mU * S mU * S mC * S mU | 429 | UCAAGGAAGAUGGCA UUUCU | SSSSSSRRRRRRRS SSSSS |
| WV-2784 | mU * S mC * S mA * S mA * SfG * SfG * SfA * S mA * R mG * R mA * R mU * R mG * R mG * SfC * SfA * SfU * S mU * S mU * S mC * S mU | 430 | UCAAGGAAGAUGGCA UUUCU | SSSSSSSRRRRRSS SSSSS |
| WV-2785 | mU * S mC * S mA * S mA * SfG * SfG * SfA * SfA * S mG * R mA * R mU * R mG * SfG * SfC * SfA * SfU * S mU * S mU * S mC * S mU | 431 | UCAAGGAAGAUGGCA UUUCU | SSSSSSSSRRRSSSS SSSS |
| WV-2786 | mU * S mC * S mA * S mA * SfG * SfG * SfA * SfA * SfG * S mA * R mU * SfG * SfG * SfC * SfA * SfU * S mU * S mU * S mC * S mU | 432 | UCAAGGAAGAUGGCA UUUCU | SSSSSSSSSRSSSSS SSSS |
| WV-2787 | mU * S mC * S mA * S mA * SfG * SfG * S mA mA mG mA mU mG mG mC * SfA * SfU * S mU * S mU * S mC * S mU | 433 | UCAAGGAAGAUGGCA UUUCU | SSSSSSOOOOOOO SSSSSS |
| WV-2788 | mU * S mC * S mA * S mA * SfG * SfG * SfA * S mA mG mA mU mG mG * SfC * SfA * SfU * S mU * S mU * S mC * S mU | 434 | UCAAGGAAGAUGGCA UUUCU | SSSSSSSOOOOOSS SSSSS |
| WV-2789 | mU * S mC * S mA * S mA * SfG * SfG * SfA * SfA * S mG mA mU mG * SfU * SfC * SfA * SfU * S mU * S mU * S mC * S mU | 435 | UCAAGGAAGAUGGCA UUUCU | SSSSSSSSOOOSSS SSSSS |
| WV-2790 | mU * S mC * S mA * S mA * SfG * SfG * SfA * SfA * SfG * S mA mU * SfG * SfG * SfC * SfA * SfU * S mU * S mU * S mC * S mU | 436 | UCAAGGAAGAUGGCA UUUCU | SSSSSSSSSOSSSSS SSSS |
| WV-2791 | mU * S mC * S mA * SfA * SfG * SfG * S mA * R mA * R mG * R mA * R mU * R mG * R mG * R mC * SfA * SfU * SfU * S mU * S mC * S mU | 437 | UCAAGGAAGAUGGCA UUUCU | SSSSSSRRRRRRRS SSSSS |
| WV-2792 | mU * S mC * S mA * SfA * SfG * SfG * SfA * S mA * R mG * R mA * R mU * R mG * R mG * SfC * SfA * SfU * SfU * S mU * S mC * S mU | 438 | UCAAGGAAGAUGGCA UUUCU | SSSSSSSRRRRRSS SSSSS |
| WV-2793 | mU * S mC * S mA * SfA * SfG * SfG * SfA * SfA * S mG * R mA * R mU * R mG * SfG * SfC * SfA * SfU * SfU * S mU * S mC * S mU | 439 | UCAAGGAAGAUGGCA UUUCU | SSSSSSSSRRRSSSS SSSS |
| WV-2794 | mU * S mC * S mA * SfA * SfG * SfG * SfA * SfA * SfG * S mA * R mU * SfG * SfG * SfC * SfA * SfU * SfU * S mU * S mC * S mU | 440 | UCAAGGAAGAUGGCA UUUCU | SSSSSSSSSRSSSSS SSSS |
| WV-2795 | mU * S mC * S mA * SfA * SfG * SfG * SfA * SfA * S mG mA mU mG * SfG * SfU * SfA * SfU * SfU * S mU * S mC * S mU | 441 | UCAAGGAAGAUGGCA UUUCU | SSSSSSSSOOOSSS SSSSS |
| WV-2796 | mU * S mC * S mA * SfA * SfG * SfG * SfA * SfA * SfG * S mA mU * SfG * SfG * SfC * SfA * SfU * SfU * S mU * S mC * S mU | 442 | UCAAGGAAGAUGGCA UUUCU | SSSSSSSSSOSSSSS SSSS |
| WV- | fU * fC * fA * fA * fG * fG * fA * fA * mG * mA * mU * mG * mG * fC * | 443 | UCAAGGAAGAUGGCA | XXXXX XXXXX |

TABLE A1-continued

| | | | | |
|---|---|---|---|---|
| 2797 | fA * fU * fU * fU * fC * fU | | UUUCU | XXXXX XXXX |
| WV-2798 | fU * fC * fA * fA * fG * fG * fA * fA * mG * mA * mU * mG * fG * fC * fA * fU * fU * fU * fC * fU | 444 | UCAAGGAAGAUGGCA UUUCU | XXXXX XXXXX XXXXX XXXX |
| WV-2799 | fU * fC * fA * fA * fG * fG * fA * fA * fG * mA * mU * fG * fG * fC * fA * fU * fU * fU * fC * fU | 445 | UCAAGGAAGAUGGCA UUUCU | XXXXX XXXXX XXXXX XXXX |
| WV-2800 | fU * fC * fA * fA * fG * fG * fA * mA * mG * mA * mU * mG * mG * fC * fA * fU * fU * fU * fC * fU | 446 | UCAAGGAAGAUGGCA UUUCU | XXXXX XXXXX XXXXX XXXX |
| WV-2801 | mU * mC * mA * fA * fG * fG * mA * mA * mG * mA * mU * mG * mG * mC * fA * fU * fU * mU * mC * mU | 447 | UCAAGGAAGAUGGCA UUUCU | XXXXX XXXXX XXXXX XXXX |
| WV-2802 | mU * mC * mA * fA * fG * fG * fA * mA * mG * mA * mU * mG * mG * fC * fA * fU * fU * mU * mC * mU | 448 | UCAAGGAAGAUGGCA UUUCU | XXXXX XXXXX XXXXX XXXX |
| WV-2803 | mU * mC * mA * fA * fG * fG * fA * fA * mG * mA * mU * mG * fG * fC * fA * fU * fU * mU * mC * mU | 449 | UCAAGGAAGAUGGCA UUUCU | XXXXX XXXXX XXXXX XXXX |
| WV-2804 | mU * mC * mA * fA * fG * fG * fA * fA * fG * mA * mU * fG * fG * fC * fA * fU * fU * mU * mC * mU | 450 | UCAAGGAAGAUGGCA UUUCU | XXXXX XXXXX XXXXX XXXX |
| WV-2805 | mU * mC * mA * fA * fG * fG * fA * fA * mG mA mU mG * fG * fC * fA * fU * fU * mU * mC * mU | 451 | UCAAGGAAGAUGGCA UUUCU | XXXXXXXXOOOX XXXXXXX |
| WV-2806 | mU * mC * mA * fA * fG * fG * fA * fA * fG * mA mU * fG * fG * fC * fA * fU * fU * mU * mC * mU | 452 | UCAAGGAAGAUGGCA UUUCU | XXXXX XXXXOXXXXX XXXX |
| WV-2807 | Mod024L001 * mU * mC * mA * mA * mG * mG * mA * mA * mG * mA * mU * mG * mG * mC * mA * mU * mU * mU * mC * mU | 453 | UCAAGGAAGAUGGCA UUUCU | XXXXX XXXXX XXXXX XXXXX |
| WV-2808 | Mod026L001 * mU * mC * mA * mA * mG * mG * mA * mA * mG * mA * mU * mG * mG * mC * mA * mU * mU * mU * mC * mU | 454 | UCAAGGAAGAUGGCA UUUCU | XXXXX XXXXX XXXXX XXXXX |
| WV-2812 | fU * fC * fA * fA * fG * fG * mA * mA * mG * mA * BrdU * mG * mG * mC * fA * fU * fU * fU * fC * fC | 455 | UCAAGGAAGATGGCA UUUCU | XXXXX XXXXX XXXXX XXXX |
| WV-2813 | fU * fC * fA * fA * fG * fG * fA * fA * fG * mA * BrdU * fG * fG * fC * fA * fU * fU * fU * fC * fU | 456 | UCAAGGAAGATGGCA UUUCU | XXXXX XXXXX XXXXX XXXX |
| WV-2814 | mU * mC * mA * mA * mG * mG * mA * mA * mG * mA * BrdU * mG * mG * mC * mA * mU * mU * mU * mC * mU | 457 | UCAAGGAAGATGGCA UUUCU | XXXXX XXXXX XXXXX XXXX |
| WV-3017 | fU * SfC * SfA * SfA * SfG * SfG * SfA * SfA * S mG mA BrdU mG * SfG * SfC * SfA * SfU * SfU * SfU * SfC * SfU | 458 | UCAAGGAAGATGGCA UUUCU | SSSSSSSSOOOSSS SSSSS |
| WV-3018 | fU * fC * fA * fA * fG * fG * fA * fA * mG mA BrdU mG * fG * fC * fA * fU * fU * fU * fC * fU | 459 | UCAAGGAAGATGGCA UUUCU | XXXXXXXXOOOX XXXXXXX |
| WV-3019 | fU * SfC * SfA * SfA * SfG * SfG * S mA mA mG mA BrdU mG mG mC * SfA * SfU * SfU * SfU * SfC * SfU | 460 | UCAAGGAAGATGGCA UUUCU | SSSSSSOOOOOOO SSSSSS |

TABLE A1-continued

| | | | | |
|---|---|---|---|---|
| WV-3020 | fU * fC * fA * fA * fG * fG * mA mA mG mA BrdU mG mG mC * fA * fU * fU * fU * fC * fU | 461 | UCAAGGAAGATGGCA UUUCU | XXXXXXOOOOOO OXXXXXX |
| WV-3022 | L001 * fU * SfC * SfA * SfA * SfG * SfG * S mA mA mG mA mU mG mG mC * SfA * SfU * SfU * SfU * SfC * SfU | 462 | UCAAGGAAGAUGGCA UUUCU | XSSSSSSOOOOOO OSSSSSS |
| WV-3023 | Mod015L001 * fU * SfC * SfA * SfA * SfG * SfG * S mA mA mG mA mU mG mG mC * SfA * SfU * SfU * SfU * SfC * SfU | 463 | UCAAGGAAGAUGGCA UUUCU | XSSSSSSOOOOOO OSSSSSS |
| WV-3024 | Mod006L001 * fU * SfC * SfA * SfA * SfG * SfG * S mA mA mG mA mU mG mG mC * SfA * SfU * SfU * SfU * SfC * SfU | 464 | UCAAGGAAGAUGGCA UUUCU | XSSSSSSOOOOOO OSSSSSS |
| WV-3025 | L001 * fU * SfC * SfA * SfA * SfG * SfG * SfA * SfA * S mG mA mU mG * SfG * SfC * SfA * SfU * SfU * SfU * SfC * sfU | 465 | UCAAGGAAGAUGGCA UUUCU | XSSSSSSSSOOOSS SSSSSS |
| WV-3026 | Mod015L001 * fU * SfC * SfA * SfA * SfG * SfG * SfA * SfA * S mG mA mU mG * SfG * SfC * SfA * SfU * SfU * SfU * SfC * SfU | 466 | UCAAGGAAGAUGGCA UUUCU | XSSSSSSSSOOOSS SSSSSS |
| WV-3027 | Mod006L001 * fU * SfC * SfA * SfA * SfG * SfG * SfA * SfA * S mG mA mU mG * SfG * SfC * SfA * SfU * SfU * SfU * SfC * SfU | 467 | UCAAGGAAGAUGGCA UUUCU | XSSSSSSSSOOOSS SSSSSS |
| WV-3028 | fU * SfC * SfA * SfA * SfG * SfG * SfA * SfA * S mG mA mU mG mG * SfC * SfA * SfU * SfU * SfU * SfC * SfU | 468 | UCAAGGAAGAUGGCA UUUCU | SSSSSSSSOOOOSS SSSSS |
| WV-3029 | L001 * fU * fC * fA * fA * fG * fG * mA * mA * mG * mA * mU * mG * mG * mC * fA * fU * fU * fU * fC * fU | 469 | UCAAGGAAGAUGGCA UUUCU | XXXXX XXXXX XXXXX XXXXX |
| WV-3030 | Mod015L001 * fU * fC * fA * fA * fG * fG * mA * mA * mG * mA * mU * mG * mG * mC * fA * fU * fU * fU * fC * fU | 470 | UCAAGGAAGAUGGCA UUUCU | XXXXX XXXXX XXXXX XXXXX |
| WV-3031 | Mod006L001 * fU * fC * fA * fA * fG * fG * mA * mA * mG * mA * mU * mG * mG * mC * fA * fU * fU * fU * fC * fU | 471 | UCAAGGAAGAUGGCA UUUCU | XXXXX XXXXX XXXXX XXXXX |
| WV-3032 | Mod020L001 * fU * fC * fA * fA * fG * fG * mA * mA * mG * mA * mU * mG * mG * mC * fA * fU * fU * fU * fC * fU | 472 | UCAAGGAAGAUGGCA UUUCU | XXXXX XXXXX XXXXX XXXXX |
| WV-3033 | Mod019L001 * fU * fC * fA * fA * fG * fG * mA * mA * mG * mA * mU * mG * mG * mC * fA * fU * fU * fU * fC * fU | 473 | UCAAGGAAGAUGGCA UUUCU | XXXXX XXXXX XXXXX XXXXX |
| WV-3034 | L001 * fU * fC * fA * fA * fG * fG * fA * fA * mG mA mU mG * fG * fC * fA * fU * fU * fU * fC * fU | 474 | UCAAGGAAGAUGGCA UUUCU | XXXXX XXXXOOOXXXXX XXX |
| WV-3035 | Mod015L001 * fU * fC * fA * fA * fG * fG * fA * fA * mG mA mU mG * fG * fC * fA * fU * fU * fU * fC * fU | 475 | UCAAGGAAGAUGGCA UUUCU | XXXXX XXXXOOOXXXXX XXX |
| WV-3036 | Mod006L001 * fU * fC * fA * fA * fG * fG * fA * fA * mG mA mU mG * fG * fC * fA * fU * fU * fU * fC * fU | 476 | UCAAGGAAGAUGGCA UUUCU | XXXXX XXXXOOOXXXXX XXX |
| WV- | Mod020L001 * fU * fC * fA * fA * fG * fG * fA * fA * mG mA mU mG * fG * | 477 | UCAAGGAAGAUGGCA | XXXXX |

TABLE A1-continued

| | | | | |
|---|---|---|---|---|
| 3037 | fC * fA * fU * fU * fU * fC * fU | | UUUCU | XXXXOOOXXXXX XXX |
| WV-3038 | Mod019L001 * fU * fC * fA * fA * fG * fG * fA * fA * mG mA mU mG * fG * fC * fA * fU * fU * fU * fC * fU | 478 | UCAAGGAAGAUGGCA UUUCU | XXXXX XXXXOOOXXXXX XXX |
| WV-3039 | fU * fC * fA * fA * fG * fG * mA mA mG mA * mU mG mG mC * fA * fU * fU * fU * fC * fU | 479 | UCAAGGAAGAUGGCA UUUCU | XXXXXXOOOXOO OXXXXXX |
| WV-3040 | fU * fC * fA * fA * fG * fG * mA mA mG * mA * mU * mG mG mC * fA * fU * fU * fU * fC * fU | 480 | UCAAGGAAGAUGGCA UUUCU | XXXXXXOOXXXO OXXXXXX |
| WV-3041 | fU * fC * fA * fA * fG * fG * mA mA * mG * mA * mU * mG * mG mC * fA * fU * fU * fU * fC * fU | 481 | UCAAGGAAGAUGGCA UUUCU | XXXXXXOXXXXX OXXXXXX |
| WV-3042 | fU * fC * fA * fA * fG * fG * mA * mA * mG mA mU mG * mG * mC * fA * fU * fU * fU * fC * fU | 482 | UCAAGGAAGAUGGCA UUUCU | XXXXXXXXOOOX XXXXXXX |
| WV-3043 | fU * fC * fA * fA * fG * fG * mA * mA mG mA mU mG mG * mC * fA * fU * fU * fU * fC * fU | 483 | UCAAGGAAGAUGGCA UUUCU | XXXXXXXOOOOO XXXXXXX |
| WV-3044 | fU * fC * fA * fA * fG * fG * mA * mA * mG mA mU mG * mG * mC * fA * fU * fU * fU * fC * fU | 484 | UCAAGGAAGAUGGCA UUUCU | XXXXXXXXOOOX XXXXXXX |
| WV-3045 | fU * fC * fA * fA * fG * fG * mA * mA mG mA mU mG mG * mC * fA * fU * fU * fU * fC * fU | 485 | UCAAGGAAGAUGGCA UUUCU | XXXXXXXOOOOO XXXXXXX |
| WV-3046 | fU * fC * fA * fA * fG * fG * mA mA mG mAfU * mG mG * fC * fA * fU * fU * fU * fC * fU | 486 | UCAAGGAAGAUGGCA UUUCU | XXXXXXOOOOXO XXXXXXX |
| WV-3047 | fU * fC * fA * fA * fG * fG * mA * mA * mG * mA * fU * mG * mG * fC * fA * fU * fU * fU * fC * fU | 487 | UCAAGGAAGAUGGCA UUUCU | XXXXX XXXXX XXXXX XXXX |
| WV-3048 | fU * fC * fA * fA * mG * mG * fAfA mG mAfU * mG mG * fC * fA * fU * fU * fU * fC * fU | 488 | UCAAGGAAGAUGGCA UUUCU | XXXXXXOOOOXO XXXXXXX |
| WV-3049 | fU * fC * fA * fA * mG * mG * fA * fA * mG * mA * fU * mG * mG * fC * fA * fU * fU * fU * fC * fU | 489 | UCAAGGAAGAUGGCA UUUCU | XXXXX XXXXX XXXXX XXXX |
| WV-3050 | fU * fC * fA * fA * fG * fG * mA * mA * mG * mA * fU * mG * mG * fC * fA * fU * fU * fU * fC * fU | 490 | UCAAGGAAGAUGGCA UUUCU | XXXXX XXXXX XXXXX XXXX |
| WV-3051 | fU * fC * fA * fA * mG * mG * mG * fA * fA * mG * mA * fU * mG * mG * fC * fA * fU * fU * fU * fC * fU | 491 | UCAAGGAAGAUGGCA UUUCU | XXXXX XXXXX XXXXX XXXX |
| WV-3052 | fU * fC * fA * fA * mG * mG * fA * fA * mG mA mU mG * mG * fC * fA * fU * fU * fU * fC * fU | 492 | UCAAGGAAGAUGGCA UUUCU | XXXXXXXXOOOX XXXXXXX |
| WV-3053 | fU * fC * fA * fA * mG * mG * mA * mA * mG mAfU mG * mG * fC * fA * fU * fU * fU * fC * fU | 493 | UCAAGGAAGAUGGCA UUUCU | XXXXXXXXOOOX XXXXXXX |
| WV- | fU * fC * fA * fA * mG * mG * fA * fA * mG * mA * mU * mG * mG * fC | 494 | UCAAGGAAGAUGGCA | XXXXX XXXXX |

TABLE A1-continued

| | | | | |
|---|---|---|---|---|
| 3054 | * fA * fU * fU * fU * fC * fU | | UUUCU | XXXXX XXXX |
| WV-3055 | fU * fC * fA * fA * mG * mG * mA * mA * mG * mA * fU * mG * mG * fC * fA * fU * fU * fU * fC * fU | 495 | UCAAGGAAGAUGGCA UUUCU | XXXXX XXXXX XXXXX XXXX |
| WV-3056 | fU * fC * fA * fA * mG * mG * fAfA mG mA * fU * mG mG * fC * fA * fU * fU * fU * fC * fU | 496 | UCAAGGAAGAUGGCA UUUCU | XXXXXXOOOXXO XXXXXXX |
| WV-3057 | fU * fC * fA * fA * mG * mG * fA * fA * mG * mA * fU * mG * mG * fC * fA * fU * fU * fU * fC * fU | 497 | UCAAGGAAGAUGGCA UUUCU | XXXXX XXXXX XXXXX XXXX |
| WV-3058 | fU * fC * fA * fA * mG * mG * fA * fA * mG * fA * fU * mG * mG * fC * fA * fU * fU * fU * fC * fU | 498 | UCAAGGAAGAUGGCA UUUCU | XXXXX XXXXX XXXXX XXXX |
| WV-3059 | fU * fC * fA * fA * mG * mG * fA * fA * mG mA mU mG mG * fC * fA * fU * fU * fU * fC * fU | 499 | UCAAGGAAGAUGGCA UUUCU | XXXXXXXXOOOO XXXXXXX |
| WV-3060 | fU * fC * fA * fA * mG * mG * fA * fA * mG mAfU * mG mG * fC * fA * fU * fU * fU * fC * fU | 500 | UCAAGGAAGAUGGCA UUUCU | XXXXXXXXOOXO XXXXXXX |
| WV-3061 | fU * fC * fA * fA * mG * mG * mA * mA * mG mAfU * mG mG * fC * fA * fU * fU * fU * fC * fU | 501 | UCAAGGAAGAUGGCA UUUCU | XXXXXXXXOOXO XXXXXXX |
| WV-3070 | fU * SfC * SfA * SfA * SfG * SfG * S mA mA mG mA mU: mG mG mC * SfA * SfU * SfU * SfU * SfC * SfU | 502 | UCAAGGAAGAUGGCA UUUCU | SSSSSSOOOODOO SSSSSS |
| WV-3071 | fU * SfC * SfA * SfA * SfG * SfG * S mA mA: mG mA: mU mG: mG mC * SfA * SfU * SfU * SfU * SfC * SfU | 503 | UCAAGGAAGAUGGCA UUUCU | SSSSSSODODODO SSSSSS |
| WV-3072 | fU * SfC * SfA * SfA * SfG * SfG * S mA: mA mG: mA mU: mG mG: mC * SfA * SfU * SfU * SfU * SfC * SfU | 504 | UCAAGGAAGAUGGCA UUUCU | SSSSSSDODODOD SSSSSS |
| WV-3073 | fU * SfC * SfA * SfA * SfG * SfG * S mA: mA mG mA mU: mG mG: mC * SfA * SfU * SfU * SfU * SfC * SfU | 505 | UCAAGGAAGAUGGCA UUUCU | SSSSSSDOOODOD SSSSSS |
| WV-3074 | fU * SfC * SfA * SfA * fG:fG: mA mA mG mA mU: mG mG mC * SfA * SfU * SfU * SfU * SfC * SfU | 506 | UCAAGGAAGAUGGCA UUUCU | SSSXDDOOOODO OSSSSSS |
| WV-3075 | fU * SfC * SfA * SfA * mG: mG: mA mA mG mA mU: mG mG mC * SfA * SfU * SfU * SfU * SfC * SfU | 507 | UCAAGGAAGAUGGCA UUUCU | SSSXDDOOOODO OSSSSSS |
| WV-3076 | fU * SfC * SfA * SfA * SfG * SfG * SfA * S mA mG mA mU: mG mG * SfC * SfA * SfU * SfU * SfU * SfC * SfU | 508 | UCAAGGAAGAUGGCA UUUCU | SSSSSSSOOODOSS SSSSS |
| WV-3077 | fU * SfC * SfA * SfA * fG:fG:fA * S mA mG mA mU: mG mG * SfC * SfA * SfU * SfU * SfU * SfC * SfU | 509 | UCAAGGAAGAUGGCA UUUCU | SSSXDDSOOODOS SSSSSS |
| WV-3078 | fU * SfC * SfA * SfA * mG: mG:fA * S mA mG mA mU: mG mG * SfC * SfA * SfU * SfU * SfU * SfC * SfU | 510 | UCAAGGAAGAUGGCA UUUCU | SSSXDDSOOODOS SSSSSS |
| WV-3079 | fU * SfC * SfA * SfA * SfG * SfG * SfA * SfA * S mG mA mU: mG * SfG * SfC * SfA * SfU * SfU * SfU * SfC * SfU | 511 | UCAAGGAAGAUGGCA UUUCU | SSSSSSSSOODSSS SSSSS |

TABLE A1-continued

| | | | | |
|---|---|---|---|---|
| WV-3080 | fU * SfC * SfA * SfA * SfG * SfG * SfA * SfA * S mG: mA: mU: mG * SfG * SfC * SfA * SfU * SfU * SfU * SfC * SfU | 512 | UCAAGGAAGAUGGCAUUUCU | SSSSSSSSDDDSSSSSSSS |
| WV-3081 | fU * SfC * SfA * SfA * SfG * SfG * SfA * SfA * S mG: mA mU: mG * SfG * SfC * SfA * SfU * SfU * SfU * SfC * SfU | 513 | UCAAGGAAGAUGGCAUUUCU | SSSSSSSSDODSSSSSSS |
| WV-3082 | fU * SfC * SfA * SfA * fG:fG:fA * SfA * S mG mA mU: mG * SfG * SfC * SfA * SfU * SfU * SfU * SfC * SfU | 514 | UCAAGGAAGAUGGCAUUUCU | SSSXDDSSOODSSSSSSSS |
| WV-3083 | fU * SfC * SfA * SfA * mG: mG:fA * SfA * S mG mA mU: mG * SfG * SfC * SfA * SfU * SfU * SfU * SfC * SfU | 515 | UCAAGGAAGAUGGCAUUUCU | SSSXDDSSOODSSSSSSSS |
| WV-3084 | Mod015L001 mU * mC * mA * mA * mG * mG * mA * mA * mG * mA * mU * mG * mG * mC * mA * mU * mU * mU * mC * mU | 516 | UCAAGGAAGAUGGCAUUUCU | OXXXXX XXXXX XXXXX XXXX |
| WV-3085 | Mod019L001 mU * mC * mA * mA * mG * mG * mA * mA * mG * mA * mU * mG * mG * mC * mA * mU * mU * mU * mC * mU | 517 | UCAAGGAAGAUGGCAUUUCU | OXXXXX XXXXX XXXXX XXXX |
| WV-3086 | Mod020L001 mU * mC * mA * mA * mG * mG * mA * mA * mG * mA * mU * mG * mG * mC * mA * mU * mU * mU * mC * mU | 518 | UCAAGGAAGAUGGCAUUUCU | OXXXXX XXXXX XXXXX XXXX |
| WV-3087 | Mod015L001: mU * mC * mA * mA * mG * mG * mA * mA * mG * mA * mU * mG * mG * mC * mA * mU * mU * mU * mC * mU | 519 | UCAAGGAAGAUGGCAUUUCU | DXXXXX XXXXX XXXXX XXXX |
| WV-3088 | Mod019L001: mU * mC * mA * mA * mG * mG * mA * mA * mG * mA * mU * mG * mG * mC * mA * mU * mU * mU * mC * mU | 520 | UCAAGGAAGAUGGCAUUUCU | DXXXXX XXXXX XXXXX XXXX |
| WV-3089 | Mod020L001: mU * mC * mA * mA * mG * mG * mA * mA * mG * mA * mU * mG * mG * mC * mA * mU * mU * mU * mC * mU | 521 | UCAAGGAAGAUGGCAUUUCU | DXXXXX XXXXX XXXXX XXXX |
| WV-3113 | fU * SfC * SfA * SfA * SfG:fG: mA mA mG mA mU: mG mG mC * SfA * SfU * SfU * SfU * SfC * SfU | 522 | UCAAGGAAGAUGGCAUUUCU | SSSSDDOOOODOOSSSSSS |
| WV-3114 | fU * SfC * SfA * SfA * S mG: mG: mA mA mG mA mU: mG mG mC * SfA * SfU * SfU * SfU * SfC * SfU | 523 | UCAAGGAAGAUGGCAUUUCU | SSSSDDOOOODOOSSSSSS |
| WV-3115 | fU * SfC * SfA * SfA * SfG:fG:fA * S mA mG mA mU: mG * SfC * SfA * SfU * SfU * SfU * SfC * SfU | 524 | UCAAGGAAGAUGGCAUUUCU | SSSSDDSOOODOSSSSSSS |
| WV-3116 | fU * SfC * SfA * SfA * S mG: mG:fA * S mA mG mA mU: mG mG * SfC * SfA * SfU * SfU * SfU * SfC * SfU | 525 | UCAAGGAAGAUGGCAUUUCU | SSSSDDSOOODOSSSSSSS |
| WV-3117 | fU * SfC * SfA * SfA * SfG:fG:fA * SfA * S mG mA mU: mG * SfG * SfC * SfA * SfU * SfU * SfU * SfC * SfU | 526 | UCAAGGAAGAUGGCAUUUCU | SSSSDDSSOODSSSSSSS |
| WV-3118 | fU * SfC * SfA * SfA * S mG: mG:fA * SfA * S mG mA mU: mG * SfG * SfC * SfA * SfU * SfU * SfU * SfC * SfU | 527 | UCAAGGAAGAUGGCAUUUCU | SSSSDDSSOODSSSSSSS |
| WV-3120 | fU * SfC * SfA * SfA * SfG * SfG * SfA * SfA * SfG * S mA mU mG * SfG * SfC * SfA * SfU * SfU * SfU * SfC * SfU | 528 | UCAAGGAAGAUGGCAUUUCU | SSSSSSSSSOOSSSSSSSS |
| WV-3121 | fU * fC * fA * fA * fG * fG * fA * fA * fG * mA mU mG * fG * fC * fA * fU * fU * fU * fC * fU | 529 | UCAAGGAAGAUGGCAUUUCU | XXXXXXXXXOOXXXXXX |

TABLE A1-continued

| | | | | |
|---|---|---|---|---|
| | | | | XX |
| WV-3152 | fU * SfC * SfA * SfA * SfG * SfG * S mAfA * S mGfA * S mUfG * S mGfC * SfA * SfU * SfU * SfU * SfC * SfU | 530 | UCAAGGAAGAUGGCA UUUCU | SSSSSSOSOSOSOS SSSSS |
| WV-3153 | fU * SfC * SfA * SfA * SfG * SfG * SfA * SfA * S mGfA * S mUfG * S mG * SfC * SfA * SfU * SfU * SfU * SfC * SfU | 531 | UCAAGGAAGAUGGCA UUUCU | SSSSSSSSOSOSSSS SSSS |
| WV-3357 | L001 mU * mC * mA * mA * mG * mG * mA * mA * mG * mA * mU * mG * mG * mC * mA * mU * mU * mU * mC * mU | 532 | UCAAGGAAGAUGGCA UUUCU | OXXXXX XXXXX XXXXX XXXX |
| WV-3358 | L001fU * SfC * SfA * SfA * SfG * SfG * SfA * SfA * SfG * S mA mU * SfG * SfG * SfC * SfA* SfU * SfU * SfU * SfC * SfU | 533 | UCAAGGAAGAUGGCA UUUCU | OSSSSSSSSSOSSSS SSSSS |
| WV-3359 | Mod013L001 mU * mC * mA * mA * mG * mG * mA * mA * mG * mA * mU * mG * mG * mC * mA * mU * mU * mU * mC * mU | 534 | UCAAGGAAGAUGGCA UUUCU | OXXXXX XXXXX XXXXX XXXX |
| WV-3360 | Mod013L001fU * SfC * SfA * SfA * SfG * SfG * SfA * SfA * SfG * S mA mU * SfG * SfG * SfC * SfA * SfU * SfU * SfU * SfC * SfU | 535 | UCAAGGAAGAUGGCA UUUCU | OSSSSSSSSSOSSSS SSSSS |
| WV-3361 | Mod014L001fU * SfC * SfA * SfA * SfG * SfG * SfA * SfA * SfG * S mA mU * SfG * SfG * SfC * SfA * SfU * SfU * SfU * SfC * SfU | 536 | UCAAGGAAGAUGGCA UUUCU | OSSSSSSSSSOSSSS SSSSS |
| WV-3362 | Mod005L001fU * SfC * SfA * SfA * SfG * SfG * SfA * SfA * SfG * S mA mU * SfG * SfG * SfC * SfA * SfU * SfU * SfU * SfC * SfU | 537 | UCAAGGAAGAUGGCA UUUCU | OSSSSSSSSSOSSSS SSSSS |
| WV-3363 | Mod015L001fU * SfC * SfA * SfA * SfG * SfG * SfA * SfA * SfG * S mA mU * SfG * SfG * SfC * SfA * SfU * SfU * SfU * SfC * SfU | 538 | UCAAGGAAGAUGGCA UUUCU | OSSSSSSSSSOSSSS SSSSS |
| WV-3364 | Mod020L001fU * SfC * SfA * SfA * SfG * SfG * SfA * SfA * SfG * S mA mU * SfG * SfG * SfC * SfA * SfU * SfU * SfU * SfC * SfU | 539 | UCAAGGAAGAUGGCA UUUCU | OSSSSSSSSSOSSSS SSSSS |
| WV-3365 | Mod027L001fU * SfC * SfA * SfA * SfG * SfG * SfA * SfA * SfG * S mA mU * SfG * SfG * SfC * SfA * SfU * SfU * SfU * SfC * SfU | 540 | UCAAGGAAGAUGGCA UUUCU | OSSSSSSSSSOSSSS SSSSS |
| WV-3366 | Mod029L001fU * SfC * SfA * SfA * SfG * SfG * SfA * SfA * SfG * S mA mU * SfG * SfG * SfC * SfA * SfU * SfU * SfU * SfC * SfU | 541 | UCAAGGAAGAUGGCA UUUCU | OSSSSSSSSSOSSSS SSSSS |
| WV-3463 | fU * SfC * SfA * SfA * SfG * SfGfA * S mAfG * S mAfU * S mGfGfC * SfA * SfU * SfU * SfU * SfC * SfU | 542 | UCAAGGAAGAUGGCA UUUCU | SSSSSOSOSOSOOS SSSSS |
| WV-3464 | fU * SfC * SfA * SfA * SfG * SfG * SfA * SfAfG * S mAfU * S mG * S mG * SfC * SfA * SfU * SfU * SfU * SfC * SfU | 543 | UCAAGGAAGAUGGCA UUUCU | SSSSSSSOSOSSSSS SSSS |
| WV-3465 | fU * SfC * SfA * SfA * SfG * SfG * SfA * SfA * SfG * S mAfU * S mG * SfG * SfC * SfA * SfU * SfU * SfU * SfC * SfU | 544 | UCAAGGAAGAUGGCA UUUCU | SSSSSSSSSOSSSS5 SSSS |
| WV-3466 | fU * SfC * SfA * SfA * SfG * SfG * SfA * SfA * S mG mAfU * S mG mG * SfC * SfA * SfU * SfU * SfU * SfC * SfG | 545 | UCAAGGAAGAUGGCA UUUCU | SSSSSSSSOOSOSS SSSSS |

TABLE A1-continued

| | | | | |
|---|---|---|---|---|
| WV-3467 | fU * SfC * SfA * SfA * SfG * SfG * SfA * SfA * SfG * S mAfU * S mGfG * SfC * SfA * SfU * SfU * SfU * SfC * SfU | 546 | UCAAGGAAGAUGGCAUUUCU | SSSSSSSSSOSOSSSSSSS |
| WV-3468 | fU * SfC * SfA * SfA * SfG * SfG * mA mA mG mAfU * S mG mG * SfC * SfA * SfU * SfU * SfU * SfC * SfU | 547 | UCAAGGAAGAUGGCAUUUCU | SSSSSXOOOOSOSSSSSSS |
| WV-3469 | fU * SfC * SfA * SfA * SfG * SfG * S mA * S mA * S mG * S mA * SfU * S mG * S mG * SfC * SfA * SfU * SfU * SfU * SfC * SfU | 548 | UCAAGGAAGAUGGCAUUUCU | SSSSSSSSSSSSSSSSSSS |
| WV-3470 | fU * SfC * SfA * SfA * SfG * SfG * S mAfA * S mGfA * SfUfG * S mGfC * SfA * SfU * SfU * SfU * SfC * SfU | 549 | UCAAGGAAGAUGGCAUUUCU | SSSSSSOSOSOSOSSSSSS |
| WV-3471 | fU * SfC * SfA * SfA * SfG * SfG * S mAfA * S mGfA * SfU mG mGfC * SfA * SfU * SfU * SfU * SfC * SfU | 550 | UCAAGGAAGAUGGCAUUUCU | SSSSSSOSOSOOOSSSSSS |
| WV-3472 | fU * SfC * SfA * SfA * SfG * SfG * S mAfA * S mGfA * SfU * S mG mGfC * SfA * SfU * SfU * SfU * SfC * SfU | 551 | UCAAGGAAGAUGGCAUUUCU | SSSSSSOSOSSOOSSSSSS |
| WV-3473 | fU * SfC * SfA * SfA * SfG * SfG * S mAfA * S mG mA * SfU * S mG mGfC * SfA * SfG * SfU * SfU * SfC * SfU | 552 | UCAAGGAAGAUGGCAUUUCU | SSSSSSOSOSSOOSSSSSS |
| WV-3506 | fU * SfC * SfA * SfA * SfG * SfG * S mAfA * S mGfAfU * S mG mGfC * SfA * SfU * SfU * SfU * SfC * SfU | 553 | UCAAGGAAGAUGGCAUUUCU | SSSSSSOSOOSOOSSSSSS |
| WV-3507 | fU * SfC * SfA * SfA * SfG * SfG * S mAfA * S mG mAfU * S mG mGfC * SfA * SfU * SfU * SfU * SfC * SfU | 554 | UCAAGGAAGAUGGCAUUUCU | SSSSSSOSOOSOOSSSSSS |
| WV-3508 | fU * SfC * SfA * SfA * SfG * SfG * S mAfA * S mGfA * SfU * S mG mGfC * SfAfU * SfU * SfU * SfC * SfU | 555 | UCAAGGAAGAUGGCAUUUCU | SSSSSSOSOSSOOSOSSSS |
| WV-3509 | fU * SfC * SfA * SfA * SfG * SfG * S mAfA * S mG mA * SfU * S mG mGfC * SfAfU * SfU * SfU * SfC * SfU | 556 | UCAAGGAAGAUGGCAUUUCU | SSSSSSOSOSSOOSOSSSS |
| WV-3510 | fU * SfC * SfA * SfA * SfG * SfG * S mAfA * S mGfAfU * S mG mGfC * S mA * SfU * SfU * SfU * SfC * SfU | 557 | UCAAGGAAGAUGGCAUUUCU | SSSSSSOSOOSOOSSSSSS |
| WV-3511 | fU * SfC * SfA * SfA * SfG* SfG* S mAfA * S mG mAfU * S mG mGfC * S mA * SfU * SfU * SfU * SfC * SfU | 558 | UCAAGGAAGAUGGCAUUUCU | SSSSSSOSOOSOOSSSSSS |
| WV-3512 | fU * SfC * SfA * SfA * SfG * SfG * S mAfA * S mGfAfU * S mG mGfC * S mAfU * SfU * SfU * SfC * SfU | 559 | UCAAGGAAGAUGGCAUUUCU | SSSSSSOSOOSOOSOSSSS |
| WV-3513 | fU * SfC * SfA * SfA * SfG * SfG * S mAfA * S mG mAfU * S mG mGfC * S mAfU * SfU * SfU * SfC * SfU | 560 | UCAAGGAAGAUGGCAUUUCU | SSSSSSOSOOSOOSOSSSS |
| WV-3514 | fU * SfC * SfA * SfA * SfG * SfG * S mAfA * S mGfAfU * S mG mGfC * SfAfU * SfU * SfU * SfC * SfU | 561 | UCAAGGAAGAUGGCAUUUCU | SSSSSSOSOOSOOSOSSSS |
| WV-3515 | fU * SfC * SfA * SfA * SfG * SfG * S mAfA * S mG mAfU * S mG mGfC * SfAfU * SfU * SfU * SfC * SfU | 562 | UCAAGGAAGAUGGCAUUUCU | SSSSSSOSOOSOOSOSSSS |
| WV- | fU * fC * fA * fA * fG * fG * mAfA * mGfA * mUfG * mGfC * fA * fU * fU | 563 | UCAAGGAAGAUGGCA | XXXXXXOXOXOX |

TABLE A1-continued

| | | | | |
|---|---|---|---|---|
| 3516 | * fU * fC * fU | | UUUCU | OXXXXXX |
| WV-3517 | Mod030fU * fC * fA * fA * fG * fG * mAfA * mGfA * mUfG * mGfC * fA * fU * fU * fU * fC * fU | 564 | UCAAGGAAGAUGGCA UUUCU | OXXXXXXOXOXO XOXXXXXX |
| WV-3518 | Mod031fU * fC * fA * fA * fG * fG * mAfA * mGfA * mUfG * mGfC * fA * fU * fU * fU * fC * fU | 565 | UCAAGGAAGAUGGCA UUUCU | OXXXXXXOXOXO XOXXXXXX |
| WV-3519 | Mod032fU * fC * fA * fA * fG * fG * mAfA * mGfA * mUfG * mGfC * fA * fU * fU * fU * fC * fU | 566 | UCAAGGAAGAUGGCA UUUCU | OXXXXXXOXOXO XOXXXXXX |
| WV-3520 | Mod033fU * fC * fA * fA * fG * fG * mAfA * mGfA * mUfG * mGfC * fA * fU * fU * fU * fC * fU | 567 | UCAAGGAAGAUGGCA UUUCU | OXXXXXXOXOXO XOXXXXXX |
| WV-3543 | Mod013L001fU * SfC * SfA * SfA * SfG * SfG * S mAfA * S mG mA * SfU * S mG mGfC * SfA * SfU * SfU * SfU * SfC * SfU | 568 | UCAAGGAAGAUGGCA UUUCU | OSSSSSSOSOSSOO SSSSSS |
| WV-3544 | Mod005L001fU * SfC * SfA * SfA * SfG * SfG * S mAfA * S mG mA * SfU * S mG mGfC * SfA * SfU * SfU * SfU * SfC * SfU | 569 | UCAAGGAAGAUGGCA UUUCU | OSSSSSSOSOSSOO SSSSSS |
| WV-3545 | Mod015L001fU * SfC * SfA * SfA * SfG * SfG * S mAfA * S mG mA * SfU * S mG mGfC * SfA * SfU * SfU * SfU * SfC * SfU | 570 | UCAAGGAAGAUGGCA UUUCU | OSSSSSSOSOSSOO SSSSSS |
| WV-3546 | Mod020L001fU * SfC * SfA * SfA * SfG * SfG * S mAfA * S mG mA * SfG * S mG mGfC * SfA * SfU * SfU * SfU * SfC * SfU | 571 | UCAAGGAAGAUGGCA UUUCU | OSSSSSSOSOSSOO SSSSSS |
| WV-3547 | Mod027L001fU * SfC * SfA * SfA * SfG * SfG * S mAfA * S mG mA * SfU * S mG mGfC * SfA * SfU * SfU * SfU * SfC * SfU | 572 | UCAAGGAAGAUGGCA UUUCU | OSSSSSSOSOSSOO SSSSSS |
| WV-3548 | Mod029L001fU * SfC * SfA * SfA * SfG * SfG * S mAfA * S mG mA * SfU * S mG mGfC * SfA * SfU * SfU * SfU * SfC * SfU | 573 | UCAAGGAAGAUGGCA UUUCU | OSSSSSSOSOSSOO SSSSSS |
| WV-3549 | Mod030fU * SfC * SfA * SfA * SfG * SfG * S mAfA * S mG mA * SfU * S mG mGfC * SfA * SfU * SfU * SfU * SfC * SfU | 574 | UCAAGGAAGAUGGCA UUUCU | OSSSSSSOSOSSOO SSSSSS |
| WV-3550 | Mod032fU * SfC * SfA * SfA * SfG * SfG * S mAfA * S mG mA * SfU * S mG mGfC * SfA * SfU * SfU * SfU * SfC * SfU | 575 | UCAAGGAAGAUGGCA UUUCU | OSSSSSSOSOSSOO SSSSSS |
| WV-3551 | Mod033fU * SfC * SfA * SfA * SfG * SfG * S mAfA * S mG mA * SfU * S mG mGfC * SfA * SfU * SfU * SfU * SfC * SfU | 576 | UCAAGGAAGAUGGCA UUUCU | OSSSSSSOSOSSOO SSSSSS |
| WV-3552 | Mod020L001 * fU * SfC * SfA * SfA * SfG * SfG * S mAfA * S mG mA * SfG * S mG mGfC * SfA * SfU * SfU * SfU * SfC * SfU | 577 | UCAAGGAAGAUGGCA UUUCU | OXSSSSSSOSOSSO OSSSSSS |
| WV-3553 | Mod005L001 * fU * SfC * SfA * SfA * SfG * SfG * S mAfA * S mG mA * SfU * S mG mGfC * SfA * SfU * SfU * SfU * SfC * SfU | 578 | UCAAGGAAGAUGGCA UUUCU | OXSSSSSSOSOSSO OSSSSSS |
| WV-3554 | Mod014L001fU * SfC * SfA * SfA * SfG * SfG * S mAfA * S mG mA * SfG * S mG mGfC * SfA * SfU * SfU * SfU * SfC * SfU | 579 | UCAAGGAAGAUGGCA UUUCU | OOSSSSSSOSOSSO OSSSSSS |
| WV-3555 | Mod030 * fU * SfC * SfA * SfA * SfG * SfG * S mAfA * S mG mA * SfU * S mG mGfC * SfA * SfU * SfU * SfU * SfC * SfU | 580 | UCAAGGAAGAUGGCA UUUCU | XSSSSSSOSOSSOO SSSSSS |

TABLE A1-continued

| | | | | |
|---|---|---|---|---|
| WV-3556 | Mod032 * fU * SfC * SfA * SfA * SfG * SfG * S mAfA * S mG mA * SfU * S mG mGfC * SfA * SfU * SfU * SfU * SfC * SfU | 581 | UCAAGGAAGAUGGCAUUUCU | XSSSSSSOSOSSOOSSSSSS |
| WV-3557 | Mod033 * fU * SfC * SfA * SfA * SfG * SfG * S mAfA * S mG mA * SfG * S mG mGfC * SfA * SfU * SfU * SfU * SfC * SfU | 582 | UCAAGGAAGAUGGCAUUUCU | XSSSSSSOSOSSOOSSSSSS |
| WV-3558 | Mod033 * fU * fC * fA * fA * fG * fG * mAfA * mGfA * mUfG * mGfC * fA * fU * fU * fU * fC * fU | 583 | UCAAGGAAGAUGGCAUUUCU | XXXXXXXOXOXOXOXXXXXX |
| WV-3559 | Mod020L001fU * fC * fA * fA * fG * fG * mAfA * mGfA * mUfG * mGfC * fA * fU * fU * fU * fC * fU | 584 | UCAAGGAAGAUGGCAUUUCU | OXXXXXXOXOXOXOXXXXXX |
| WV-3560 | Mod020L001 * fU * fC * fA * fA * fG * fG * mAfA * mGfA * mUfG * mGfC * fA * fU * fU * fU * fC * fU | 585 | UCAAGGAAGAUGGCAUUUCU | XXXXXXXOXOXOXOXXXXXX |
| WV-3753 | L001 * fU * SfC * SfA * SfA * SfG * SfG * S mAfA * S mG mA * SfU * S mG mGfC * SfA * SfU * SfU * SfU * SfC * SfU | 586 | UCAAGGAAGAUGGCAUUUCU | XSSSSSSOSOSSOOSSSSSS |
| WV-3754 | L001fU * SfC * SfA * SfA * SfG * SfG * S mAfA * S mG mA * SfU * S mG mGfC * SfA * SfU * SfU * SfU * SfC * SfU | 587 | UCAAGGAAGAUGGCAUUUCU | OSSSSSSOSOSSOOSSSSSS |
| WV-3820 | L001 * fU * fC * fA * fA * fG * fG * mAfA * mGfA * mUfG * mGfC * fA * fU * fU * fU * fC * fU | 588 | UCAAGGAAGAUGGCAUUUCU | XXXXXXXOXOXOXOXXXXXX |
| WV-3821 | L001fU * fC * fA * fA * fG * fG * mAfA * mGfA * mUfG * mGfC * fA * fU * fU * fU * fC * fU | 589 | UCAAGGAAGAUGGCAUUUCU | OXXXXXXOXOXOXOXXXXXX |
| WV-3855 | Mod015L001 * fU * fC * fA * fA * fG * fG * mAfA * mGfA * mUfG * mGfC * fA * fU * fU * fU * fC * fU | 590 | UCAAGGAAGAUGGCAUUUCU | XXXXXXXOXOXOXOXXXXXX |
| WV-3856 | Mod015L001fU * fC * fA * fA * fG * fG * mAfA * mGfA * mUfG * mGfC * fA * fU * fU * fU * fC * fU | 591 | UCAAGGAAGAUGGCAUUUCU | OXXXXXXOXOXOXOXXXXXX |
| WV-3971 | Mod033L001 * fU * SfC * SfA * SfA * SfG * SfG * S mAfA * S mG mA * SfU * S mG mGfC * SfA * SfU * SfU * SfU * SfC * SfU | 592 | UCAAGGAAGAUGGCAUUUCU | XSSSSSSOSOSSOOSSSSSS |
| WV-4106 | Mod015L001 * fU * SfC * SfA * SfA * SfG * SfG * S mAfA * S mG mA * SfU * S mG mGfC * SfA * SfU * SfU * SfU * SfC * SfU | 593 | UCAAGGAAGAUGGCAUUUCU | XSSSSSSOSOSSOOSSSSSS |
| WV-4107 | Mod015L001 * SfU * SfC * SfA * SfA * SfG * SfG * S mAfA * S mG mA * SfG * S mG mGfC * SfA * SfU * SfU * SfU * SfC * SfG | 594 | UCAAGGAAGAUGGCAUUUCU | SSSSSSSOSOSSOOSSSSSS |
| WV-4191 | L001 * SfU * SfC * SfA * SfA * SfG * SfG * S mAfA * S mG mA * SfU * S mG mGfC * SfA * SfU * SfU * SfU * SfC * SfU | 595 | UCAAGGAAGAUGGCAUUUCU | SSSSSSSOSOSSOOSSSSSS |
| WV-4231 | fU * SfC * SfA * SfA * SfG * SfG * S mAfA * S mG mA * SfU * S mG mGfC * SfA * SfU * SfU * SfU * SfC | 596 | UCAAGGAAGAUGGCAUUUC | SSSSSSOSOSSOOSSSSS |
| WV-4232 | fU * SfC * SfA * SfA * SfG * SfG * S mAfA * S mG mA * SfU * S mG mGfC * SfA * SfU * SfU * SfU | 597 | UCAAGGAAGAUGGCAUUU | SSSSSSOSOSSOOSSSS |
| WV-4233 | fC * SfA * SfA * SfG * SfG * S mAfA * S mG mA * SfU * S mG mGfC * SfA * SfU * SfU * SfU * SfC * SfU | 598 | CAAGGAAGAUGGCAUUUCU | SSSSSOSOSSOOSSSSSS |

TABLE A1-continued

| | | | | |
|---|---|---|---|---|
| WV-4610 | Mod020L001 mG * mG * mC * mC * mA * mA * mA * mC * mC * mU * mC * mG * mG * mC * mU * mU * mA * mC * mC * mU | 599 | GGCCAAACCUCGGCUUACCU | OXXXXX XXXXXXXXXX XXXX |
| WV-4611 | Mod015L001 mG * mG * mC * mC * mA * mA * mA * mC * mC * mU * mC * mG * mG * mC * mU * mU * mA * mC * mC * mU | 600 | GGCCAAACCUCGGCUUACCU | OXXXXX XXXXXXXXXX XXXX |
| WV-4614 | fU * fU * fC * fU * fG * fU * mA * mA * mG * mG * mU * mU * mU * mU * fU * fA * fU * fG * fU * fG | 601 | UUCUGUAAGGUUUUUAUGUG | XXXXX XXXXXXXXXX XXXX |
| WV-4615 | fA * fU * fU * fU * fC * fU * mG * mU * mA * mA * mG * mG * mU * mU * fU * fU * fU * fA * fU * fU | 602 | AUUUCUGUAAGGUUUUUAUG | XXXXX XXXXXXXXXX XXXX |
| WV-4616 | fC * fC * fA * fU * fU * fU * mC * mU * mG * mU * mA * mA * mG * mG * fU * fU * fU * fU * fU * fA | 603 | CCAUUUCUGUAAGGUUUUUA | XXXXX XXXXXXXXXX XXXX |
| WV-4617 | fA * fU * fU * fC * fA * fU * mU * mU * mC * mU * mG * mU * mA * mA * fG * fG * fU * fU * fU * fU | 604 | AUCCAUUUCUGUAAGGUUUU | XXXXX XXXXXXXXXX XXXX |
| WV-4618 | fC * fA * fU * fC * fC * fA * mU * mU * mU * mC * mU * mG * mU * mA * fA * fG * fG * fU * fU * fU | 605 | CAUCCAUUUCUGUAAGGUUU | XXXXX XXXXXXXXXX XXXX |
| WV-4619 | fC * fC * fA * fU * fC * fC * mA * mU * mU * mU * mC * mU * mG * mU * fA * fA * fG * fG * fU * fU | 606 | CCAUCCAUUUCUGUAAGGUU | XXXXX XXXXXXXXXX XXXX |
| WV-4620 | fG * fC * fC * fA * fU * fC * mC * mA * mU * mU * mU * mC * mU * mG * fU * fA * fA * fG * fG * fU | 607 | GCCAUCCAUUUCUGUAAGGU | XXXXX XXXXXXXXXX XXXX |
| WV-4621 | fA * fG * fC * fC * fA * fU * mC * mC * mA * mU * mU * mU * mC * mU * fG * fU * fA * fA * fG * fG | 608 | AGCCAUCCAUUUCUGUAAGG | XXXXX XXXXXXXXXX XXXX |
| WV-4622 | fC * fA * fG * fC * fC * fA * mU * mC * mC * mA * mU * mU * mU * mC * fU * fG * fU * fA * fA * fG | 609 | CAGCCAUCCAUUUCUGUAAG | XXXXX XXXXXXXXXX XXXX |
| WV-4623 | fU * fC * fA * fG * fC * fC * mA * mU * mC * mC * mA * mU * mU * mU * fC * fU * fG * fU * fA * fA | 610 | UCAGCCAUCCAUUUCUGUAA | XXXXX XXXXXXXXXX XXXX |
| WV-4624 | fU * fU * fC * fA * fG * fC * mC * mA * mU * mC * mC * mA * mU * mU * fU * fU * fU * fG * fU * fA | 611 | UUCAGCCAUCCAUUUCUGUA | XXXXX XXXXXXXXXX XXXX |
| WV-4625 | fC * fU * fU * fC * fA * fG * mC * mC * mA * mU * mC * mC * mA * mU * fU * fU * fC * fU * fG * fU | 612 | CUUCAGCCAUCCAUUUCUGU | XXXXX XXXXXXXXXX XXXX |
| WV-4626 | fA * fC * fU * fU * fC * fA * mG *mC * mC * mA * mU * mC * mC * mA * fU * fU * fU * fC * fU * fG | 613 | ACUUCAGCCAUCCAUUUCUG | XXXXX XXXXXXXXXX XXXX |
| WV-4627 | fA * fA * fC * fU * fU * fC * mA * mG * mC * mC * mA * mU * mC * mC * fA * fU * fU * fU * fC * fU | 614 | AACUUCAGCCAUCCAUUUCU | XXXXX XXXXXXXXXX XXXX |
| WV-4628 | fC * fA * fA * fC * fU * fU * mC * mA * mG * mC * mC * mA * mU * mC * fC * fA * fU * fU * fU * fC | 615 | CAACUUCAGCCAUCCAUUUC | XXXXX XXXXXXXXXX XXXX |
| WV- | fU * fC * fA * fA * fC * fU * mU * mC * mA * mG * mC * mC * mA * | 616 | UCAACUUCAGCCAUC | XXXXX XXXXX |

TABLE A1-continued

| | | | | |
|---|---|---|---|---|
| 4629 | mU * fC * fC * fA * fU * fU * fU | | CAUUU | XXXXX XXXX |
| WV-<br>4630 | fA * fU * fC * fA * fA * fC * mU * mU * mC * mA * mG * mC * mC *<br>mA * fU * fC * fC * fA * fU * fU | 617 | AUCAACUUCAGCCAU<br>CCAUU | XXXXX XXXXX<br>XXXXX XXXX |
| WV-<br>4631 | fC * fA * fU * fC * fA * fA * mC * mU * mU * mC * mA * mG * mC *<br>mC * fA * fU * fC * fC * fA * fU | 618 | CAUCAACUUCAGCCA<br>UCCAU | XXXXX XXXXX<br>XXXXX XXXX |
| WV-<br>4632 | fA * fC * fA * fU * fC * fA * mA * mC * mU * mU * mC * mA * mG *<br>mC * fC * fA * fU * fC * fC * fA | 619 | ACAUCAACUUCAGCC<br>AUCCA | XXXXX XXXXX<br>XXXXX XXXX |
| WV-<br>4633 | fA * fA * fC * fA * fU * fC * mA * mA * mC * mU * mU * mC * mA *<br>mG * fC * fC * fA * fU * fC * fC | 620 | AACAUCAACUUCAGC<br>CAUCC | XXXXX XXXXX<br>XXXXX XXXX |
| WV-<br>4634 | fG * fA * fA * fA * fA * fC * mA * mU * mC * mA * mA * mC * mU *<br>mU * fC * fA * fG * fC * fC * fA | 621 | GAAAACAUCAACUUC<br>AGCCA | XXXXX XXXXX<br>XXXXX XXXX |
| WV-<br>4635<br>0 | fC * fA * fG * fG * fA * fA * mA * mA * mC * mA * mU * mC * mA *<br>mA * fC * fU * fU * fC * fA * fG | 622 | CAGGAAAACAUCAAC<br>UUCAG | XXXXX XXXXX<br>XXXXX XXXX |
| WV-<br>4636 | fU * fU * fU * fC * fA * fG * mG * mA * mA * mA * mA * mC * mA *<br>mU * fC * fA * fA * fC * fU * fU | 623 | UUUCAGGAAAACAUG<br>AACUU | XXXXX XXXXX<br>XXXXX XXXX |
| WV-<br>4637 | fC * fU * fC * fU * fU * fU * mC * mA * mG * mG * mA * mA * mA *<br>mA * fC * fA * fU * fC * fA * fA | 624 | CUCUUUCAGGAAAAC<br>AUCAA | XXXXX XXXXX<br>XXXXX XXXX |
| WV-<br>4638 | fU * fU * fC * fC * fU * fC * mU * mU * mU * mC * mA * mG * mG *<br>mA * fA * fA * fA * fC * fA * fU | 625 | UUCCUCUUUCAGGAA<br>AACAU | XXXXX XXXXX<br>XXXXX XXXX |
| WV-<br>4639 | fG * fC * fC * fA * fU * fU * mC * mC * mU * mC * mU * mU * mU *<br>mC * fA * fG * fG * fA * fA * fA | 626 | GCCAUUCCUCUUUCA<br>GGAAA | XXXXX XXXXX<br>XXXXX XXXX |
| WV-<br>4640 | fG * fG * fC * fC * fA * fU * mU * mC * mC * mU * mC * mU * mU *<br>mU * fC * fA * fG * fG * fA * fA | 627 | GGCCAUUCCUCUUUC<br>AGGAA | XXXXX XXXXX<br>XXXXX XXXX |
| WV-<br>4641 | fA * fG * fG * fC * fC * fA * mU * mU * mC * mC * mU * mC * mU *<br>mU * fU * fC * fA * fG * fG * fA | 628 | AGGCCAUUCCUCUUU<br>CAGGA | XXXXX XXXXX<br>XXXXX XXXX |
| WV-<br>4642 | fC * fA * fG * fG * fC * fU * mA * mU * mU * mC * mC * mU * mC *<br>mU * fU * fU * fC * fA * fG * fG | 629 | CAGGCCAUUCCUCUU<br>UCAGG | XXXXX XXXXX<br>XXXXX XXXX |
| WV-<br>4643 | fG * fC * fA * fG * fG * fC * mC * mA * mU * mU * mC * mC * mU *<br>mC * fU * fU * fU * fC * fA * fG | 630 | GCAGGCCAUUCCUCU<br>UUCAG | XXXXX XXXXX<br>XXXXX XXXX |
| WV-<br>4644 | fG * fG * fC * fA * fG * fG * mC * mC * mA * mU * mU * mC * mC *<br>mU * fC * fU * fU * fU * fC * fA | 631 | GGCAGGCCAUUCCUC<br>UUUCA | XXXXX XXXXX<br>XXXXX XXXX |
| WV-<br>4645 | fG * fG * fG * fC * fA * fG * mG * mC * mC * mA * mU * mU * mC *<br>mC * fU * fC * fU * fU * fU * fC | 632 | GGGCAGGCCAUUCCU<br>CUUUC | XXXXX XXXXX<br>XXXXX XXXX |
| WV-<br>4646 | fA * fG * fG * fG * fC * fA * mG * mG * mC * mC * mA * mU * mU *<br>mC * fC * fU * fC * fU * fU * fU | 633 | AGGGCAGGCCAUUCC<br>UCUUU | XXXXX XXXXX<br>XXXXX XXXX |

TABLE A1-continued

| | | | | |
|---|---|---|---|---|
| WV-4647 | fC * fA * fG * fG * fG * fC * mA * mG * mG * mC * mC * mA * mU * mU * fC * fC * fU * fC * fU * fU | 634 | CAGGGCAGGCCAUUCCUCUU | XXXXX XXXXX XXXXX XXXX |
| WV-4648 | fC * fC * fA * fG * fG * fG * mC * mA * mG * mG * mC * mC * mA * mU * fU * fC * fC * fU * fC * fU | 635 | CCAGGGCAGGCCAUUCCUCU | XXXXX XXXXX XXXXX XXXX |
| WV-4649 | fC * fC * fC * fA * fG * fG * mG * mC * mA * mG * mG * mC * mC * mA * fU * fU * fC * fC * fU * fC | 636 | CCCAGGGCAGGCCAUUCCUC | XXXXX XXXXX XXXXX XXXX |
| WV-4650 | fC * fC * fC * fC * fA * fG * mG * mG * mC * mA * mG * mG * mC * mC * fA * fU * fU * fC * fC * fU | 637 | CCCCAGGGCAGGCCAUUCCU | XXXXX XXXXX XXXXX XXXX |
| WV-4651 | fC * fC * fC * fC * fC * fA * mG * mG * mG * mC * mA * mG * mG * mC * fC * fA * fU * fU * fC * fC | 638 | CCCCCAGGGCAGGCCAUUCC | XXXXX XXXXX XXXXX XXXX |
| WV-4652 | fU * fC * fC * fC * fC * fC * mA * mG * mG * mG * mC * mA * mG * mG * fC * fC * fA * fU * fU * fC | 639 | UCCCCCAGGGCAGGCCAUUC | XXXXX XXXXX XXXXX XXXX |
| WV-4653 | fA * fU * fC * fC * fC * fC * mC * mA * mG * mG * mG * mC * mA * mG * fG * fU * fC * fA * fU * fU | 640 | AUCCCCCAGGGCAGGCCAUU | XXXXX XXXXX XXXXX XXXX |
| WV-4654 | fC * fA * fU * fC * fC * fC * mC * mC * mA * mG * mG * mG * mC * mA * fG * fG * fC * fC * fA * fU | 641 | CAUCCCCCAGGGCAGGCCAU | XXXXX XXXXX XXXXX XXXX |
| WV-4655 | fG * fC * fA * fU * fC * fC * mC * mC * mC * mA * mG * mG * mG * mC * fA * fG * fG * fC * fC * fA | 642 | GCAUCCCCCAGGGCAGGCCA | XXXXX XXXXX XXXXX XXXX |
| WV-4656 | fA * fG * fC * fA * fU * fC * mC * mC * mC * mC * mA * mG * mG * mG * fC * fA * fG * fG * fC * fC | 643 | AGCAUCCCCCAGGGCAGGCC | XXXXX XXXXX XXXXX XXXX |
| WV-4657 | fC * fA * fG * fC * fA * fU * mC * mC * mC * mC * mC * mA * mG * mG * fG * fC * fA * fG * fG * fC | 644 | CAGCAUCCCCCAGGGCAGGC | XXXXX XXXXX XXXXX XXXX |
| WV-4658 | fU * fC * fA * fG * fC * fA * mU * mC * mC * mC * mC * mC * mA * mG * fG * fG * fC * fA * fG * fG | 645 | UCAGCAUCCCCCAGGGCAGG | XXXXX XXXXX XXXXX XXXX |
| WV-4659 | fU * fU * fC * fA * fG * fC * mA * mU * mC * mC * mC * mC * mC * mA * fG * fG * fG * fC * fA * fG | 646 | UUCAGCAUCCCCCAGGGCAG | XXXXX XXXXX XXXXX XXXX |
| WV-4660 | fU * fU * fU * fC * fA * fG * mC * mA * mU * mC * mC * mC * mC * mC * fA * fG * fG * fG * fC * fA | 647 | UUUCAGCAUCCCCCAGGGCA | XXXXX XXXXX XXXXX XXXX |
| WV-4661 | fU * fU * fU * fU * fC * fA * mG * mC * mA * mU * mC * mC * mC * mC * fC * fA * fG * fG * fG * fC | 648 | AUUUCAGCAUCCCCCAGGGC | XXXXX XXXXX XXXXX XXXX |
| WV-4662 | fG * fA * fU * fU * fU * fC * mA * mG * mC * mA * mU * mC * mC * mC * fC * fC * fA * fG * fG * fG | 649 | GAUUUCAGCAUCCCCCAGGG | XXXXX XXXXX XXXXX XXXX |
| WV-4663 | fG * fG * fA * fU * fU * fU * mC * mA * mG * mC * mA * mU * mC * mC * fC * fC * fC * fA * fG * fG | 650 | GGAUUUCAGCAUCCCCCAGG | XXXXX XXXXX XXXXX XXXX |
| WV-4664 | fA * fG * fG * fA * fU * fU * mU * mC * mA * mG * mC * mA * mU * mC * fC * fC * fC * fC * fA * fG | 651 | AGGAUUUCAGCAUCCCCCAG | XXXXX XXXXX XXXXX XXXX |

TABLE A1-continued

| | | | | |
|---|---|---|---|---|
| WV-4665 | fC * fA * fG * fG * fA * fU * mU * mU * mC * mA * mG * mC * mA * mU * fC * fC * fC * fC * fC * fA | 652 | CAGGAUUUCAGCAUCCCCCA | XXXXX XXXXX XXXXX XXXX |
| WV-4666 | fU * fC * fA * fG * fG * fA * mU * mU * mU * mC * mA * mG * mC * mA * fU * fC * fC * fC * fC * fC | 653 | UCAGGAUUUCAGCAUCCCCC | XXXXX XXXXX XXXXX XXXX |
| WV-4667 | fU * fU * fC * fA * fG * fG * mA * mU * mU * mU * mC * mA * mG * mC * fA * fU * fC * fC * fC * fC | 654 | UUCAGGAUUUCAGCAUCCCC | XXXXX XXXXX XXXXX XXXX |
| WV-4668 | fU * fU * fU * fC * fA * fG * mG * mA * mU * mU * mU * mC * mA * mG * fC * fA * fU * fC * fC * fC | 655 | UUUCAGGAUUUCAGCAUCCC | XXXXX XXXXX XXXXX XXXX |
| WV-4669 | fU * fU* fU * fU * fC * fA * mG * mG * mA * mU * mU * mU * mC * mA * fG * fC * fA * fU * fC * fC | 656 | UUUUCAGGAUUUCAGCAUCC | XXXXX XXXXX XXXXX XXXX |
| WV-4670 | fU * fU * fU * fU * fU * fC * mA * mG * mG * mA * mU * mU * mU * mC * fA * fG * fC * fA * fU * fC | 657 | UUUUUCAGGAUUUCAGCAUC | XXXXX XXXXX XXXXX XXXX |
| WV-4671 | fU * fU * fU * fU * fU * fU * mC * mA * mG * mG * mA * mU * mU * mU * fC * fA * fG * fC * fA * fU | 658 | UUUUUUCAGGAUUUCAGCAU | XXXXX XXXXX XXXXX XXXX |
| WV-4672 | fG * fU * fU * fU * fU * fU * mU * mC * mA * mG * mG * mA * mU * mU * fU * fC * fA * fG * fC * fA | 659 | GUUUUUUCAGGAUUUCAGCA | XXXXX XXXXX XXXXX XXXX |
| WV-4673 | fU * fG * fU * fU * fU * fU * mU * mU * mC * mA * mG * mG * mA * mU * fU * fU * fC * fA * fG * fC | 660 | UGUUUUUUCAGGAUUUCAGC | XXXXX XXXXX XXXXX XXXX |
| WV-4674 | fC * fU * fG * fU * fU * fU * mU * mU * mU * mC * mA * mG * mG * mA * fU * fU * fU * fC * fA * fG | 661 | CUGUUUUUUCAGGAUUUCAG | XXXXX XXXXX XXXXX XXXX |
| WV-4675 | fG * fC * fU * fG * fU * fU * mU * mU * mU * mU * mC * mA * mG * mG * fA * fU * fU * fU * fC * fA | 662 | GCUGUUUUUUCAGGAUUUCA | XXXXX XXXXX XXXXX XXXX |
| WV-4676 | fA * fG * fC * fU * fG * fU * mU * mU * mU * mU * mU * mC * mA * mG * fG * fA * fU * fU * fU * fC | 663 | AGCUGUUUUUUCAGGAUUUC | XXXXX XXXXX XXXXX XXXX |
| WV-4677 | fG * fA * fG * fC * fU * fG * mU * mU * mU * mU * mU * mU * mC * mA * fG * fG * fA * fU * fU * fU | 664 | GAGCUGUUUUUUCAGGAUUU | XXXXX XXXXX XXXXX XXXX |
| WV-4678 | fU * fG * fA * fG * fC * fU * mG * mU * mU * mU * mU * mU * mU * mC * fA * fG * fG * fA * fU * fU | 665 | UGAGCUGUUUUUUCAGGAUU | XXXXX XXXXX XXXXX XXXX |
| WV-4679 | fU * fU * fG * fA * fG * fC * mU * mG * mU * mU * mU * mU * mU * mU * fC * fA * fG * fG * fA * fU | 666 | UUGAGCUGUUUUUUCAGGAU | XXXXX XXXXX XXXXX XXXX |
| WV-4680 | fU * fU * fU * fG * fA * fG * mC * mU * mG * mU * mU * mU * mU * mU * fU * fC * fA * fG * fG * fA | 667 | UUUGAGCUGUUUUUUCAGGA | XXXXX XXXXX XXXXX XXXX |
| WV-4681 | fG * fU * fU * fU * fG * fA * mG * mC * mU * mG * mU * mU * mU * mU * fU * fU * fC * fA * fG * fG | 668 | GUUUGAGCUGUUUUUUCAGG | XXXXX XXXXX XXXXX XXXX |
| WV- | fU * fU * fG * fU * fU * fU * mG * mA * mG * mC * mU * mG * mU * | 669 | UUGUUUGAGCUGUU | XXXXX XXXXX |

TABLE A1-continued

| | | | | |
|---|---|---|---|---|
| 4682 | mU * fU * fU * fU * fU * fC * fA | | UUUUCA | XXXXX XXXX |
| WV-4683 | fC * fA * fU * fU * fG * fU * mU * mU * mG * mA * mG * mC * mU * mG * fU * fU * fU * fU * fU * fU | 670 | CAUUGUUUGAGCUGU UUUUU | XXXXX XXXXX XXXXX XXXX |
| WV-4684 | fG * fC * fA * fU * fU * fG * mU * mU * mU * mG * mA * mG * mC * mU * fG * fU * fU * fU * fU * fU | 671 | GCAUUGUUUGAGCUG UUUUU | XXXXX XXXXX XXXXX XXXX |
| WV-4685 | fU * fG * fC * fA * fU * fU * mG * mU * mU * mU * mG * mA * mG * mC * fU * fG * fU * fU * fU * fU | 672 | UGCAUUGUUUGAGCU GUUUU | XXXXX XXXXX XXXXX XXXX |
| WV-4686 | fC * fU * fG * fC * fA * fU * mU * mG * mU * mU * mU * mG * mA * mG * fC * fU * fG * fU * fU * fU | 673 | CUGCAUUGUUUGAGC UGUUU | XXXXX XXXXX XXXXX XXXX |
| WV-4687 | fU * fC * fU * fG * fC * fA * mU * mU * mG * mU * mU * mU * mG * mA * fG * fC * fU * fG * fU * fU | 674 | UCUGCAUUGUUUGAG CUGUU | XXXXX XXXXX XXXXX XXXX |
| WV-4688 | fC * fU * fC * fU * fG * fC * mA * mU * mU * mG * mU * mU * mU * mG * fA * fG * fC * fU * fG * fU | 675 | CUCUGCAUUGUUUGA GCUGU | XXXXX XXXXX XXXXX XXXX |
| WV-4689 | fA * fC * fU * fC * fU * fG * mC * mA * mU * mU * mG * mU * mU * mU * fG * fA * fG * fC * fU * fG | 676 | ACUCUGCAUUGUUUG AGCUG | XXXXX XXXXX XXXXX XXXX |
| WV-4690 | fU * fA * fC * fU * fC * fU * mG * mC * mA * mU * mU * mG * mU * mU * fU * fG * fA * fG * fC * fU | 677 | UACUCUGCAUUGUUU GAGCU | XXXXX XXXXX XXXXX XXXX |
| WV-4691 | fG * fU * fA * fC * fU * fC * mU * mG * mC * mA * mU * mU * mG * mU * fU * fU * fG * fA * fG * fC | 678 | UUACUCUGCAUUGUU UGAGC | XXXXX XXXXX XXXXX XXXX |
| WV-4692 | fC * fU * fU * fA * fC * fU * mC * mU * mG * mC * mA * mU * mU * mG * fU * fU * fU * fG * fA * fG | 679 | CUUACUCUGCAUUGU UUGAG | XXXXX XXXXX XXXXX XXXX |
| WV-4693 | fU * fC * fU * fU * fA * fC * mU * mC * mU * mG * mC * mA * mU * mU * fG * fU * fU * fU * fG * fA | 680 | UCUUACUCUGCAUUG UUUGA | XXXXX XXXXX XXXXX XXXX |
| WV-4694 | fA * fU * fC * fU * fU * fA * mC * mU * mC * mU * mG * mC * mA * mU * fU * fG * fU * fU * fU * fG | 681 | AUCUUACUCUGCAUU GUUUG | XXXXX XXXXX XXXXX XXXX |
| WV-4695 | fA * fA * fU * fC * fU * fU * mA * mC * mU * mC * mU * mG * mC * mA * fU * fU * fG * fU * fU * fU | 682 | AAUCUUACUCUGCAU UGUUU | XXXXX XXXXX XXXXX XXXX |
| WV-4696 | fC * fA * fA * fA * fU * fC * mU * mU * mA * mC * mU * mC * mU * mG * fC * fA * fU * fU * fG * fU | 683 | CAAAUCUUACUCUGC AUUGU | XXXXX XXXXX XXXXX XXXX |
| WV-4697 | fG * fA * fU * fA * fC * fA * mA * mA * mU * mC * mU * mU * mA * mC * fU * fC * fU * fG * fC * fA | 684 | GAUACAAAUCUUACU CUGCA | XXXXX XXXXX XXXXX XXXX |
| WV-4698 | fA * fA * fU * fU * fC * fU * mU * mU * mC * mA * mA * mC * mU * mA * fG * fA * fA * fU * fA * fA | 685 | AAUUCUUUCAACUAG AAUAA | XXXXX XXXXX XXXXX XXXX |
| WV-4699 | fU * fG * fA * fA * fU * fU * mC * mU * mU * mU * mC * mA * mA * mC * fU * fA * fG * fA * fA * fU | 686 | UGAAUUCUUUCAACU AGAAU | XXXXX XXXXX XXXXX XXXX |

TABLE A1-continued

| | | | | |
|---|---|---|---|---|
| WV-4700 | fU * fC * fU * fG * fA * fA * mU * mU * mC * mU * mU * mU * mC * mA * fA * fC * fU * fA * fG * fA | 687 | UCUGAAUUCUUUCAACUAGA | XXXXX XXXXX XXXXX XXXX |
| WV-4701 | fA * fU * fU * fC * fU * fG * mA * mA * mU * mU * mC * mU * mU * mU * fC * fA * fA * fC * fU * fA | 688 | AUUCUGAAUUCUUUCAACUA | XXXXX XXXXX XXXXX XXXX |
| WV-4702 | fU * fG * fA * fU * fU * fC * mU * mG * mA * mA * mU * mU * mC * mU * fU * fU * fC * fA * fA * fC | 689 | UGAUUCUGAAUUCUUUCAAC | XXXXX XXXXX XXXXX XXXX |
| WV-4703 | fA * fC * fU * fG * fA * fU * mU * mC * mU * mG * mA * mA * mU * mU * fC * fU * fU * fU * fC * fA | 690 | ACUGAUUCUGAAUUCUUUCA | XXXXX XXXXX XXXXX XXXX |
| WV-4704 | fC * fC * fA * fC * fU * fG * mA * mU * mU * mC * mU * mG * A * mA * fU * fU * fC * fU * fU * fU | 691 | CCACUGAUUCUGAAUUCUUU | XXXXX XXXXX XXXXX XXXX |
| WV-4705 | fU * fC * fC * fC * fA * fC * mU * mG * mA * mU * mU * mC * mU * mG * fA * fA * fU * fU * fC * fU | 692 | UCCCACUGAUUCUGAAUUCU | XXXXX XXXXX XXXXX XXXX |
| WV-4706 | fC * fA * fU * fC * fC * fC * mA * mC * mU * mG * mA * mU * mU * mC * fU * fG * fA * fA * fU * fU | 693 | CAUCCCACUGAUUCUGAAUU | XXXXX XXXXX XXXXX XXXX |
| WV-4707 | fU * fU * fC * fA * fU * fC * mC * mC * mA * mC * mU * mG * mA * mU * fU * fC * fU *fG * fA * fA | 694 | UUCAUCCCACUGAUUCUGAA | XXXXX XXXXX XXXXX XXXX |
| WV-4708 | fA * fC * fU * fU * fC * fA * mU * mC * mC * mC * mA * mC * mU * mG * fA * fU * fU * fC * fU * fG | 695 | ACUUCAUCCCACUGAUUCUG | XXXXX XXXXX XXXXX XXXX |
| WV-4709 | fG * fU * fA * fC * fU * fU * mC * mA * mU * mC * mC * mC * mA * mC * fU * fG * fA * fU * fU * fC | 696 | GUACUUCAUCCCACUGAUUC | XXXXX XXXXX XXXXX XXXX |
| WV-4710 | fU * fU * fG * fU * fA * fC * mU * mU * mC * mA * mU * mC * mC * mC * fA * fC * fU * fG * fA * fU | 697 | UUGUACUUCAUCCCACUGAU | XXXXX XXXXX XXXXX XXXX |
| WV-4711 | fU * fC * fU * fU * fG * fU * mA * mC * mU * mU * mC * mA * mU * mC * fC * fC * fA * fC * fU * fG | 698 | UCUUGUACUUCAUCCCACUG | XXXXX XXXXX XXXXX XXXX |
| WV-4712 | fG * fU * fU * fC * fU * fU * mG * mU * mA * mC * mU * mU * mC * mA * fU * fC * fC * fC * fA * fC | 699 | GUUCUUGUACUUCAUCCCAC | XXXXX XXXXX XXXXX XXXX |
| WV-4713 | fG * fU * fG * fU * fU * fC * mU * mU * mG * mU * mA *mC * mU * mU * fC * fA * fU * fC * fC * fC | 700 | GUGUUCUUGUACUUCAUCCC | XXXXX XXXXX XXXXX XXXX |
| WV-4714 | fA * fG * fG * fU * fG * fU * mU * mC * mU * mU * mG * mU * mA * mC * fU * fU * fC * fA * fU * fC | 701 | AGGUGUUCUUGUACUUCAUC | XXXXX XXXXX XXXXX XXXX |
| WV-4715 | fG * fA * fA * fG * fG * fU * mG * mU * mU * mC * mU * mU * mG * mU * fA * fC * fU * fU * fC * fA | 702 | GAAGGUGUUCUUGUACUUCA | XXXXX XXXXX XXXXX XXXX |
| WV-4716 | fC * fU * fG * fA * fA * fG * mG * mU * mG * mU * mU * mC * mU * mU * fG * fU * fA * fC * fU * fU | 703 | CUGAAGGUGUUCUUGUACUU | XXXXX XXXXX XXXXX XXXX |
| WV-4717 | fU * fU * fC * fU * fG * fA * mA * mG * mG * mU * mG * mU * mU * mC * fU * fU * fG * fU * fA * fC | 704 | UUCUGAAGGUGUUCUUGUAC | XXXXX XXXXX XXXXX XXXX |

TABLE A1-continued

| | | | | |
|---|---|---|---|---|
| WV-4718 | fG * fG * fU * fU * fC * fU * mG * mA * mA * mG * mG * mU * mG * mU * fU * fU * fU * fU * fG * fU | 705 | GGUUCUGAAGGUGUUCUUGU | XXXXX XXXXX XXXXX XXXX |
| WV-4719 | fC * fC * fG * fG * fU * fU * mC * mU * mG * mA * mA * mG * mG * mU * fG * fU * fU * fC * fU * fU | 706 | CCGGUUCUGAAGGUGUUCUU | XXXXX XXXXX XXXXX XXXX |
| WV-4720 | fC * fU * fC * fC * fG * fG * mU * mU * mC * mU * mG * mA * mA * mG * fG * fU * fG * fU * fU * fC | 707 | CUCCGGUUCUGAAGGUGUUC | XXXXX XXXXX XXXXX XXXX |
| WV-4721 | fG * fC * fC * fU * fC * fC * mG * mG * mU * mU * mC * mU * mG * mA * fA * fG * fG * fU * fG * fU | 708 | GCCUCCGGUUCUGAAGGUGU | XXXXX XXXXX XXXXX XXXX |
| WV-4722 | fU * fU * fG * fC * fC * fU * mC * mC * mG * mG * mU * mU * mC * mU * fG * fA * fA * fG * fG * fU | 709 | UUGCCUCCGGUUCUGAAGGU | XXXXX XXXXX XXXXX XXXX |
| WV-4723 | fU * fG * fU * fU * fG * fC * mC * mU * mC * mC * mG * mG * mU * mU * fC * fU * fG * fA * fA * fG | 710 | UGUUGCCUCCGGUUCUGAAG | XXXXX XXXXX XXXXX XXXX |
| WV-4724 | fA * fC * fU * fG * fU * fU * mG * mC * mC * mU * mC * mC * mG * mG * fU * fU * fC * fU * fG * fA | 711 | ACUGUUGCCUCCGGUUCUGA | XXXXX XXXXX XXXXX XXXX |
| WV-4725 | fC * fA * fA * fC * fU * fG * mU * mU * mG * mC * mC * mU * mC * mC * fG * fG * fU * fU * fC * fU | 712 | CAACUGUUGCCUCCGGUUCU | XXXXX XXXXX XXXXX XXXX |
| WV-4726 | fU * fU * fC * fA * fA * fC * mU * mG * mU * mU * mG * mC * mC * mU * fC * fC * fG * fG * fU * fU | 713 | UUCAACUGUUGCCUCCGGUU | XXXXX XXXXX XXXXX XXXX |
| WV-4727 | fC * fA * fU * fU * fC * fA * mA * mC * mU * mG * mU * mU * mG * mC * fC * fU * fC * fC * fG * fG | 714 | CAUUCAACUGUUGCCUCCGG | XXXXX XXXXX XXXXX XXXX |
| WV-4728 | fU * fU * fC * fA * fU * fU * mC * mA * mA * mC * mU * mG * mU * mU * fG * fC * fC * fU * fC * fC | 715 | UUCAUUCAACUGUUGCCUCC | XXXXX XXXXX XXXXX XXXX |
| WV-4729 | fA * fU * fU * fU * fC * fA * mU * mU * mC * mA * mA * mC * mU * mG * fU * fU * fG * fC * fC * fU | 716 | AUUUCAUUCAACUGUUGCCU | XXXXX XXXXX XXXXX XXXX |
| WV-4730 | fA * fU * fC * fC * fU * fU * mU * mA * mA * mC * mA * mU * mU * mU * fC * fA * fU * fU * fC * fA | 717 | AUCCUUUAACAUUUCAUUCA | XXXXX XXXXX XXXXX XXXX |
| WV-4731 | fG * fA * fA * fU * fC * fC * mU * mU * mU * mA * mA * mC * mA * mU * fU * fU * fC * fA * fU * fU | 718 | GAAUCCUUUAACAUUUCAUU | XXXXX XXXXX XXXXX XXXX |
| WV-4732 | fU * fU * fG * fA * fA * fU * mC * mC * mU * mU * mU * mA * mA * mC * fA * mU * fU * fU * fC * fA | 719 | UUGAAUCCUUUAACAUUUCA | XXXXX XXXXX XXXXX XXXX |
| WV-4733 | fU * fG * fU * fU * fG * fA * mA * mU * mC * mC * mU * mU * mU * mA * fA * fC * fA * fU * fU * fU | 720 | UGUUGAAUCCUUUAACAUUU | XXXXX XXXXX XXXXX XXXX |
| WV-4734 | fU * fG * fU * fG * fU * fU * mG * mA * mA * mU * mC * mC * mU * mU * fU * fA * fA * fC * fA * fU | 721 | UGUGUUGAAUCCUUUAACAU | XXXXX XXXXX XXXXX XXXX |
| WV- | fA * fU * fU * fG * fU * fG * mU * mU * mG * mA * mA * mU * mC * | 722 | AUUGUGUUGAAUCCU | XXXXX XXXXX |

TABLE A1-continued

| | | | | |
|---|---|---|---|---|
| 4735 | mC * fU * fU * fU * fA * fA * fC | | UUAAC | XXXXX XXXX |
| WV-<br>4736 | fC * fC * fA * fU * fU * fG * mU * mG * mU * mU * mG * mA * mA *<br>mU * fC * fC * fU * fU * fU * fA | 723 | CCAUUGUGUUGAAUC<br>CUUUA | XXXXX XXXXX<br>XXXXX XXXX |
| WV-<br>4737 | fA * fG * fC * fC * fA * fU * mU * mG * mU * mG * mU * mU * mG *<br>mA * fA * fU * fC * fC * fU * fU | 724 | AGCCAUUGUGUUGAA<br>UCCUU | XXXXX XXXXX<br>XXXXX XXXX |
| WV-<br>4738 | fC * fC * fA * fG * fC * fC * mA * mU * mU * mG * mU * mG * mU *<br>mU * fG * fA * fA * fU * fC * fC | 725 | CCAGCCAUUGUGUUG<br>AAUCC | XXXXX XXXXX<br>XXXXX XXXX |
| WV-<br>4739 | fU * fU * fC * fC * fA * fG * mC * mC * mA * mU * mU * mG * mU *<br>mG * fU * fU * fG * fA * fA * fU | 726 | UUCCAGCCAUUGUGU<br>UGAAU | XXXXX XXXXX<br>XXXXX XXXX |
| WV-<br>4740 | fG * fC * fU * fU * fC * fC * mA * mG * mC * mC * mA * mU * mU *<br>mG * fU * fG * fU * fU * fG * fA | 727 | GCUUCCAGCCAUUGU<br>GUUGA | XXXXX XXXXX<br>XXXXX XXXX |
| WV-<br>4741 | fU * fA * fG * fC * fU * fU * mC * mC * mA * mG * mC * mC * mA *<br>mU * fU * fG * fU * fG * fU * fU | 728 | UAGCUUCCAGCCAUU<br>GUGUU | XXXXX XXXXX<br>XXXXX XXXX |
| WV-<br>4742 | fC * fU * fU * fA * fG * fC * mU * mU * mC * mC * mA * mG * mC *<br>mC * fA * fU * fU * fU * fU * fG | 729 | CUUAGCUUCCAGCCA<br>UUGUG | XXXXX XXXXX<br>XXXXX XXXX |
| WV-<br>4743 | fU * fC * fC * fU * fU * fA * mG * mC * mU * mU * mC * mC * mA *<br>mG * fC * fC * fA * fU * fU * fG | 730 | UCCUUAGCUUCCAGC<br>CAUUG | XXXXX XXXXX<br>XXXXX XXXX |
| WV-<br>4744 | fC * fU * fU * fC * fC * fU * mU * mA * mG * mC * mU * mU * mC *<br>mC * fA * fG * fC * fC * fA * fU | 731 | CUUCCUUAGCUUCCA<br>GCCAU | XXXXX XXXXX<br>XXXXX XXXX |
| WV-<br>4745 | fU * fU * fC * fU * fU * fC * mC * mU * mU * mA * mG * mC * mU *<br>mU * fC * fC * fA * fG * fC * fC | 732 | UUCUUCCUUAGCUUC<br>CAGCC | XXXXX XXXXX<br>XXXXX XXXX |
| WV-<br>4746 | fG * fC * fU * fU * fC * fU * mU * mC * mC * mU * mU * mA * mG *<br>mC * fU * fU * fC * fC * fA * fG | 733 | GCUUCUUCCUUAGCU<br>UCCAG | XXXXX XXXXX<br>XXXXX XXXX |
| WV-<br>4747 | fC * fA * fG * fC * fU * fU * mC * mU * mU * mC * mC * mU * mU *<br>mA * fG * fC * fU * fU * fC * fC | 734 | CAGCUUCUUCCUUAG<br>CUUCC | XXXXX XXXXX<br>XXXXX XXXX |
| WV-<br>4748 | fC * fU * fC * fA * fG * fC * mU * mU * mC * mU * mU * mC * mC *<br>mU * fU * fA * fG * fC * fU * fU | 735 | CUCAGCUUCUUCCUU<br>AGCUU | XXXXX XXXXX<br>XXXXX XXXX |
| WV-<br>4749 | fC * fU * fG * fC * fU * fC * mA * mG * mC * mU * mU * mC * mU *<br>mU * fC * fC * fU * fU * fA * fG | 736 | CUGCUCAGCUUCUUC<br>CUUAG | XXXXX XXXXX<br>XXXXX XXXX |
| WV- | fA * fC * fC * fU * fG * fC * mU * mC * mA * mG * mC * mU * mU * | 737 | ACCUGCUCAGCUUCU | XXXXX XXXXX |
| WV-<br>4751 | fA * fG * fA * fC * fC * fU * mG * mC * mU * mC * mA * mG * mC *<br>mU * fU * fC * fU * fU * fC * fC | 738 | AGACCUGCUCAGCUU<br>CUUCC | XXXXX XXXXX<br>XXXXX XXXX |
| WV-<br>4752 | fU * fA * fA * fG * fA * fC * mC * mU * mG * mC * mU * mC * mA *<br>mG * fC * fU * fU * fC * fU * fU | 739 | UAAGACCUGCUCAGC<br>UUCUU | XXXXX XXXXX<br>XXXXX XXXX |
| WV-<br>4753 | fC * fC * fU * fA * fA * fG * mA * mC * mC * mU * mG * mC * mU *<br>mC * fA * fG * fC * fU * fU * fC | 740 | CCUAAGACCUGCUCA<br>GCUUC | XXXXX XXXXX<br>XXXXX XXXX |
| WV | fG * fU * fC * fC * fU * fA * mA * mG * mA * mC * mC * mU * mG * | 741 | GUCCUAAGACCUGCU | XXXXX XXXXX |

mC * fU * fUCXXXXX* XXXX* fU * fU

TABLE A1-continued

| | | | | |
|---|---|---|---|---|
| 4754 | mC * fU * fC * fA * fG * fC * fU | | CAGCU | XXXXX XXXX |
| WV-4755 | fC * fU * fG * fU * fC * fC * mU * mA * mA * mG * mA * mC * mC * mU * fG * fC * fU * fC * fA * fG | 742 | CUGUCCUAAGACCUG CUCAG | XXXXX XXXXX XXXXX XXXX |
| WV-4756 | fG * fG * fC * fC * fU * fG * mU * mC * mC * mU * mA * mA * mG * mA * fC * fC * fU * fG * fC * fU | 743 | GGCCUGUCCUAAGAC CUGCU | XXXXX XXXXX XXXXX XXXX |
| WV-4757 | fU * fU * fG * fG * fC * fC * mU * mG * mU * mC * mC * mU * mA * mA * fG * fA * fC * fC * fU * fG | 744 | CUGGCCUGUCCUAAG ACCUG | XXXXX XXXXX XXXXX XXXX |
| WV-4758 | fC * fU * fC * fU * fG * fG * mC * mC * mU * mG * mU * mC * mC * mU * fA * fA * fG * fA * fC * fC | 745 | CUCUGGCCUGUCCUA AGACC | XXXXX XXXXX XXXXX XXXX |
| WV-4759 | fG * fG * fC * fU * fC * fU * mG * mG * mC * mC * mU * mG * mU * mC * fC * fU * fA * fA * fG * fA | 746 | GGCUCUGGCCUGUCC UAAGA | XXXXX XXXXX XXXXX XXXX |
| WV-4760 | fU * fU * fG * fG * fC * fU * mC * mU * mG * mG * mC * mC * mU * mG * fU * fC * fC * fU * fA * fA | 747 | UUGGCUCUGGCCUGU CCUAA | XXXXX XXXXX XXXXX XXXX |
| WV-4761 | fG * fC * fU * fU * fG * fG * mC * mU * mC * mU * mG * mG * mC * mC * fU * fG * fU * fC * fC * fU | 748 | GCUUGGCUCUGGCCU GUCCU | XXXXX XXXXX XXXXX XXXX |
| WV-4762 | fA * fA * fG * fC * fU * fU * mG * mG * mC * mU * mC * mU * mG * mG * fC * fC * fU * fG * fU * fC | 749 | AAGCUUGGCUCUGGC CUGUC | XXXXX XXXXX XXXXX XXXX |
| WV-4763 | fU * fC * fA * fA * fG * fC * mU * mU * mG * mG * mC * mU * mC * mU * fG * fG * fC * fC * fU * fG | 750 | UCAAGCUUGGCUCUG GCCUG | XXXXX XXXXX XXXXX XXXX |
| WV-4764 | fU * fC * fC * fU * fU * fC * mC * mA * mU * mG * mA * mC * mU * mC * fA * fA * fG * fC * fU * fU | 751 | UCCUUCCAUGACUCA AGCUU | XXXXX XXXXX XXXXX XXXX |
| WV-4765 | fC * fC * fU * fC * fC * fU * mU * mC * mC * mA * mU * mG * mA * mC * fU * fC * fA * fA * fG * fC | 752 | CCUCCUUCCAUGACU CAAGC | XXXXX XXXXX XXXXX XXXX |
| WV-4766 | fA * fC * fC * fC * fU * fC * mC * mU * mU * mC * mC * mA * mU * mG * fA * fC * fU * fC * fA * fA | 753 | ACCCUCCUUCCAUGA CUCAA | XXXXX XXXXX XXXXX XXXX |
| WV-4767 | fG * fG * fA * fC * fC * fC * mU * mC * mC * mU * mU * mC * mC * mA * fU * fG * fA * fC * fU * fC | 754 | GGACCCUCCUUCCAU GACUC | XXXXX XXXXX XXXXX XXXX |
| WV-4768 | fA * fG * fG * fG * fA * fC * mC * mC * mU * mC * mC * mU * mU * mC * fC * fA * fU * fG * fA * fC | 755 | AGGGACCCUCCUUCC AUGAC | XXXXX XXXXX XXXXX XXXX |
| WV-4769 | fA * fU * fA * fG * fG * fG * mA * mC * mC * mC * mU * mC * mC * mU * fU * fC * fC * fA * fU * fG | 756 | AUAGGGACCCUCCUU CCAUG | XXXXX XXXXX XXXXX XXXX |
| WV-4770 | fG * fU * fA * fU * fA * fG * mG * mG * mA * mC * mC * mC * mU * mC * fC * fU * fU * fC * fC * fA | 757 | GUAUAGGGACCCUCC UUCCA | XXXXX XXXXX XXXXX XXXX |
| WV-4771 | fC * fU * fG * fU * fA * fU * mA * mG * mG * mG * mA * mC * mC * mC * fU * fC * fC * fU * fU * fC | 758 | CUGUAUAGGGACCCU CCUUC | XXXXX XXXXX XXXXX XXXX |

TABLE A1-continued

| | | | | |
|---|---|---|---|---|
| WV-4772 | fU * fA * fC * fU * fG * fU * mA * mU * mA * mG * mG * mG * mA * mC * fC * fC * fU * fC * fU * fU | 759 | UACUGUAUAGGGACCCUCCU | XXXXX XXXXX XXXXX XXXX |
| WV-4773 | fU * fC * fU * fA * fC * fU * mG * mU * mA * mU * mA * mG * mG * mG * fA * fC * fC * fC * fU * fC | 760 | UCUACUGUAUAGGGACCCUC | XXXXX XXXXX XXXXX XXXX |
| WV-4774 | fC * fA * fU * fC * fU * fA * mC * mU * mG * mU * mA * mU * mA * mG * fG * fG * fA * fC * fC * fC | 761 | CAUCUACUGUAUAGGGACCC | XXXXX XXXXX XXXXX XXXX |
| WV-4775 | fU * fG * fC * fA * fU * fC * mU * mA * mC * mU * mG * mU * mA * mU * fA * fG * fG * fG * fA * fC | 762 | UGCAUCUACUGUAUAGGGAC | XXXXX XXXXX XXXXX XXXX |
| WV-4776 | fA * fU * fU * fG * fC * fA * mU * mC * mU * mA * mC * mU * mG * mU * fA * fU * fA * fG * fG * fG | 763 | AUUGCAUCUACUGUAUAGGG | XXXXX XXXXX XXXXX XXXX |
| WV-4777 | fG * fG * fA * fU * fU * fG * mC * mA * mU * mC * mU * mA * mC * mU * fG * fU * fA * fU * fA * fG | 764 | GGAUUGCAUCUACUGUAUAG | XXXXX XXXXX XXXXX XXXX |
| WV-4778 | fU * fU * fG * fG * fA * fU * mU * mG * mC * mA * mU * mC * mU * mA * fC * fU * fG * fU * fA * fU | 765 | UUGGAUUGCAUCUACUGUAU | XXXXX XXXXX XXXXX XXXX |
| WV-4779 | fU * fU * fU * fU * fG * fG * mA * mU * mU * mG * mC * mA * mU * mC * fU * fA * fC * fU * fG * fU | 766 | UUUUGGAUUGCAUCUACUGU | XXXXX XXXXX XXXXX XXXX |
| WV-4780 | fU * fC * fU * fU * fU * fU * mG * mG * mA * mU * mU * mG * mC * mA * fU * fC * fU * fA * fC * fU | 767 | UCUUUUGGAUUGCAUCUACU | XXXXX XXXXX XXXXX XXXX |
| WV-4781 | fU * fU * fU * fC * fU * fU * mU * mU * mG * mG * mA * mU * mU * mG * fC * fA * fU * fC * fU * fA | 768 | UUUCUUUUGGAUUGCAUCUA | XXXXX XXXXX XXXXX XXXX |
| WV-4782 | fA * fU * fU * fU * fU * fC * mU * mU * mU * mU * mG * mG * mA * mU * fU * fG * fC * fA * fU * fC | 769 | AUUUUCUUUUGGAUUGCAUC | XXXXX XXXXX XXXXX XXXX |
| WV-4783 | fU * fG * fA * fU * fU * fU * mU * mC * mU * mU * mU * mU * mG * mG * fA * fU * fU * fG * fC * fA | 770 | UGAUUUUCUUUUGGAUUGCA | XXXXX XXXXX XXXXX XXXX |
| WV-4784 | fU * fG * fU * fG * fA * fU * mU * mU * mU * mC * mU * mU * mU * mU * fG * fG * fA * fU * fU * fG | 771 | UGUGAUUUUCUUUUGGAUUG | XXXXX XXXXX XXXXX XXXX |
| WV-4785 | fU * fC * fU * fG * fU * fG * mA * mU * mU * mU * mU * mC * mU * mU * fU * fU * fG * fG * fA * fU | 772 | UCUGUGAUUUUCUUUUGGAU | XXXXX XXXXX XXXXX XXXX |
| WV-4786 | fU * fU * fU * fC * fU * fG * mU * mG * mA * mU * mU * mU * mU * mC * fU * fU * fU * fU * fG * fG | 773 | UUUCUGUGAUUUUCUUUUGG | XXXXX XXXXX XXXXX XXXX |
| WV-4787 | fG * fG * fU * fU * fU * fC * mU * mG * mU * mG * mA * mU * mU * mU * fU * fC * fU * fU * fU * fU | 774 | GGUUUCUGUGAUUUUCUUUU | XXXXX XXXXX XXXXX XXXX |
| WV-4788 | fU * fU * fG * fG * fU * fU * mU * mC * mU * mG * mU * mG * mA * mU * fU * fU * fU * fC * fU * fU | 775 | UUGGUUUCUGUGAUUUUCUU | XXXXX XXXXX XXXXX XXXX |
| WV-4789 | fC * fC * fU * fU * fG * fG * mU * mU * mU * mC * mU * mG * mU * mG * fA * fU * fU * fU * fU * fC | 776 | CCUUGGUUUCUGUGAUUUUC | XXXXX XXXXX XXXXX XXXX |

TABLE A1-continued

| | | | | |
|---|---|---|---|---|
| WV-4790 | fA * fA* fC * fC * fU * fU * mG * mG * mU * mU * mU * mC * mU * mG * fU * fG * fA * fU * fU * fU | 777 | AACCUUGGUUUCUGUGAUUU | XXXXX XXXXX XXXXX XXXX |
| WV-4791 | fC * fG * fA * fA * fC * fC * mU * mU * mG * mG * mU * mU * mU * mC * fU * fG * fU * fG * fA * fU | 778 | CUAACCUUGGUUUCUGUGAU | XXXXX XXXXX XXXXX XXXX |
| WV-4792 | fU * fA * fC * fU * fA * fA * mC * mC * mU * mU * mG * mG * mU * mU * fU * fC * fU * fG * fU * fG | 779 | UACUAACCUUGGUUUCUGUG | XXXXX XXXXX XXXXX XXXX |
| WV-4793 | fG * fA * fU * fA * fC * fU * mA * mU * mC * mC * mU * mU * mG * mG * fU * fU * fU * fC * fU * fG | 780 | GAUACUAACCUUGGUUUCUG | XXXXX XXXXX XXXXX XXXX |
| WV-4890 | ChTEGfU * SfC * SfA * SfA * SfG * SfG * S mAfA * S mG mA * SfU * S mG mGfC * SfA * SfU * SfU * SfU * SfC * SfU | 781 | UCAAGGAAGAUGGCAUUUCU | OSSSSSSOSOSSOOUUUCUSSSSSS |
| WV-6010 | L001 mG * mG * mC * mC * mA * mA * mA * mC * mC * mU * mC * mG * mG * mC * mU * mU * mA * mC * mC * mU | 782 | GGCCAAACCUCGGCUUACCU | OXXXXX XXXXX XXXXX XXXX |
| WV-6137 | fU * fC * fA * fA * fG * fG * mAfA * mG mA * fU * mG mGfC * fA * fU * fU * fU * fU * fC * fU | 783 | UCAAGGAAGAUGGCAUUUCU | XXXXXXOXOXXOOXXXXXX |
| WV-6409 | Mod012L001fU * SfC * SfA * SfA * SfG * SfG * S mAfA * S mGfA * S mUfG * S mGfC * SfA * SfU * SfU * SfU * SfC * SfU | 784 | UCAAGGAAGAUGGCAUUUCU | OSSSSSSOSOSOSOSSSSSS |
| WV-6410 | Mod012L001fU * fC * fA * fA * fG * fG * mAfA * mGfA * mUfG * mGfC * fA * fU * fU * fU * fC * fU | 785 | UCAAGGAAGAUGGCAUUUCU | OXXXXXXOXOXOXOXXXXXX |
| WV-6560 | L001fU * SfC * SfA * SfA * SfG * SfG * S mAfA * S mGfA * S mUfG * S mGfC * SfA * SfU * SfU * SfU * SfC * SfU | 786 | UCAAGGAAGAUGGCAUUUCU | OSSSSSSOSOSOSOSSSSSS |
| WV-6826 | Mod012L001 mU * S mC * S mA * S mA * S mG * S mG * S mA mA * S mG mA * S mU mG * S mG mC * S mA * S mU * S mU * S mU * S mC * S mU | 787 | UCAAGGAAGAUGGCAUUUCU | OSSSSSSOSOSOSOSSSSSS |
| WV-6827 | Mod012L001 mU * mC * mA * mA * mG * mG * mA mA * mG mA * mU mG * mG mC * mA * mU * mU * mU * mC * mU | 788 | UCAAGGAAGAUGGCAUUUCU | OXXXXXXOXOXOXOXXXXXX |
| WV-6828 | Mod012L001 mU * mC * mA * mA * mG * mG * mA * mA * mG * mA * mU * mG * mG * mC * mA * mU * mU * mU * mC * mU | 789 | UCAAGGAAGAUGGCAUUUCU | OXXXXX XXXXX XXXXX XXXX |
| WV-6829 | Mod012L001fC * fC * fU * fU * fC * fC * mCfU * mGfA * mAfG * mGfU * fU * fC * fC * fU * fC * fC | 790 | CCUUCCCUGAAGGUUCCUCC | OXXXXXXOXOXOXOXXXXXX |
| WV-6830 | Mod012L001 mC * mC * mU * mU * mC * mC * mC mU * mG mA * mA mG * mG mU * mU * mC * mC * mU * mC * mC | 791 | CCUUCCCUGAAGGUUCCUCC | OXXXXXXOXOXOXOXXXXXX |
| WV-7109 | L001 mU * S mC * S mA * S mA * S mG * S mG * S mA mA * S mG mA * S mU mG * S mG mC * S mA * S mU * S mU * S mU * S mC * S mU | 792 | UCAAGGAAGAUGGCAUUUCU | OSSSSSSOSOSOSOSSSSSS |
| WV-7110 | L001 mU * mC * mA * mA * mG * mG * mA mA * mG mA * mU mG * mG mC * mA * mU * mU * mU * mC * mU | 793 | UCAAGGAAGAUGGCAUUUCU | OXXXXXXOXOXOXOXXXXXX |
| WV- | L001fC * fC * fU * fU * fC * fC * mCfU * mGfA * mAfU * mGfU * fU * fC | 794 | CCUUCCCUGAAGGUU | OXXXXXXOXOXO |

TABLE A1-continued

| | | | | |
|---|---|---|---|---|
| 7111 | * fC * fU * fC * fC | | CCUCC | XOXXXXXX |
| WV-7112 | L001 mC * mC * mU * mU * mC * mC * mC mU * mG mA * mA mG * mG mU * mU * mC * mC * mU * mC * mC | 795 | CCUUCCCUGAAGGUU CCUCC | OXXXXXXOXOXO XOXXXXXX |
| WV-7333 | fU * fC * fAfAfGfG mAfA * mG mA * fU * mG mGfC * fA * fU * fU * fU * fC * fU | 796 | UCAAGGAAGAUGGCA UUUCU | XXOOOOOXOXXO OXXXXXX |
| WV-7334 | fU * fC * fAfA * fG * fG * mAfA * mG mA * fU * mG mGfC * fA * fU * fU * fU * fC * fU | 797 | UCAAGGAAGAUGGCA UUUCU | XXOXXXOXOXXO OXXXXXX |
| WV-7335 | fU * fC * fA * fAfG * fG * mAfA * mG mA * fU * mG mGfC * fA * fU * fU * fU * fC * fU | 798 | UCAAGGAAGAUGGCA UUUCU | XXXOXXOXOXXO OXXXXXX |
| WV-7336 | fU * fC * fA * fA * fGfG * mAfA * mG mA * fU * mG mGfC * fA * fU * fU * fU * fC * fU | 799 | UCAAGGAAGAUGGCA UUUCU | XXXXOXOXOXXO OXXXXXX |
| WV-7337 | fU * fC * fA * fA * fG * fG mAfA * mG mA * fU * mG mGfC * fA * fU * fU * fU * fC * fU | 800 | UCAAGGAAGAUGGCA UUUCU | XXXXXOOXOXXO OXXXXXX |
| WV-7338 | Mod020L001fU * fC * fAfAfGfG mAfA * mG mA * fU * mG mGfC * fA * fU * fU * fU * fC * fU | 801 | UCAAGGAAGAUGGCA UUUCU | OXXOOOOOXOXX OOXXXXXX |
| WV-7339 | Mod020L001fU * fC * fAfA * fG * fG * mAfA * mG mA * fU * mG mGfC * fA * fU * fU * fU * fC * fU | 802 | UCAAGGAAGAUGGCA UUUCU | OXXOXXXOXOXX OOXXXXXX |
| WV-7340 | Mod020L001fU * fC * fA * fAfG * fG * mAfA * mG mA * fU * mG mGfC * fA * fU * fU * fU * fC * fU | 803 | UCAAGGAAGAUGGCA UUUCU | OXXXOXXOXOXX OOXXXXXX |
| WV-7341 | Mod020L001fU * fC * fA * fA * fGfG * mAfA * mG mA * fU * mG mGfC * fA * fU * fU * fU * fC * fU | 804 | UCAAGGAAGAUGGCA UUUCU | OXXXXOXOXOXX OOXXXXXX |
| WV-7342 | Mod020L001fU * fC * fA * fA * fG * fG mAfA * mG mA * fU * mG mGfC * fA * fU * fU * fU * fC * fU | 805 | UCAAGGAAGAUGGCA UUUCU | OXXXXXOOXOXX OOXXXXXX |
| WV-7343 | T * fC * fA * fA * fG * fG * mAfA * mG mA * fU * mG mGfC * fA * fU * fU * fU * fC * fU | 806 | TCAAGGAAGAUGGCA UUUCU | XXXXXXOXOXXO OXXXXXX |
| WV-7344 | fU * C * fA * fA * fG * fG * mAfA * mG mA * fU * mG mGfC * fA * fU * fU * fU * fC * fU | 807 | UCAAGGAAGAUGGCA UUUCU | XXXXXXOXOXXO OXXXXXX |
| WV-7345 | fU * fC * A * fA * fG * fG * mAfA * mG mA * fU * mG mGfC * fA * fU * fU * fU * fC * fU | 808 | UCAAGGAAGAUGGCA UUUCU | XXXXXXOXOXXO OXXXXXX |
| WV-7346 | fU * fC * fA * A * fG * fG * mAfA * mG mA * fU * mG mGfC * fA * fU * fU * fU * fC * fU | 809 | UCAAGGAAGAUGGCA UUUCU | XXXXXXOXOXXO OXXXXXX |
| WV-7347 | fU * fC * fA * fA * G * fG * mAfA * mG mA * fU * mG mGfC * fA * fU * fU * fU * fC * fU | 810 | UCAAGGAAGAUGGCA UUUCU | XXXXXXOXOXXO OXXXXXX |
| WV-7348 | fU * fC * fA * fA * fG * G * mAfA * mG mA * fU * mG mGfC * fA * fU * fU * fU * fC * fU | 811 | UCAAGGAAGAUGGCA UUUCU | XXXXXXOXOXXO OXXXXXX |

TABLE A1-continued

| | | | | |
|---|---|---|---|---|
| WV-7349 | fU * fC * fA * fA * fG * fG * mAA * mG mA * fU * mG mGfC * fA * fU * fU * fU * fC * fU | 812 | UCAAGGAAGAUGGCAUUUCU | XXXXXXOXOXXOOXXXXXX |
| WV-7350 | fU * fC * fA * fA * fG * fG * mAfA * mG mA * T * mG mGfC * fA * fU * fU * fU * fC * fU | 813 | UCAAGGAAGATGGCAUUUCU | XXXXXXOXOXXOOXXXXXX |
| WV-7351 | fU * fC * fA * fA * fG * fG * mAfA * mG mA * fU * mG mGC * fA * fU * fU * fU * fC * fU | 814 | UCAAGGAAGAUGGCAUUUCU | XXXXXXOXOXXOOXXXXXX |
| WV-7352 | fU * fC * fA * fA * fG * fG * mAfA * mG mA * fU * mG mGfC * A * fU * fU * fU * fC * fU | 815 | UCAAGGAAGAUGGCAUUUCU | XXXXXXOXOXXOOXXXXXX |
| WV-7353 | fU * fC * fA * fA * fG * fG * mAfA * mG mA * fU * mG mGfC * fA * T * fU * fU * fC * fU | 816 | UCAAGGAAGAUGGCAUUUCU | XXXXXXOXOXXOOXXXXXX |
| WV-7354 | fU * fC * fA * fA * fG * fG * mAfA * mG mA * fU * mG mGfC * fA * fG * T * fU * fC * fU | 817 | UCAAGGAAGAUGGCAUTUCU | XXXXXXOXOXXOOXXXXXX |
| WV-7355 | fU * fC * fA * fA * fG * fG * mAfA * mG mA * fU * mG mGfC * fA * fU * fU * T * fC * fU | 818 | UCAAGGAAGAUGGCAUUTCU | XXXXXXOXOXXOOXXXXXX |
| WV-7356 | fU * fC * fA * fA * fG * fG * mAfA * mG mA * fU * mG mGfC * fA * fU * fU * fU * C * fU | 819 | UCAAGGAAGAUGGCAUUUCU | XXXXXXOXOXXOOXXXXXX |
| WV-7357 | fU * fC * fA * fA * fG * mAfA * mG mA * fU * mG mGfC * fA * fU * fU * fU * fC * T | 820 | UCAAGGAAGAUGGCAUUUCT | XXXXXXOXOXXOOXXXXXX |
| WV-7358 | fU * fC * A * fA * fG * G * mAfA mG mA * fU * mG mGfC * fA * fU * fU * fU * fC * fU | 821 | UCAAGGAAGAUGGCAUUUCU | XXXXXXOXOXXOOXXXXXX |
| WV-7359 | fU * C * fA * fA * G * fG * mAfA * mG mA * fU * mG mGfC * fA * fU * fU * fU * fC * fU | 822 | UCAAGGAAGAUGGCAUUUCU | XXXXXXOXOXXOOXXXXXX |
| WV-7360 | T * fC * fA * A * fG * fG * mAfA * mG mA * fU * mG mGfC * fA * fU * fU * fU * fC * fU | 823 | TCAAGGAAGAUGGCAUUUCU | XXXXXXOXOXXOOXXXXXX |
| WV-7361 | fU * fC * fA * fA * fG * fG * mAfA * mG mA * fU * mG mGfC * fA * T * fU * fU * T * fU | 824 | UCAAGGAAGAUGGCAUUUTU | XXXXXXOXOXXOOXXXXXX |
| WV-7362 | fU * fC * fA * fA * fG * fG * mAfA * mG mA * fU * mG mGfC * A * fU * fU * T * fC * fU | 825 | UCAAGGAAGAUGGCAUUTCU | XXXXXXOXOXXOOXXXXXX |
| WV-7363 | fU * fC * fA * fA * fG * fG * mAfA * mG mA * fU * mG mGC * fA * fU * T * fU * fC * T | 826 | UCAAGGAAGAUGGCAUTUCT | XXXXXXOXOXXOOXXXXXX |
| WV-7364 | fU * fC * A * fA * fG * G * mAfA * mG mA * fU * mG mGfC * fA * T * fU * fU * T * fU | 827 | UCAAGGAAGAUGGCATUUTU | XXXXXXOXOXXOOXXXXXX |
| WV-7365 | fU * fC * A * fA * fG * G * mAfA * mG mA * fU * mG mGfC * A * fU * fU * T * fC * fU | 828 | UCAAGGAAGAUGGCAUUTCU | XXXXXXOXOXXOOXXXXXX |
| WV-7366 | fU * fC * A * fA * fG * G * mAfA * mG mA * fU * mG mGC * fA * fU * T * fU * fC * T | 829 | UCAAGGAAGAUGGCAUTUCT | XXXXXXOXOXXOOXXXXXX |

TABLE A1-continued

| | | | | |
|---|---|---|---|---|
| WV-7367 | fU * C * fA * fA * G * fG * mAfA * mG mA * fU * mG mGfC * fA * T * fU * fU * T * fU | 830 | UCAAGGAAGAUGGCATUUTU | XXXXXXOXOXXOOXXXXXX |
| WV-7368 | fU * C * fA * fA * G * fG * mAfA * mG mA * fU * mG mGfC * A * fU * fU * T * fC * fU | 831 | UCAAGGAAGAUGGCAUUTCU | XXXXXXOXOXXOOXXXXXX |
| WV-7369 | fU * C * fA * fA * G * fG * mAfA * mG mA * fU * mG mGC * fA * fU * T * fU * fC * T | 832 | UCAAGGAAGAUGGCAUTUCT | XXXXXXOXOXXOOXXXXXX |
| WV-7370 | T * fC * fA * A * fG * fG * mAfA * mG mA * fU * mG mGfC * fA * T * fU * fU * T * fU | 833 | TCAAGGAAGAUGGCATUUTU | XXXXXXOXOXXOOXXXXXX |
| WV-7371 | T * fC * fA * A * fG * fG * mAfA * mG mA * fU * mG mGfC * A * fU * fU * T * fC * fU | 834 | TCAAGGAAGAUGGCAUUTCU | XXXXXXOXOXXOOXXXXXX |
| WV-7372 | T * fC * fA * A * fG * fG * mAfA * mG mA * fU * mG mGC * fA * fU * T * fU * fC * T | 835 | TCAAGGAAGAUGGCAUTUCT | XXXXXXOXOXXOOXXXXXX |
| WV-7373 | Teo * fC * fA * fA * fG * fG * mAfA * mG mA * fU * mG mGfC * fA * fU * fU * fU * fC * fU | 836 | TCAAGGAAGAUGGCAUUUCU | XXXXXXOXOXXOOXXXXXX |
| WV-7374 | fU * m5Ceo * fA * fA * fG * fG * mAfA * mG mA * fU * mG mGfC * fA * fU * fU * fG * fC * fU | 837 | UCAAGGAAGAUGGCAUUUCU | XXXXXXOXOXXOOXXXXXX |
| WV-7375 | fU * fC * Aeo * fA * fG * fG * mAfA * mG mA * fU * mG mGfC * fA * fU * fU * fU * fC * fU | 838 | UCAAGGAAGAUGGCAUUUCU | XXXXXXOXOXXOOXXXXXX |
| WV-7376 | fU * fC * fA * Aeo * fG * fG * mAfA * mG mA * fU * mG mGfC * fA * fU * fU * fU * fC * fU | 839 | UCAAGGAAGAUGGCAUUUCU | XXXXXXOXOXXOOXXXXXX |
| WV-7377 | fU * fC * fA * fA * Geo * fG * mAfA * mG mA * fU * mG mGfC * fA * fU * fU * fU * fC * fU | 840 | UCAAGGAAGAUGGCAUUUCU | XXXXXXOXOXXOOXXXXXX |
| WV-7378 | fU * fC * fA * fA * fG * Geo * mAfA * mG mA * fU * mG mGfC * fA * fU * fU * fU * fC * fU | 841 | UCAAGGAAGAUGGCAUUUCU | XXXXXXOXOXXOOXXXXXX |
| WV-7379 | fU * fC * fA * fA * fG * fG * mAAeo * mG mA * fU * mG mGfC * fA * fU * fU * fU * fC * fU | 842 | UCAAGGAAGAUGGCAUUUCU | XXXXXXOXOXXOOXXXXXX |
| WV-7380 | fU * fC * fA * fA * fG * fG * mAfA * mG mA * Teo * mG mGfC * fA * fU * fU * fU * fC * fU | 843 | UCAAGGAAGATGGCAUUUCU | XXXXXXOXOXXOOXXXXXX |
| WV-7381 | fU * fC * fA * fA * fG * fG * mAfA * mG mA * fU * mG mG m5Ceo * fA * fU * fU * fU * fC * fU | 844 | UCAAGGAAGAUGGCAUUUCU | XXXXXXOXOXXOOXXXXXX |
| WV-7382 | fU * fC * fA * fA * fG * fG * mAfA * mG mA * fU * mG mGfC * Aeo * fU * fU * fU * fC * fU | 845 | UCAAGGAAGAUGGCAUUUCU | XXXXXXOXOXXOOXXXXXX |
| WV-7383 | fU * fC * fA * fA * fG * fG * mAfA * mG mA * fU * mG mGfC * fA * Teo * fU * fU * fC * fU | 846 | UCAAGGAAGAUGGCAUUUCU | XXXXXXOXOXXOOXXXXXX |
| WV- | fU * fC * fA * fA * fG * fG * mAfA * mG mA * fU * mG mGfC * fA * fU * | 847 | UCAAGGAAGAUGGCA | XXXXXXOXOXXO |

TABLE A1-continued

| | | | | |
|---|---|---|---|---|
| 7384 | Teo * fU * fC * fU | | UTUCU | OXXXXXX |
| WV-7385 | fU * fC * fA * fA * fG * fG * mAfA * mG mA * fU * mG mGfC * fA * fU * fU * Teo * fC * fU | 848 | UCAAGGAAGAUGGCA UUTCU | XXXXXXOXOXXO OXXXXXX |
| WV-7386 | fU * fC * fA * fA * fG * fG * mAfA * mG mA * fU * mG mGfC * fA * fU * fU * fU * m5Ceo * fU | 849 | UCAAGGAAGAUGGCA UUUCU | XXXXXXOXOXXO OXXXXXX |
| WV-7387 | fU * fC * fA * fA * fG * fG * mAfA * mG mA * fU * mG mGfC * fA * fU * fU * fU * fC * Teo | 850 | UCAAGGAAGAUGGCA UUUCT | XXXXXXOXOXXO OXXXXXX |
| WV-7388 | fU * fC * Aeo * fA * fG * Geo * mAfA * mG mA * fU * mG mGfC * fA * fU * fU * fU * fC * fU | 851 | UCAAGGAAGAUGGCA UUUCU | XXXXXXOXOXXO OXXXXXX |
| WV-7389 | fU * m5Ceo * fA * fA * Geo * fG * mAfA * mG mA * fU * mG mGfC * fA * fU * fU * fU * fC * fU | 852 | UCAAGGAAGAUGGCA UUUCU | XXXXXXOXOXXO OXXXXXX |
| WV-7390 | Teo * fC * fA * Aeo * fG * fG * mAfA * mG mA * fU * mG mGfC * fA * fU * fU * fU * fC * fU | 853 | TCAAGGAAGAUGGCA UUUCU | XXXXXXOXOXXO OXXXXXX |
| WV-7391 | fU * fC * fA * fA * fG * fG * mAfA * mG mA * fU * mG mGfC * fA * Teo * fU * fU * Teo * fU | 854 | UCAAGGAAGAUGGCA TUUTU | XXXXXXOXOXXO OXXXXXX |
| WV-7392 | fU * fC * fA * fA * fG * fG * mAfA * mG mA * fU * mG mGfC * Aeo * fU * fU * Teo * fC * fU | 855 | UCAAGGAAGAUGGCA UUTCU | XXXXXXOXOXXO OXXXXXX |
| WV-7393 | fU * fC * fA * fA * fG * mAfA * mG mA * fU * mG mG m5Ceo * fA * fU * Teo * fU * fC * Teo | 856 | UCAAGGAAGAUGGCA UTUCT | XXXXXXOXOXXO OXXXXXX |
| WV-7394 | fU * fC * Aeo * fA * fG * Geo * mAfA * mG mA * fU * mG mGfC * fA * Teo * fU * fU * Teo * fU | 857 | UCAAGGAAGAUGGCA TUUTU | XXXXXXOXOXXO OXXXXXX |
| WV-7395 | fU * fC * Aeo * fA * fG * Geo * mAfA * mG mA * fU * mG mGfC * Aeo * fU * fU * Teo * fC * fU | 858 | UCAAGGAAGAUGGCA UUTCU | XXXXXXOXOXXO OXXXXXX |
| WV-7396 | fU * fC * Aeo * fA * fG * Geo * mAfA * mG mA * fU * mG mG m5Ceo * fA * fU * Teo * fU * fC * Teo | 859 | UCAAGGAAGAUGGCA UTUCT | XXXXXXOXOXXO OXXXXXX |
| WV-7397 | fU * m5Ceo * fA * fA * Geo * fG * mAfA * mG mA * fU * mG mGfC * fA * Teo * fU * fU * Teo * fU | 860 | UCAAGGAAGAUGGCA TUUTU | XXXXXXOXOXXO OXXXXXX |
| WV-7398 | fU * m5Ceo * fA * fA * Geo * fG * mAfA * mG mA * fU * mG mGfC * Aeo * fU * fU * Teo * fC * fU | 861 | UCAAGGAAGAUGGCA UUTCU | XXXXXXOXOXXO OXXXXXX |
| WV-7399 | fU * m5Ceo * fA * fA * Geo * fG * mAfA * mG mA * fU * mG mG m5Ceo * fA * fU * Teo * fU * fC * Teo | 862 | UCAAGGAAGAUGGCA UTUCT | XXXXXXOXOXXO OXXXXXX |
| WV-7400 | Teo * fC * fA * Aeo * fG * fG * mAfA * mG mA * fU * mG mGfC * fA * Teo * fU * fU * Teo * fU | 863 | TCAAGGAAGAUGGCA TUUTU | XXXXXXOXOXXO OXXXXXX |
| WV-7401 | Teo * fC * fA * Aeo * fG * fG * mAfA * mG mA * fU * mG mGfC * Aeo * fU * fU * Teo * fC * fU | 864 | TCAAGGAAGAUGGCA UUTCU | XXXXXXOXOXXO OXXXXXX |

TABLE A1-continued

| | | | | |
|---|---|---|---|---|
| WV-7402 | Teo * fC * fA * Aeo * fG * fG * mAfA * mG mA * fU * mG mG m5Ceo * fA * fU * Teo * fU * fC * Teo | 865 | TCAAGGAAGAUGGCA UTUCT | XXXXXXOXOXXO OXXXXXX |
| WV-7410 | BrfU * SfC * SfA * SfA * SfG * SfU * S mAfA * S mGfA * S mUfG * S mGfC * SfA * SfU * SfU * SfU * SfC * SfU | 866 | UCAAGGAAGAUGGCA UUUCU | SSSSSSOSOSOSOS SSSSS |
| WV-7411 | Acet5fU * SfC * SfA * SfA * SfG * SfG * S mAfA * S mGfA * S mUfG * S mGfC * SfA * SfU * SfU * SfG * SfU * SfU | 867 | UCAAGGAAGAUGGCA UUUCU | SSSSSSOSOSOSOS SSSSS |
| WV-7412 | BrfU * fC * fA * fA * fG * fG * mAfA * mGfA * mUfG * mGfC * fA * fU * fU * fU * fC * fU | 868 | UCAAGGAAGAUGGCA UUUCU | XXXXXXOXOXOX OXXXXXX |
| WV-7413 | Acet5fU * fC * fA * fA * fG * fG * mAfA * mGfA * mUfG * mGfC * fA * fU * fU * fU * fC * fU | 869 | UCAAGGAAGAUGGCA UUUCU | XXXXXXOXOXOX OXXXXXX |
| WV-7414 | BrmU * mC * mA * mA * mG * mG * mA * mA * mG * mA * mU * mG * mG * mC * mA * mU * mU * mU * mC * mU | 870 | UCAAGGAAGAUGGCA UUUCU | XXXXX XXXXX XXXXX XXXX |
| WV-7415 | Acet5 mU * mC * mA * mA * mG * mG * mA * mA * mG * mA * mU * mG * mG * mC * mA * mU * mU * mU * mC * mU | 871 | UCAAGGAAGAUGGCA UUUCU | XXXXX XXXXX XXXXX XXXX |
| WV-7436 | fC * fU * fU * fU * fA * fA * mC * mA * mU * mU * mU * mC * mA * mU * fU * fC * fA * fA * fC * fU | 872 | CUUUAACAUUUCAUU CAACU | XXXXX XXXXX XXXXX XXXX |
| WV-7437 | fU * fU * fA * fA * fC * fA * mU * mU * mU * mC * mA * mU * mU * mC * fA * fA * fC * fU * fG * fU | 873 | UUAACAUUUCAUUCA ACUGU | XXXXX XXXXX XXXXX XXXX |
| WV-7438 | fA * fA * fC * fA * fU * fU * mU * mC * mA * mU * mU * mC * mA * mA * fC * fU * fG * fU * fU * fG | 874 | AACAUUUCAUUCAAC UGUUG | XXXXX XXXXX XXXXX XXXX |
| WV-7439 | fC * fA * fU * fU * fU * fC * mA * mU * mU * mC * mA * mA * mC * mU * fG * fU * fU * fG * fU * fC | 875 | CAUUUCAUUCAACUG UUGUC | XXXXX XXXXX XXXXX XXXX |
| WV-7440 | fU * fU * fU * fC * fA * fU * mU * mC * mA * mA * mC * mU * mG * mU * fU * fG * fU * fC * fU * fC | 876 | UUUCAUUCAACUGUU GUCUC | XXXXX XXXXX XXXXX XXXX |
| WV-7441 | fU * fC * fA * fU * fU * fC * mA * mA * mC * mU * mG * mU * mU * mG * fU * fC * fU * fC * fC * fU | 877 | UCAUUCAACUGUUGU CUCCU | XXXXX XXXXX XXXXX XXXX |
| WV-7442 | fA * fU * fU * fC * fA * fA * mC * mU * mG * mU * mU * mG * mU * mC * fU * fC * fC * fU * fG * fU | 878 | AUUCAACUGUUGUCU CCUGU | XXXXX XXXXX XXXXX XXXX |
| WV-7443 | fU * fC * fA * fA * fC * fU * mG * mU * mU * mG * mU * mC * mU * mC * fC * fU * fG * fU * fU * fC | 879 | UCAACUGUUGUCUCC UGUUC | XXXXX XXXXX XXXXX XXXX |
| WV-7444 | fA * fA * fC * fU * fG * fU * mU * mG * mU * mC * mU * mC * mC * mU * fG * fU * fU * fC * fU * fG | 880 | AACUGUUGUCUCCUG UUCUG | XXXXX XXXXX XXXXX XXXX |
| WV-7445 | fC * fU * fG * fU * fU * fG * mU * mC * mU * mC * mC * mU * mG * mU * fU * fC * fU * fG * fC * fA | 881 | CUGUUGUCUCCUGUU CUGCA | XXXXX XXXXX XXXXX XXXX |
| WV-7446 | fG * fU * fU * fG * fU * fC * mU * mC * mC * mU * mG * mU * mU * mC * fU * fG * fC * fA * fG * fC | 882 | GUUGUCUCCUGUUCU GCAGC | XXXXX XXXXX XXXXX XXXX |

TABLE A1-continued

| | | | | |
|---|---|---|---|---|
| WV-7447 | fU * fG * fU * fC * fU * fC * mC * mU * mG * mU * mU * mC * mU * mG * fC * fA * fG * fC * fU * fG | 883 | UGUCUCCUGUUCUGCAGCUG | XXXXX XXXXX XXXXX XXXX |
| WV-7448 | fU * fC * fU * fC * fC * fU * mG * mU * mU * mC * mU * mG * mC * mA * fG * fC * fU * fG * fU * fU | 884 | UCUCCUGUUCUGCAGCUGUU | XXXXX XXXXX XXXXX XXXX |
| WV-7449 | fU * fC * fC * fU * fG * fU * mU * mC * mU * mG * mC * mA * mG * mC * fU * fG * fU * fU * fU * fU | 885 | UCCUGUUCUGCAGCUGUUCU | XXXXX XXXXX XXXXX XXXX |
| WV-7450 | fC * fU * fG * fU * fU * fC * mU * mG * mC * mA * mG * mC * mU * mG * fU * fU * fC * fU * fU * fG | 886 | CUGUUCUGCAGCUGUUCUUG | XXXXX XXXXX XXXXX XXXX |
| WV-7451 | fG * fU * fU * fC * fU * fG * mC * mA * mG * mC * mU * mG * mU * mU * fC * fU * fU * fG * fA * fA | 887 | GUUCUGCAGCUGUUCUUGAA | XXXXX XXXXX XXXXX XXXX |
| WV-7452 | fU * fC * fU * fG * fC * fA * mG * mC * mU * mG * mU * mU * mC * mU * fU * fG * fA * fA * fC * fC | 888 | UCUGCAGCUGUUCUUGAACC | XXXXX XXXXX XXXXX XXXX |
| WV-7453 | fU * fG * fC * fA * fG * fC * mU * mG * mU * mU * mC * mU * mU * mG * fA * fA * fC * fC * fU * fC | 889 | UGCAGCUGUUCUUAACCUC | XXXXX XXXXX XXXXX XXXX |
| WV-7454 | fU * fG * fU * fU * fC * fU * mU * mG * mA * mA * mC * mC * mU * mC * fA * fU * fC * fC * fC * fA | 890 | UGUUCUUGAACCUCAUCCCA | XXXXX XXXXX XXXXX XXXX |
| WV-7455 | fC * fA * fG * fC * fU * fG * mU * mU * mC * mU * mU * mG * mA * mA * fC * fC * fU * fC * fA * fU | 891 | CAGCUGUUCUUGAACCUCAU | XXXXX XXXXX XXXXX XXXX |
| WV-7456 | fG * fC * fU * fG * fU * fU * mC * mU * mU * mG * mA * mA * mC * mC * fU * fC * fA * fU * fC * fC | 892 | GCUGUUCUUGAACCUCAUCC | XXXXX XXXXX XXXXX XXXX |
| WV-7457 | L001fU * fC * fAfAfGfG mAfA * mG mA * fU * mG mGfC * fA * fU * fU * fU * fC * fU | 893 | UCAAGGAAGAUGGCAUUUCU | OXXOOOOOXOXX OOXXXXXX |
| WV-7458 π | L001fU * fC * fAfA * fG * fG * mAfA * mG mA * fU * mG mGfC * fA * fU * fU * fU * fC * fU | 894 | UCAAGGAAGAUGGCAUUUCU | OXXOXXXOXOXX OOXXXXXX |
| WV-7459 | L001fU * fC * fA * fAfG * fG * mAfA * mG mA * fU * mG mGfC * fA * fU * fU * fU * fC * fU | 895 | UCAAGGAAGAUGGCAUUUCU | OXXXOXXOXOXX OOXXXXXX |
| WV-7460 | L001fU * fC * fA * fA * fGfG * mAfA * mG mA * fU * mG mGfC * fA * fU * fU * fU * fC * fU | 896 | UCAAGGAAGAUGGCAUUUCU | OXXXXOXOXOXX OOXXXXXX |
| WV-7461 | L001fU * fC * fA * fA * fG * fG mAfA * mG mA * fU * mG mGfC * fA * fU * fU * fU * fC * fU | 897 | UCAAGGAAGAUGGCAUUUCU | OXXXXXOOXOXX OOXXXXXX |
| WV-7506 | mU * mC * mA * mA * mG * mG * mA mA * mG mA * mU mG * mG mC * mA * mU * mU * mU * mC * mU | 898 | UCAAGGAAGAUGGCAUUUCU | XXXXXXOXOXOX OXXXXXX |
| WV-7507 | fC * fC * fU * fU * fC * fC * mCfU * mGfA * mAfG * mGfU * fU * fC * fC * fU * fC * fC | 899 | CCUUCCCUGAAGGUUCCUCC | XXXXXXOXOXOX OXXXXXX |
| WV- | mC * mC * mU * mU * mC * mC * mC mU * mG mA * mA mG * mG | 900 | CCUUCCCUGAAGGUU | XXXXXXOXOXOX |

TABLE A1-continued

| | | | | |
|---|---|---|---|---|
| 7508 | mU * mU * mC * mC * mU * mC * mC | | CCUCC | OXXXXXX |
| WV-7596 | fU * RfC * RfA * RfA * RfG * RfG * R mAfA * R mGfA * R mUfG * R mGfC * RfA * RfU * RfU * RfU * RfC * RfU | 901 | UCAAGGAAGAUGGCA UUUCU | RRRRRROROROR ORRRRRR |
| WV-7677 | fG * fC * fC * fA * fU * fU * mU * mU * mG * mU * mU * mG * mC * mU * fC * fU * fU * fU * fC * fA | 902 | GCCAUUUUGUUGCUC UUUCA | XXXXX XXXXX XXXXX XXXX |
| WV-7678 | fA * fG * fC * fC * fA * fU * mU * mU * mU * mG * mU * mU * mG * mC * fU * fC * fU * fU * fU * fC | 903 | AGCCAUUUUGUUGCU CUUUC | XXXXX XXXXX XXXXX XXXX |
| WV-7679 | fA * fA * fG * fC * fC * fA * mU * mU * mU * mU * mG * mU * mU * mG * fC * fU * fC * fU * fU * fU | 904 | AAGCCAUUUUGUUGC UCUUU | XXXXX XXXXX XXXXX XXXX |
| WV-7680 | fU * fU * fG * fA * fA * fG * mC * mC * mA * mU * mU * mU * mU * mG * fU * fU * fG * fC * fU * fC | 905 | UUGAAGCCAUUUUGU UGCUC | XXXXX XXXXX XXXXX XXXX |
| WV-7681 | fU * fA * fG * fU * fU * fG * mA * mA * mG * mC * mC * mA * mU * mU * fU * fU * fG * fU * fU * fG | 906 | UAGUUGAAGCCAUUU UGUUG | XXXXX XXXXX XXXXX XXXX |
| WV-7682 | fA * fG * fA * fU * fA * fG * mU * mU * mG * mA * mA * mG * mC * mC * fA * fU * fU * fU * fU * fG | 907 | AGAUAGUUGAAGCCA UUUUG | XXXXX XXXXX XXXXX XXXX |
| WV-7683 | fC * fU * fC * fA * fG * fA * mU * mA * mG * mU * mU * mG * mA * mA * fG * fC * fC * fA * fU * fU | 908 | CUCAGAUAGUUGAAG CCAUU | XXXXX XXXXX XXXXX XXXX |
| WV-7684 | fU * fC * fA * fC * fU * fC * mA * mG * mA * mU * mA * mG * mU * mU * fG * fA * fA * fG * fC * fC | 909 | UCACUCAGAUAGUUG AAGCC | XXXXX XXXXX XXXXX XXXX |
| WV-7685 | fG * fU * fG * fU * fC * fA * mC * mU * mC * mA * mG * mA * mU * mA * fG * fU * fU * fG * fA * fA | 910 | GUGUCACUCAGAUAG UUGAA | XXXXX XXXXX XXXXX XXXX |
| WV-7686 | fA * fC * fA * fG * fU * fG * mU * mC * mA * mC * mU * mC * mA * mG * fA * fU * fA * fG * fU * fU | 911 | ACAGUGUCACUCAGA UAGUU | XXXXX XXXXX XXXXX XXXX |
| WV-7687 | fC * fA * fC * fA * fG * fU * mG * mU * mC * mA * mC * mU * mC * mA * fG * fA * fU * fA * fG * fU | 912 | CACAGUGUCACUCAG AUAGU | XXXXX XXXXX XXXXX XXXX |
| WV-7688 | fC * fU * fU * fC * fA * fC * mA * mG * mU * mG * mU * mC * mA * mC * fU * fC * fA * fG * fA * fU | 913 | CUUCACAGUGUCACU CAGAU | XXXXX XXXXX XXXXX XXXX |
| WV-7689 | fC * fC * fU * fU * fC * fA * mC * mA * mG * mU * mG * mU * mC * mA * fC * fU * fC * fA * fG * fA | 914 | CCUUCACAGUGUCAC UCAGA | XXXXX XXXXX XXXXX XXXX |
| WV-7690 | fC * fU * fC * fC * fU * fU * mC * mA * mC * mA * mG * mU * mG * mU * fC * fA * fC * fU * fC * fA | 915 | CUCCUUCACAGUGUC ACUCA | XXXXX XXXXX XXXXX XXXX |
| WV-7691 | fA * fU * fC * fU * fC * fC * mU * mU * mC * mA * mC * mA * mG * mU * fG * fU * fC * fA * fC * fU | 916 | AUCUCCUUCACAGUG UCACU | XXXXX XXXXX XXXXX XXXX |
| WV-7692 | fC * fC * fA * fU * fC * fU * mC * mC * mU * mU * mC * mA * mC * mA * fG * fU * fG * fU * fC * fA | 917 | CCAUCUCCUUCACAG UGUCA | XXXXX XXXXX XXXXX XXXX |

TABLE A1-continued

| | | | | |
|---|---|---|---|---|
| WV-7693 | fG * fG * fC * fC * fA * fU * mC * mU * mC * mC * mU * mU * mC * mA * fC * fA * fG * fU * fG * fU | 918 | GGCCAUCUCCUUCACAGUGU | XXXXX XXXXX XXXXX XXXX |
| WV-7694 | fU * fU * fG * fG * fC * fC * mA * mU * mC * mU * mC * mC * mU * mU * fC * fA * fC * fA * fG * fU | 919 | UUGGCCAUCUCCUUCACAGU | XXXXX XXXXX XXXXX XXXX |
| WV-7695 | fU * fC * fU * fU * fG * fG * mC * mC * mA * mU * mC * mU * mC * mC * fU * fU * fC * fA * fC * fA | 920 | UCUUGGCCAUCUCCUUCACA | XXXXX XXXXX XXXXX XXXX |
| WV-7696 | fU * fU * fU * fC * fU * fU * mG * mG * mC * mC * mA * mU * mC * mU * fC * fC * fU * fU * fC * fA | 921 | UUUCUUGGCCAUCUCCUUCA | XXXXX XXXXX XXXXX XXXX |
| WV-7697 | fG * fC * fU * fU * fU * fC * mU * mU * mG * mG * mC * mC * mA * mU * fC * fU * fC * fC * fU * fU | 922 | GCUUUCUUGGCCAUCUCCUU | XXXXX XXXXX XXXXX XXXX |
| WV-7698 | fG * fU * fG * fC * fU * fU * mU * mC * mU * mU * mG * mG * mC * mC * fA * fU * fC * fU * fC * fC | 923 | GUGCUUUCUUGGCCAUCUCC | XXXXX XXXXX XXXXX XXXX |
| WV-7699 | fA * fG * fG * fU * fG * fC * mU * mU * mU * mC * mU * mU * mG * mG * fC * fC * fA * fU * fC * fU | 924 | AGGUGCUUUCUUGGCCAUCU | XXXXX XXXXX XXXXX XXXX |
| WV-7700 | fG * fA * fA * fG * fG * fU * mG * mC * mU * mU * mU * mC * mU * mU * fG * fG * fC * fC * fA * fU | 925 | GAAGGUGCUUUCUUGGCCAU | XXXXX XXXXX XXXXX XXXX |
| WV-7701 | fC * fU * fG * fA * fA * fG * mG * mU * mG * mC * mU * mU * mU * mC * fU * fU * fG * fG * fC * fC | 926 | CUGAAGGUGCUUUCUUGGCC | XXXXX XXXXX XXXXX XXXX |
| WV-7702 | fU * fU * fC * fU * fG * fA * mA * mG * mG * mU * mG * mC * mU * mU * fU * fC * fU * fU * fG * fG | 927 | UUCUGAAGGUGCUUUCUUGG | XXXXX XXXXX XXXXX XXXX |
| WV-7703 | fU * fA * fU * fU * fU * fC * mU * mG * mA * mA * mG * mG * mU * mG * fC * fU * fU * fU * fC * fU | 928 | UAUUUCUGAAGGUGCUUUCU | XXXXX XXXXX XXXXX XXXX |
| WV-7704 | fA * fU * fA * fU * fU * fU * mC * mU * mG * mA * mA * mG * mG * mU * fG * fC * fU * fU * fU * fC | 929 | AUAUUUCUGAAGGUGCUUUC | XXXXX XXXXX XXXXX XXXX |
| WV-7705 | fG * fG * fC * fA * fU * fA * mU * mU * mU * mC * mU * mG * mA * mA * fG * fG * fU * fG * fC * fU | 930 | GGCAUAUUUCUGAAGGUGCU | XXXXX XXXXX XXXXX XXXX |
| WV-7706 | fU * fG * fG * fC * fA * fU * mA * mU * mU * mU * mC * mU * mG * mA * fA * fG * fG * fU * fG * fC | 931 | UGGCAUAUUUCUGAAGGUGC | XXXXX XXXXX XXXXX XXXX |
| WV-7707 | fU * fC * fU * fG * fG * fC * mA * mU * mA * mU * mU * mU * mC * mU * fG * fA * fA * fG * fG * fU | 932 | UCUGGCAUAUUUCUGAAGGU | XXXXX XXXXX XXXXX XXXX |
| WV-7708 | fU * fC * fU * fG * fA * fC * mA * mG * mA * mU * mA * mU * mU * mU * fC * fU * fG * fG * fC * fA | 933 | UCUGACAGAUAUUUCUGGCA | XXXXX XXXXX XXXXX XXXX |
| WV-7709 | fA * fU * fU * fC * fU * fG * mA * mC * mA * mG * mA * mU * mA * mU * fU * fU * fC * fU * fG * fG | 934 | AUUCUGACAGAUAUUUCUGG | XXXXX XXXXX XXXXX XXXX |
| WV-7710 | fC * fA * fA * fA * fU * fU * mC * mU * mG * mA * mC * mA * mG * mA * fU * fA * fU * fU * fU * fC | 935 | CAAAUUCUGACAGAUAUUUC | XXXXX XXXXX XXXXX XXXX |

TABLE A1-continued

| | | | | |
|---|---|---|---|---|
| WV-7711 | fU * fC * fU * fC * fU * fU * mC * mA * mA * mA * mU * mU * mC * mU * fG * fA * fC * fA * fG * fA | 936 | UCUCUUCAAAUUCUG ACAGA | XXXXX XXXXX XXXXX XXXX |
| WV-7712 | fC * fU * fU * fC * fA * fA * mU * mC * mU * mC * mU * mU * mC * mA * fA * fA * fU * fU * fC * fU | 937 | CCUCAAUCUCUUCAA AUUCU | XXXXX XXXXX XXXXX XXXX |
| WV-7713 | fG * fC * fC * fC * fC * fU * mC * mA * mA * mU * mC * mU * mC * mU * fU * fC * fA * fA * fA * fU | 938 | GCCCCUCAAUCUCUU CAAAU | XXXXX XXXXX XXXXX XXXX |
| WV-7714 | fU * fG * fC * fC * fC * fC * mU * mC * mA * mA * mU * mC * mU * mC * fU * fU * fC * fA * fA * fA | 939 | UGCCCCUCAAUCUCU UCAAA | XXXXX XXXXX XXXXX XXXX |
| WV-7715 | fG * fU * fG * fC * fC * fC * mC * mU * mC * mA * mA * mU * mC * mU * fC * fU * fU * fC * fA * fA | 940 | GUGCCCCUCAAUCUC UUCAA | XXXXX XXXXX XXXXX XXXX |
| WV-7716 | fA * fG * fU * fG * fC * fC * mC * mC * mU * mC * mA * mA * mU * mC * fU * fC * fU * fU * fC * fA | 941 | AGUGCCCCUCAAUCU CUUCA | XXXXX XXXXX XXXXX XXXX |
| WV-7717 | fC * fC * fA * fG * fU * fG * mC * mC * mC * mC * mU * mC * mA * mA * fU * fC * fU * fC * fU * fU | 942 | CCAGUGCCCCUCAAU CUCUU | XXXXX XXXXX XXXXX XXXX |
| WV-7718 | fU * fU * fC * fC * fA * fU * mU * mG * mC * mC * mC * mC * mU * mC * fA * fA * fU * fC * fU * fC | 943 | UUCCAGUGCCCCUCA AUCUC | XXXXX XXXXX XXXXX XXXX |
| WV-7719 | fU * fC * fU * fU * fC * fC * mA * mG * mU * mG * mC * mC * mC * mC * fU * fC * fA * fA * fU * fC | 944 | UCUUCCAGUGCCCCU CAAUC | XXXXX XXXXX XXXXX XXXX |
| WV-7720 | fU * fU * fU * fC * fU * fU * mC * mC * mA * mG * mU * mG * mC * mC * fC * fC * fU * fC * fA * fA | 945 | UUUCUUCCAGUGCCC CUCAA | XXXXX XXXXX XXXXX XXXX |
| WV-7721 | fA * fG * fU * fU * fU * fC * mU * mC * mC * mC * mA * mG * mU * mG * fC * fC * fC * fC * fU * fC | 946 | AGUUUCUUCCAGUGC CCCUC | XXXXX XXXXX XXXXX XXXX |
| WV-7722 | fA * fA * fA * fG * fU * fU * mC * mC * mU * mU * mC * mC * mA * mG * fU * fG * fC * fC * fC * fC | 947 | AAAGUUUCUUCCAGU GCCCC | XXXXX XXXXX XXXXX XXXX |
| WV-7723 | fA * fG * fG * fA * fA * fA * mG * mU * mU * mU * mC * mU * mU * mC * fC * fA * fG * fU * fG * fC | 948 | AGGAAAGUUUCUUCC AGUGC | XXXXX XXXXX XXXXX XXXX |
| WV-7724 | fG * fG * fA * fG * fG * fA * mA * mA * mG * mU * mU * mU * mC * mU * fU * fC * fC * fA * fG * fU | 949 | GGAGGAAAGUUUCU UCCAGU | XXXXX XXXXX XXXXX XXXX |
| WV-7725 | fC * fU * fG * fG * fG * fA * mG * mG * mA * mA * mA * mG * mU * mU * fU * fC * fU * fU * fC * fC | 950 | CUGGGAGGAAAGUU UCUUCC | XXXXX XXXXX XXXXX XXXX |
| WV-7726 | fA * fC * fU * fG * fG * fG * mA * mG * mG * mA * mA * mA * mG * mU * fU * fU * fC * fU * fU * fC | 951 | ACUGGGAGGAAAGU UUCUUC | XXXXX XXXXX XXXXX XXXX |
| WV-7727 | fC * fC * fA * fA * fC * fU * mG * mG * mG * mA * mG * mG * mA * mA * fA * fG * fU * fU * fU * fC | 952 | CCAACUGGGAGGAAA GUUUC | XXXXX XXXXX XXXXX XXXX |
| WV- | fC * fC * fA * fC * fC * fA * mA * mC * mU * mG * mG * mG * mA * | 953 | CCACCAACUGGGAGG | XXXXX XXXXX |

TABLE A1-continued

| | | | | |
|---|---|---|---|---|
| 7728 | mG * fG * fA * fA * fA * fG * fU | | AAAGU | XXXXX XXXX |
| WV-7729 | fU * fU * fU * fC * fC * fA * mC * mC * mA * mA * mC * mU * mG * mG * fG * fA * fG * fG * fA * fA | 954 | UUUCCACCAACUGGGAGGAA | XXXXX XXXXX XXXXX XXXX |
| WV-7730 | fC * fU * fU * fU * fC * fC * mA * mC * mC * mA * mA * mC * mU * mG * fG * fG * fA * fG * fG * fA | 955 | CUUUCCACCAACUGGGAGGA | XXXXX XXXXX XXXXX XXXX |
| WV-7731 | fG * fC * fU * fU * fU * fC * mC * mA * mC * mC * mA * mA * mC * mU * fG * fG * fG * fA * fG * fG | 956 | GCUUUCCACCAACUGGGAGG | XXXXX XXXXX XXXXX XXXX |
| WV-7732 | fC * fA * fG * fC * fU * fU * mU * mC * mC * mA * mC * mC * mA * mA * fC * fU * fG * fG * fG * fA | 957 | CAGCUUUCCACCAACUGGGA | XXXXX XXXXX XXXXX XXXX |
| WV-7733 | fG * fG * fC * fA * fG * fC * mU * mU * mU * mC * mC * mA * mC * mC * fA * fA * fC * fU * fG * fG | 958 | GGCAGCUUUCCACCAACUGG | XXXXX XXXXX XXXXX XXXX |
| WV-7734 | fU * fU * fG * fG * fC * fA * mG * mC * mU * mU * mU * mC * mC * mA * fC * fC * fA * fA * fC * fU | 959 | UUGGCAGCUUUCCACCAACU | XXXXX XXXXX XXXXX XXXX |
| WV-7735 | fU * fU * fU * fU * fG * fG * mC * mA * mG * mC * mU * mU * mU * mC * fC * fA * fC * fC * fA * fA | 960 | UUUUGGCAGCUUUCCACCAA | XXXXX XXXXX XXXXX XXXX |
| WV-7736 | fG * fC * fU * fU * fU * fU * mG * mG * mC * mA * mG * mC * mU * mU * fU * fC * fC * fA * fC * fC | 961 | GCUUUUGGCAGCUUUCCACC | XXXXX XXXXX XXXXX XXXX |
| WV-7737 | fU * fA * fG * fC * fU * fU * mU * mU * mG * mG * mC * mA * mG * mC * fU * fU * fU * fC * fC * fA | 962 | UAGCUUUUGGCAGCUUUCCA | XXXXX XXXXX XXXXX XXXX |
| WV-7738 | fU * fC * fU * fA * fG * fC * mU * mU * mU * mU * mG * mG * mC * mA * fG * fC * fU * fU * fU * fC | 963 | UCUAGCUUUUGGCAGCUUUC | XXXXX XXXXX XXXXX XXXX |
| WV-7739 | fC * fU * fU * fC * fU * fA * mG * mC * mU * mU * mU * mU * mG * mG * fC * fA * fG * fC * fU * fU | 964 | CUUCUAGCUUUUGGCAGCUU | XXXXX XXXXX XXXXX XXXX |
| WV-7740 | fU * fU * fC * fU * fU * fC * mU * mA * mG * mC * mU * mU * mU * mU * fG * fG * fC * fA * fG * fC | 965 | UUCUUCUAGCUUUUGGCAGC | XXXXX XXXXX XXXXX XXXX |
| WV-7741 | fU * fG * fU * fU * fC * fU * mU * mC * mU * mA * mG * mC * mU * mU * fU * fU * fG * fG * fC * fA | 966 | UGUUCUUCUAGCUUUUGGCA | XXXXX XXXXX XXXXX XXXX |
| WV-7742 | fU * fA * fU * fG * fU * fU * mC * mU * mU * mC * mU * mA * mG * mC * fU * fU * fU * fU * fG * fG | 967 | UAUGUUCUUCUAGCUUUUGG | XXXXX XXXXX XXXXX XXXX |
| WV-7743 | fC * fA * fU * fA * fU * fG * mU * mU * mC * mU * mU * mC * mU * mA * fG * fC * fU * fU * fU * fU | 968 | CAUAUGUUCUUCUAGCUUUU | XXXXX XXXXX XXXXX XXXX |
| WV-7744 | fU * fU * fC * fA * fU * fA * mU * mG * mU * mU * mC * mU * mU * mC * fU * fA * fG * fC * fU * fU | 969 | UUCAUAUGUUCUUCUAGCUU | XXXXX XXXXX XXXXX XXXX |
| WV-7745 | fA * fU * fU * fC * fA * fU * mA * mU * mG * mU * mU * mC * mU * mU * fC * fU * fA * fG * fC * fU | 970 | AUUCAUAUGUUCUUCUAGCU | XXXXX XXXXX XXXXX XXXX |

TABLE A1-continued

| | | | | |
|---|---|---|---|---|
| WV-7746 | fU * fA * fU * fU * fC * fA * mU * mA * mU * mG * mU * mU * mC * mU * fU * fC * fU * fA * fG * fC | 971 | UAUUCAUAUGUUCUUCUAGC | XXXXX XXXXX XXXXX XXXX |
| WV-7747 | fG * fU * fU * fU * fA * fU * mU * mC * mA * mU * mA * mU * mG * mU * fU * fC * fU * fU * fC * fU | 972 | GUUUAUUCAUAUGUUCUUCU | XXXXX XXXXX XXXXX XXXX |
| WV-7748 | fA * fG * fU * fU * fU * fA * mU * mU * mC * mA * mU * mA * mU * mG * fU * fU * fC * fU * fU * fC | 973 | AGUUUAUUCAUAUGUUCUUC | XXXXX XXXXX XXXXX XXXX |
| WV-7749 | fG * fA * fA * fG * fU * fU * mU * mA * mU * mU * mC * mA * mU * mA * fU * fG * fU * fU * fC * fU | 974 | GAAGUUUAUUCAUAUGUUCU | XXXXX XXXXX XXXXX XXXX |
| WV-7750 | fU * fC * fG * fA * fA * fG * mU * mU * mU * mA * mU * mU * mC * mA * fU * fA * fU * fG * fU * fU | 975 | UCGAAGUUUAUUCAUAUGUU | XXXXX XXXXX XXXXX XXXX |
| WV-7751 | fU * fU * fC * fG * fA * fA * mG * mU * mU * mU * mA * mU * mU * mC * fA * fU * fA * fU * fG * fU | 976 | UUCGAAGUUUAUUCAUAUGU | XXXXX XXXXX XXXXX XXXX |
| WV-7752 | fU * fU * fU * fC * fG * fA * mA * mG * mU * mU * mU * mA * mU * mU * fC * fA * fU * fA * fU * fG | 977 | UUUCGAAGUUUAUUCAUAUG | XXXXX XXXXX XXXXX XXXX |
| WV-7753 | fA * fA * fU * fU * fU * fU * mC * mG * mA * mA * mG * mU * mU * mU * fA * fU * fU * fC * fA * fU | 978 | AAUUUUCGAAGUUUAUUCAU | XXXXX XXXXX XXXXX XXXX |
| WV-7754 | fU * fG * fA * fA * fA * fG * mU * mU * mU * mC * mG * mA * mA * mG * fU * fU * fU * fA * fU * fU | 979 | UGAAAUUUUCGAAGUUUAUU | XXXXX XXXXX XXXXX XXXX |
| WV-7755 | fA * fC * fC * fU * fG * fA * mA * mA * mU * mU * mU * mU * mC * mG * fA * fA * fG * fU * fU * fU | 980 | ACCUGAAAUUUUCGAAGUUU | XXXXX XXXXX XXXXX XXXX |
| WV-7756 | fG * fU * fA * fC * fC * fU * mG * mA * mA * mA * mU * mU * mU * mU * fC * fG * fA * fA * fG * fU | 981 | UUACCUGAAAUUUUCGAAGU | XXXXX XXXXX XXXXX XXXX |
| WV-7757 | fG * fC * fU * fU * fA * fC * mC * mU * mG * mA * mA * mA * mU * mU * fU * fU * fC * fG * fA * fA | 982 | GCUUACCUGAAAUUUUCGAA | XXXXX XXXXX XXXXX XXXX |
| WV-7758 | fC * fG * fG * fC * fU * fU * mA * mC * mC * mU * mG * mA * mA * mA * fU * fU * fU * fU * fC * fG | 983 | CGGCUUACCUGAAAUUUUCG | XXXXX XXXXX XXXXX XXXX |
| WV-7759 | fC * fU * fC * fG * fG * fC * mU * mU * mA * mC * mC * mU * mG * mA * fA * fA * fU * fU * fU * fU | 984 | CUCGGCUUACCUGAAAUUUU | XXXXX XXXXX XXXXX XXXX |
| WV-7760 | fA * fC * fC * fU * fC * fG * mG * mC * mU * mU * mA * mC * mC * mU * fG * fA * fA * fA * fU * fU | 985 | ACCUCGGCUUACCUGAAAUU | XXXXX XXXXX XXXXX XXXX |
| WV-7761 | fA * fA * fA * fC * fC * fU * mC * mG * mG * mC * mU * mU * mA * mC * fC * fU * fG * fA * fA * fA | 986 | AAACCUCGGCUUACCUGAAA | XXXXX XXXXX XXXXX XXXX |
| WV-7762 | fC * fC * fA * fA * fA * fC * mC * mU * mC * mG * mG * mC * mU * mU * fA * fC * fC * fU * fU * fA | 987 | CCAAACCUCGGCUUACCUGA | XXXXX XXXXX XXXXX XXXX |
| WV-7763 | fG * fC * fC * fA * fA * fA * mC * mC * mU * mC * mG * mG * mC * mU * fU * fA * fC * fC * fU * fG | 988 | GCCAAACCUCGGCUUACCUG | XXXXX XXXXX XXXXX XXXX |

TABLE A1-continued

| | | | | |
|---|---|---|---|---|
| WV-7764 | fA * fG * fG * fC * fC * fA * mA * mA * mC * mC * mU * mC * mG * mG * fC * fU * fU * fA * fC * fC | 989 | AGGCCAAACCUCGGCUUACC | XXXXX XXXXX XXXXX XXXX |
| WV-7765 | fA * fA * fA * fG * fG * fC * mC * mA * mA * mA * mC * mC * mU * mC * fG * fG * fC * fU * fU * fA | 990 | AAAGGCCAAACCUCGGCUUA | XXXXX XXXXX XXXXX XXXX |
| WV-7766 | fU * fU * fA * fA * fA * fG * mG * mC * mC * mA * mA * mA * mC * mC * fU * fC * fG * fG * fC * fU | 991 | UUAAAGGCCAAACCUCGGCU | XXXXX XXXXX XXXXX XXXX |
| WV-7767 | fG * fU * fU * fU * fA * fA * mA * mG * mG * mC * mC * mA * mA * mA * fC * fC * fU * fC * fG * fG | 992 | GUUUAAAGGCCAAACCUCGG | XXXXX XXXXX XXXXX XXXX |
| WV-7768 | fU * fA * fG * fU * fU * fU * mA * mA * mA * mG * mG * mC * mC * mA * fA * fA * fC * fC * fU * fC | 993 | UAGUUUAAAGGCCAAACCUC | XXXXX XXXXX XXXXX XXXX |
| WV-7769 | fU * fA * fU * fA * fG * fU * mU * mU * mA * mA * mA * mG * mG * mC * fC * fA * fA * fA * fC * fC | 994 | UAUAGUUUAAAGGCCAAACC | XXXXX XXXXX XXXXX XXXX |
| WV-7770 | fA * fA * fU * fA * fU * fA * mG * mU * mU * mU * mA * mA * mA * mG * fG * fC * fC * fA * fA * fA | 995 | AAUAUAGUUUAAAGGCCAAA | XXXXX XXXXX XXXXX XXXX |
| WV-7771 | fA * fA * fA * fA * fU * fA * mU * mA * mG * mU * mU * mU * mA * mA * fA * fG * fG * fC * fC * fA | 996 | AAAAUAUAGUUUAAAGGCCA | XXXXX XXXXX XXXXX XXXX |
| WV-8130 | Mod028L001 * fU * SfC * SfA * SfA * SfG * SfG * S mAfA * S mG mA * SfU * S mG mGfC * SfA * SfU * SfU * SfU * SfC * SfU | 997 | UCAAGGAAGAUGGCAUUUCU | XSSSSSSOSOSSOOSSSSSS |
| WV-8131 | Mod028L001fU * SfC * SfA * SfA * SfG * SfG * S mAfA * S mG mA * SfU * S mG mGfC * SfA * SfU * SfU * SfU * SfC * SfU | 998 | UCAAGGAAGAUGGCAUUUCU | OSSSSSSOSOSSOOSSSSSS |
| WV-8230 | fU * SfC * SfA * SfA * SfG * SfG * SAeofA * SGeoAeo * SfU * SGeoGeofC * SfA * SfG * SfU * SfU * SfC * SfU | 999 | UCAAGGAAGAUGGCAUUUCU | SSSSSSOSOSSOOSSSSSS |
| WV-8231 | fU * SfC * SfA * SfA * SfG * SfG * SAeofA * SGeoAeofU * SGeoGeofC * SfA * SfU * SfU * SfU * SfC * SfU | 1000 | UCAAGGAAGAUGGCAUUUCU | SSSSSSOSOOSOOSSSSSS |
| WV-8232 | fU * SfC * SfA * SfA * SfG * SfG * SAeoAeoGeoAeoTeoGeoGeofC * SfA * SfU * SfU * SfU * SfC * SfU | 1001 | UCAAGGAAGATGGCAUUUCU | SSSSSSOOOOOOOSSSSSS |
| WV-8449 | fU * RfC * RfA * RfA * RfG * RfG * R mAfA * R mG mA * RfU * R mG mGfC * RfA * RfU * RfU * RfU * RfC * RfU | 1002 | UCAAGGAAGAUGGCAUUUCU | RRRRRRORORROORRRRRR |
| WV-8478 | fU * fC * fA * fA * fG * fG * Aeo * Aeo * Geo * Aeo * Teo * Geo * Geo * m5Ceo * Aeo * Teo * Teo * Teo * m5Ceo * Teo | 1003 | UCAAGGAAGATGGCATTTCT | XXXXX XXXXX XXXXX XXXX |
| WV-8479 | fU * fC * fA * fA * fG * fG * Aeo * Aeo * Geo * Aeo * Teo * Geo * Geo * m5Ceo * Aeo * Teo * Teo * Teo * m5Ceo * mU | 1004 | UCAAGGAAGATGGCATTTCU | XXXXX XXXXX XXXXX XXXX |
| WV-8480 | fU * fC * fA * fA * fG * fG * Aeo * Aeo * Geo * Aeo * Teo * Geo * Geo * m5Ceo * Aeo * Teo * Teo * Teo * mC * mU | 1005 | UCAAGGAAGATGGCATTTCU | XXXXX XXXXX XXXXX XXXX |
| WV- | fU * fC * fA * fA * fG * fG * Aeo * Aeo * Geo * Aeo * Teo * Geo * Geo * | 1006 | UCAAGGAAGATGGCA | XXXXX XXXXX |

TABLE A1-continued

| | | | | |
|---|---|---|---|---|
| 8481 | m5Ceo * Aeo * Teo * Teo * mU * mC * mU | | TTUCU | XXXXX XXXX |
| WV-8482 | fU * fC * fA * fA * fG * fG * Aeo * Aeo * Geo * Aeo * Teo * Geo * Geo * m5Ceo * Aeo * Teo * mU * mU * mC * mU | 1007 | UCAAGGAAGATGGCA TUUCU | XXXXX XXXXX XXXXX XXXX |
| WV-8483 | fU * fC * fA * fA * fG * fG * Aeo * Aeo * Geo * Aeo * Teo * Geo * Geo * m5Ceo * Aeo * mU * mU * mU * mC * mU | 1008 | UCAAGGAAGATGGCA UUUCU | XXXXX XXXXX XXXXX XXXX |
| WV-8484 | fU * fC * fA * fA * fG * fG * Aeo * Aeo * Geo * Aeo * Teo * Geo * Geo * m5Ceo * mA * mU * mU * mU * mC * mU | 1009 | UCAAGGAAGATGGCA UUUCU | XXXXX XXXXX XXXXX XXXX |
| WV-8485 | fU * fC * fA * fA * fG * fG * Aeo * Aeo * Geo * Aeo * Teo * Geo * Geo * mC * mA * mU * mU * mU * mC * mU | 1010 | UCAAGGAAGATGGCA UUUCU | XXXXX XXXXX XXXXX XXXX |
| WV-8486 | fU * fC * fA * fA * fG * fG * Aeo * Aeo * Geo * Aeo * Teo * Geo * mG * mC * mA * mU * mU * mU * mC * mU | 1011 | UCAAGGAAGATGGCA UUUCU | XXXXX XXXXX XXXXX XXXX |
| WV-8487 | fU * fC * fA * fA * fG * fG * Aeo * Aeo * Geo * Aeo * Teo * mG * mG * mC * mA * mU * mU * mU * mC * mU | 1012 | UCAAGGAAGATGGCA UUUCU | XXXXX XXXXX XXXXX XXXX |
| WV-8488 | fU * fC * fA * fA * fG * fG * Aeo * Aeo * Geo * Aeo * mU * mG * mG * mC * mA * mU * mU * mU * mC * mU | 1013 | UCAAGGAAGAUGGCA UUUCU | XXXXX XXXXX XXXXX XXXX |
| WV-8489 | fU * fC * fA * fA * fG * fG * Aeo * Aeo * Geo * mA * mU * mG * mG * mC * mA * mU * mU * mU * mC * mU | 1014 | UCAAGGAAGAUGGCA UUUCU | XXXXX XXXXX XXXXX XXXX |
| WV-8490 | fU * fC * fA * fA * fG * fG * Aeo * Aeo * mG * mA * mU * mG * G * mC * mA * mU * mU * mU * mC * mU | 1015 | UCAAGGAAGAUGGCA UUUCU | XXXXX XXXXX XXXXX XXXX |
| WV-8491 | fU * fC * fA * fA * fG * fG * Aeo * mA * mG * mA * mU * mG * mG * mC * mA * mU * mU * mU * mC * mU | 1016 | UCAAGGAAGAUGGCA UUUCU | XXXXX XXXXX XXXXX XXXX |
| WV-8492 | Teo * m5Ceo * Aeo * Aeo * Geo * Geo * Aeo * Aeo * Geo * Aeo * Teo * Geo * Geo * m5Ceo * fA * fU * fU * fU * fC * fU | 1017 | TCAAGGAAGATGGCA UUUCU | XXXXX XXXXX XXXXX XXXX |
| WV-8493 | mU * m5Ceo * Aeo * Aeo * Geo * Geo * Aeo * Aeo * Geo * Aeo * Teo * Geo * Geo * m5Ceo * fA * fU * fU * fU * fC * fU | 1018 | UCAAGGAAGATGGCA UUUCU | XXXXX XXXXX XXXXX XXXX |
| WV-8494 | mU * mC * Aeo * Aeo * Geo * Geo * Aeo * Aeo * Geo * Aeo * Teo * Geo * Geo * m5Ceo * fA * fU * fU * fU * fC * fU | 1019 | UCAAGGAAGATGGCA UUUCU | XXXXX XXXXX XXXXX XXXX |
| WV-8495 | mU * mC * mA * Aeo * Geo * Geo * Aeo * Aeo * Geo * Aeo * Teo * Geo * Geo * m5Ceo * fA * fU * fU * fU * fC * fU | 1020 | UCAAGGAAGATGGCA UUUCU | XXXXX XXXXX XXXXX XXXX |
| WV-8496 | mU * mC * mA * mA * Geo * Geo * Aeo * Aeo * Geo * Aeo * Teo * Geo * Geo * m5Ceo * fA * fU * fU * fU * fC * fU | 1021 | UCAAGGAAGATGGCA UUUCU | XXXXX XXXXX XXXXX XXXX |
| WV-8497 | mU * mC * mA * mA * mG * Geo * Aeo * Aeo * Geo * Aeo * Teo * Geo * Geo * m5Ceo * fA * fU * fU * fU * fC * fU | 1022 | UCAAGGAAGATGGCA UUUCU | XXXXX XXXXX XXXXX XXXX |
| WV-8498 | mU * mC * mA * mA * mG * mG * Aeo * Aeo * Geo * Aeo * Teo * Geo * Geo * m5Ceo * fA * fU * fU * fU * fC * fU | 1023 | UCAAGGAAGATGGCA UUUCU | XXXXX XXXXX XXXXX XXXX |

TABLE A1-continued

| | | | | |
|---|---|---|---|---|
| WV-8499 | mU * mC * mA * mA * mG * mG * mA * Aeo * Geo * Aeo * Teo * Geo * Geo * m5Ceo * fA * fU * fU * fU * fC *fU | 1024 | UCAAGGAAGATGGCAUUUCU | XXXXX XXXXX XXXXX XXXX |
| WV-8500 | mU * mC * mA * mA * mG * mG * mA * mA * Geo * Aeo * Teo * Geo * Geo * m5Ceo * fA * fU * fU * fU * fC * fU | 1025 | UCAAGGAAGATGGCAUUUCU | XXXXX XXXXX XXXXX XXXX |
| WV-8501 | mU * mC * mA * mA * mG * mG * mA * mA * mG * Aeo * Teo * Geo * Geo * m5Ceo * fA * fU * fU * fU * fC * fU | 1026 | UCAAGGAAGATGGCAUUUCU | XXXXX XXXXX XXXXX XXXX |
| WV-8502 | mU * mC * mA * mA * mG * mG * mA * mA * mG * mA * Teo * Geo * Geo * m5Ceo * fA * fU * fU * fU * fC * fU | 1027 | UCAAGGAAGATGGCAUUUCU | XXXXX XXXXX XXXXX XXXX |
| WV-8503 | mU * mC * mA * mA * mG * mG * mA * mA * mG * mA * mU * Geo * Geo * m5Ceo * fA * fU * fU * fU * fC * fU | 1028 | UCAAGGAAGAUGGCAUUUCU | XXXXX XXXXX XXXXX XXXX |
| WV-8504 | mU * mC * mA * mA * mG * mG * mA * mA * mG * mA * mU * mG * Geo * m5Ceo * fA * fU * fU * fU * fC * fU | 1029 | UCAAGGAAGAUGGCAUUUCU | XXXXX XXXXX XXXXX XXXX |
| WV-8505 | mU * mC * mA * mA * mG * mG * mA * mA * mG * mA * mU * mG * mG * m5Ceo * fA * fU * fU * fU * fC * fU | 1030 | UCAAGGAAGAUGGCAUUUCU | XXXXX XXXXX XXXXX XXXX |
| WV-8506 | Teo * m5Ceo * Aeo * Aeo * Geo * Geo * Aeo * Aeo * Geo * Aeo * Teo * Geo * Geo * m5Ceo * Aeo * Teo * Teo * Teo * m5Ceo * Teo | 1031 | TCAAGGAAGATGGCATTTCT | XXXXX XXXXX XXXXX XXXX |
| WV-8806 | CTCCAACATCAAGGAAGATGGCATTTCTAG +all PMO | 1032 | CTCCAACATCAAGGAAGATGGCATTTCTAG | XXXXX XXXXX XXXXX XXXXX |
| WV-884 | mU * R mC * R mA * R mA * R mG * R mG * R mA * R mA * R mG * R mA * R mU * R mG * R mG * R mC * R mA * R mU * R mU * R mU * R mC * R mU | 1033 | UCAAGGAAGAUGGCAUUUCU | RRRRRRRRRRRRRRRRRRR |
| WV-885 | mU * S mC * R mA * S mA * R mG * S mG * R mA * S mA * R mG * S mA * R mU * S mG * R mG * S mC * R mA * S mU * R mU * S mU * R mC * S mU | 1034 | UCAAGGAAGAUGGCAUUUCU | SRSRSRSRSRSRSRSRSRS |
| WV-886 | mU * R mC * R mA * R mA * S mG * S mG * S mA * S mA * S mG * S mA * S mU * S mG * S mG * S mC * S mA * S mU * S mU * R mU * R mC * R mU | 1035 | UCAAGGAAGAUGGCAUUUCU | RRRSSSSSSSSSSSSSRRR |
| WV-887 | mU * S mC * S mA * S mA * R mG * R mG * R mA * R mA * R mG * R mA * R mU * R mG * R mG * R mC * R mA * R mU * R mU * S mU * S mC * S mU | 1036 | UCAAGGAAGAUGGCAUUUCU | SSSRRRRRRRRRRRRRSSS |
| WV-888 | mU * R mC * R mA * R mA * R mG * R mG * S mA * S mA * R mG * S mA * S mU * R mG * S mG * S mC * R mA * R mU * R mU * R mU * R mC * R mU | 1037 | UCAAGGAAGAUGGCAUUUCU | RRRRRSSRSSRSSRRRRR |

TABLE A1-continued

| | | | | |
|---|---|---|---|---|
| WV-889 | mU * S mC * S mA * S mA * S mG * S mG * R mA * R mA * S mG * R mA * R mU * S mG * R mG * R mC * S mA * S mU * S mU * S mU * S mC * S mU | 1038 | UCAAGGAAGAUGGCAUUUCU | SSSSSRRSRRSRRSSSSSS |
| WV-890 | mU * R mC * R mA * R mA * S mG * S mG * R mA * R mA * S mG * R mA * R mU * R mG * S mG * R mC * R mA * S mU * S mU * R mU * R mC * R mU | 1039 | UCAAGGAAGAUGGCAUUUCU | RRRSSRRSRRRSRRSSRRR |
| WV-891 | mU * S mC * S mA * S mA * R mG * R mG * S mA * S mA * R mG * S mA * S mU * S mG * R mG * S mC * S mA * R mU * R mU * S mU * S mC * S mU | 1040 | UCAAGGAAGAUGGCAUUUCU | SSSRRSSRSSSRSSRRSSS |
| WV-892 | mU * S mC * R mA * R mA * R mG * R mG * R mA * R mA * R mG * R mA * R mC * R mG * R mG * R mC * R mA * R mU * R mU * R mU * R mC * S mU | 1041 | UCAAGGAAGAUGGCAUUUCU | SRRRRRRRRRRRRRRRRRS |
| WV-893 | mU * R mC * S mA * S mA * S mG * S mG * S mA * S mA * S mG * S mA * S mU * S mG * S mG * S mC * S mA * S mU * S mU * S mU * S mC * R mU | 1042 | UCAAGGAAGAUGGCAUUUCU | RSSSSSSSSSSSSSSSSSR |
| WV-8937 | fA * SfA * SfG * SfG * S mAfA * S mG mA * SfU * S mG mGfC * SfA * SfU * SfU * SfU * SfC * SfU | 1043 | AAGGAAGAUGGCAUUUCU | SSSSOSOSSOOSSSSSS |
| WV-894 | mU * S mC * R mA * S mA * S mG * R mG * R mA * S mA * S mG * R mA * S mU * S mG * R mG * R mC * R mA * S mU * S mU * S mU * S mC * R mU | 1044 | UCAAGGAAGAUGGCAUUUCU | SRSSRRSSRSSRRRSSSSR |
| WV-895 | mU * R mC * S mA * R mA * R mG * S mG * S mA * R mA * R mG * S mA * R mU * R mG * S mG * S mC * S mA * R mU * R mU * R mU * R mC * S mU | 1045 | UCAAGGAAGAUGGCAUUUCU | RSRRSSRRSRRSSSRRRRS |
| WV-896 | mU * S mC * S mA * R mA * R mG * R mG * R mA * R mA * R mG * R mA * R mU * S mG * R mG * R mC * S mA * R mU * S mU * S mU * S mC * S mU | 1046 | UCAAGGAAGAUGGCAUUUCU | SSRRRRRRRRSRRSRSSSS |
| WV-897 | mU * R mC * R mA * S mA * S mG * S mG * S mA * S mA * S mG * S mA * S mU * R mG * S mG * S mC * R mA * S mU * R mU * R mU * R mC * R mU | 1047 | UCAAGGAAGAUGGCAUUUCU | RRSSSSSSSSRSSRSRRRR |
| WV-9067 | fG * fU * fA * fC * fU * fU * m5Ceo * Aeo * Teo * m5Ceo * m5Ceo * m5Ceo * Aeo * m5Ceo * fU * fG * fA * fU * fU * fC | 1048 | GUACUUCATCCCACUGAUUC | XXXXX XXXXXXXXXX XXXX |
| WV-9068 | fG * fU * fA * fC * fU * fU * m5Ceo * AeoTeo * m5Ceo m5Ceo * m5CeoAeo * m5CeofU * fG * fA * fU * fU * fC | 1049 | GUACUUCATCCCACUGAUUC | XXXXXXXOXOXOXOXXXXX |
| WV-9069 | fG * fU * fA * fC * fU * fU * m5CeoAeo * Teo m5Ceo * m5Ceo m5Ceo * Aeo m5Ceo * fU * fG * fA * fU * fU * fC | 1050 | GUACUUCATCCCACUGAUUC | XXXXXXOXOXOXOXXXXXX |
| WV-9070 | fG * fU * fA * fC * fU * fU * m5Ceo * mA * Teo * mC * m5Ceo * mC * Aeo * mC * fU * fG * fA * fU * fU * fC | 1051 | GUACUUCATCCCACUGAUUC | XXXXX XXXXXXXXXX XXXX |
| WV-9071 | fG * fU * fA * fC * fU * fU * m5Ceo * mATeo * mC m5Ceo * mCAeo * mCfU * fG * fA * fU * fU * fC | 1052 | GUACUUCATCCCACUGAUUC | XXXXXXXOXOXOXOXXXXX |

TABLE A1-continued

| | | | | |
|---|---|---|---|---|
| WV-9072 | fG * fU * fA * fC * fU * fU * m5Ceo mA * Teo mC * m5Ceo mC * Aeo mC * fU * fG * fA * fU * fU * fC | 1053 | GUACUUCATCCCACU GAUUC | XXXXXXOXOXOX OXXXXXX |
| WV-9073 | fG * fU * fA * fC * fU * fU * mC * Aeo * mU * m5Ceo * mC * m5Ceo * mA * m5Ceo * fU * fG * fA * fU * fU * fC | 1054 | GUACUUCAUCCCACU GAUUC | XXXXX XXXXX XXXXX XXXX |
| WV-9074 | fG * fU * fA * fC * fU * fU * mC * Aeo mU * m5Ceo mC * m5Ceo mA * m5CeofU * fG * fA * fU * fU * fU | 1055 | GUACUUCAUCCCACU GAUUC | XXXXXXXOXOXO XOXXXXX |
| WV-9075 | fG * fU * fA * fC * fU * fU * mCAeo * mU m5Ceo * mC m5Ceo * mA m5Ceo * fU * fG * fA * fU * fU * fC | 1056 | GUACUUCAUCCCACU GAUUC | XXXXXXOXOXOX OXXXXXX |
| WV-9076 | fG * fU * fA * fC * fU * fU * m5Ceo * fA * Teo * fC * m5Ceo * fC * Aeo * fC * fU * fG * fA * fU * fU * fC | 1057 | GUACUUCATCCCACU GAUUC | XXXXX XXXXX XXXXX XXXX |
| WV-9077 | fG * fU * fA * fC * fU * fU * m5Ceo * fATeo * fC m5Ceo * fCAeo * fCfU * fG * fA * fU * fU * fC | 1058 | GUACUUCATCCCACU GAUUC | XXXXXXXOXOXO XOXXXXX |
| WV-9078 | fG * fU * fA * fC * fU * fU * m5CeofA * TeofC * m5CeofC * AeofC * fU * fG * fA * fU * fU * fC | 1059 | GUACUUCATCCCACU GAUUC | XXXXXXOXOXOX OXXXXXX |
| WV-9079 | fG * fU * fA * fC * fU * fU * fC * Aeo * fU * m5Ceo * fC * m5Ceo * fA * m5Ceo * fU * fG * fA * fU * fU * fC | 1060 | GUACUUCAUCCCACU GAUUC | XXXXX XXXXX XXXXX XXXX |
| WV-9080 | fG * fU * fA * fC * fU * fU * fC * AeofU * m5CeofC * m5CeofA * m5CeofU * fG * fA * fU * fU * fC | 1061 | GUACUUCAUCCCACU GAUUC | XXXXXXXOXOXO XOXXXXX |
| WV-9081 | fG * fU * fA * fC * fU * fU * fCAeo * fU m5Ceo * fC m5Ceo * fA m5Ceo * fU * fG * fA * fU * fU * fC | 1062 | GUACUUCAUCCCACU GAUUC | XXXXXXOXOXOX OXXXXXX |
| WV-9082 | fG * fU * fA * fC * fU * fU * mC * fA * mU * fC * mC * fC * mA * fC * fU * fG * fA * fU * fU * fC | 1063 | GUACUUCAUCCCACU GAUUC | XXXXX XXXXX XXXXX XXXX |
| WV-9083 | fG * fU * fA * fC * fU * fU * mC * fA mU * fC mC * fC mA * fCfU * fG * fA * fU * fU * fC | 1064 | GUACUUCAUCCCACU GAUUC | XXXXXXXOXOXO XOXXXXX |
| WV-9084 | fG * fU * fA * fC * fU * fU * mCfA * mUfC * mCfC * mAfC * fU * fG * fA * fU * fU * fC | 1065 | GUACUUCAUCCCACU GAUUC | XXXXXXOXOXOX OXXXXXX |
| WV-9085 | fG * fU * fA * fC * fU * fU * fC * mA * fU * mC * fC * mC * fA * mC * fU * fG * fA * fU * fU * fC | 1066 | GUACUUCAUCCCACU GAUUC | XXXXX XXXXX XXXXX XXXX |
| WV-9086 | fG * fU * fA * fC * fU * fU * fC * mAfU * mCfC * mCfA * mCfU * fG * fA * fU * fU * fC | 1067 | GUACUUCAUCCCACU GAUUC | XXXXXXXOXOXO XOXXXXX |
| WV-9087 | fG * fU * fA * fC * fU * fU * fC mA * fU mC * fC mC * fA mC * fU * fG * fA * fU * fU * fC | 1068 | GUACUUCAUCCCACU GAUUC | XXXXXXOXOXOX OXXXXXX |
| WV-9088 | Geo * Teo * Aeo * m5Ceo * Teo * Teo * m5Ceo * Aeo * Teo * m5Ceo * m5Ceo * m5Ceo * Aeo * m5Ceo * fU * fG * fA * fU * fU * fC | 1069 | GTACTTCATCCCACU GAUUC | XXXXX XXXXX XXXXX XXXX |
| WV- | mG * mU * mA * mC * mU * Teo * m5Ceo * Aeo * Teo * m5Ceo * m5Ceo | 1070 | GUACUTCATCCCACU | XXXXX XXXXX |

TABLE A1-continued

| | | | | |
|---|---|---|---|---|
| 9089 | * m5Ceo * Aeo * m5Ceo * fU * fG * fA * fU * fU * fC | | GAUUC | XXXXX XXXX |
| WV-9090 | mG * mU * mA * mC * mU * mU * m5Ceo * Aeo * Teo * m5Ceo m5Ceo * m5Ceo * Aeo * m5Ceo * fU * fG * fA * fU * fU * fC | 1071 | GUACUUCATCCCACU GAUUC | XXXXX XXXXX XXXXX XXXX |
| WV-9091 | fG * fU * fG * fU * fU * fC * Teo * Teo * Geo * Teo * Aeo * m5Ceo * Teo * Teo * fC * fA * fU * fC * fC * fC | 1072 | GUGUUCTTGTACTTC AUCCC | XXXXX XXXXX XXXXX XXXX |
| WV-9092 | fG * fU * fG * fU * fU * fC * Teo * TeoGeo * TeoAeo * m5CeoTeo * TeofC * fA * fU * fC * fC * fC | 1073 | GUGUUCTTGTACTTC AUCCC | XXXXXXXOXOXO XOXXXXX |
| WV-9093 | fG * fU * fG * fU * fU * fC * TeoTeo * GeoTeo * Aeo m5Ceo * TeoTeo * fC * fA * fU * fC * fC * fC | 1074 | GUGUUCTTGTACTTC AUCCC | XXXXXXOXOXOX OXXXXXX |
| WV-9094 | fG * fU * fG * fU * fU * fc * Teo * mU * Geo * mU * Aeo * mC * Teo * mU * fC * fA * fU * fC * fC * fC | 1075 | GUGUUCTUGUACTUC AUCCC | XXXXX XXXXX XXXXX XXXX |
| WV-9095 | fG * fU * fG * fU * fU * fC * Teo * mUGeo * mUAeo * mCTeo * mUfC * fA * fU * fC * fC * fC | 1076 | GUGUUCTUGUACTUC AUCCC | XXXXXXXOXOXO XOXXXXX |
| WV-9096 | fG * fU * fG * fU * fU * fC * Teo mU * Geo mU * Aeo mC * Teo mU * fC * fA * fU * fC * fC * fC | 1077 | GUGUUCTUGUACTUC AUCCC | XXXXXXOXOXOX OXXXXXX |
| WV-9097 | fU * fU * fG * fU * fU * fC * mU * Teo * mG * Teo * mA * m5Ceo * mU * Teo * fC * fA * fU * fC * fC * fC | 1078 | GUGUUCUTGTACUTC AUCCC | XXXXX XXXXX XXXXX XXXX |
| WV-9098 | fG * fU * fG * fU * fU * fC * mU * Teo mG * Teo mA * m5Ceo mU * TeofC * fA * fU * fC * fC * fC | 1079 | GUGUUCUTGTACUTC AUCCC | XXXXXXXOXOXO XOXXXXX |
| WV-9099 | fG * fU * fG * fU * fU * fC * mUTeo * mGTeo * mA m5Ceo * mUTeo * fC * fA * fU * fC * fC * fC | 1080 | GUGUUCUTGTACUTC AUCCC | XXXXXXOXOXOX OXXXXXX |
| WV-9100 | fU * fU * fG * fU * fU * fC * Teo * fU * Geo * fU * Aeo * fC * Teo * fU * fC * fA * fU * fC * fC * fC | 1081 | GUGUUCTUGUACTUC AUCCC | XXXXX XXXXX XXXXX XXXX |
| WV-9101 | fG * fU * fG * fU * fU * fC * Teo * fUGeo * fUAeo * fCTeo * fUfC * fA * fU * fC * fC * fC | 1082 | GUGUUCTUGUACTUC AUCCC | XXXXXXXOXOXO XOXXXXX |
| WV-9102 | fG * fU * fG * fU * fU * fC * TeofU * GeofU * AeofC * TeofU * fC * fA * fU * fC * fC * fC | 1083 | GUGUUCTUGUACTUC AUCCC | XXXXXXOXOXOX OXXXXXX |
| WV-9103 | fG * fU * fG * fU * fU * fC * fU * Teo * fG * Teo * fA * m5Ceo * fU * Teo * fC * fA * fU * fC * fC * fC | 1084 | GUGUUCUTGTACUTC AUCCC | XXXXX XXXXX XXXXX XXXX |
| WV-9104 | fG * fU * fG * fU * fU * fC * fU * TeofG * TeofA * m5CeofU * TeofC * fA * fG * fC * fC * fC | 1085 | GUGUUCUTGTACUTC AUCCC | XXXXXXXOXOXO XOXXXXX |
| WV-9105 | fG * fU * fG * fU * fU * fC * fUTeo * fGTeo * fA m5Ceo * fUTeo * fC * fA * fU * fC * fC * fC | 1086 | GUGUUCUTGTACUTC AUCCC | XXXXXXOXOXOX OXXXXXX |
| WV-9106 | fG * fU * fG * fU * fU * fC * mU * fU * mG * fU * mA * fC * mU * fU * fC * fA * fU * fC * fC * fC | 1087 | GUGUUCUUGUACUUC AUCCC | XXXXX XXXXX XXXXX XXXX |

TABLE A1-continued

| | | | | |
|---|---|---|---|---|
| WV-9107 | fG * fU * fG * fU * fU * fC * mU * fU mG * fU mA * fC mU * fUfC * fA * fU * fC * fC * fC | 1088 | GUGUUCUUGUACUUC AUCCC | XXXXXXXOXOXO XOXXXXX |
| WV-9108 | fG * fU * fG * fU * fU * fC * mUfU * mGfU * mAfC * mUfU * fC * fA * fU * fC * fC * fC | 1089 | GUGUUCUUGUACUUC AUCCC | XXXXXXOXOXOX OXXXXXX |
| WV-9109 | fG * fU * fG * fU * fU * fC * fU * mU * fG * mC * fA * mC * fU * mU * fC * fA * fU * fC * fC * fC | 1090 | GUGUUCUUGUACUUC AUCCC | XXXXX XXXXX XXXXX XXXX |
| WV-9110 | fG * fU * fG * fU * fU * fC * fU * mUfG * mUfA * mCfU * mUfC * fA * fU * fC * fC * fC | 1091 | GUGUUCUUGUACUUC AUCCC | XXXXXXXOXOXO XOXXXXX |
| WV-9111 | fG * fU * fG * fU * fU * fC * fU mU * fG mU * fA mC * fU mU * fC * fA * fU * fC * fC * fC | 1092 | GUGUUCUUGUACUUC AUCCC | XXXXXXOXOXOX OXXXXXX |
| WV-9112 | Geo * Teo * Geo * Teo * Teo * m5Ceo * Teo * Teo * Geo * Teo * Aeo * m5Ceo * Teo * Teo * fC * fA * fU * fC * fC * fC | 1093 | GTGTTCTTGTACTTCA | XXXXX XXXXX UCCC XXXXX XXXX |
| WV-9113 | mG * mU * mG * mU * mU * m5Ceo * Teo * Teo * Geo * Teo * Aeo * m5Ceo * Teo * Teo * fC * fA * fU * fC * fC * fC | 1094 | GUGUUCTTGTACTTC AUCCC | XXXXX XXXXX XXXXX XXXX |
| WV-9114 | mG * mU * mG * mU * mU * mC * Teo * Teo * Geo * Teo * Aeo * m5Ceo * Teo * Teo * fC * fA * fU * fC * fC * fC | 1095 | GUGUUCTTGTACTTC AUCCC | XXXXX XXXXX XXXXX XXXX |
| WV-9115 | fU * fU * fC * fU * fG * fA * Aeo * Geo * Geo * Teo * Geo * Teo * Teo * m5Ceo * fU * fU * fG * fU * fA * fC | 1096 | UUCUGAAGGTGTTCU UGUAC | XXXXX XXXXX XXXXX XXXX |
| WV-9116 | fU * fU * fC * fU * fG * fA * Aeo * GeoGeo * TeoGeo * TeoTeo * m5CeofU * fU * fG * fU * fA * fC | 1097 | UUCUGAAGGTGTTCU UGUAC | XXXXXXXOXOXO XOXXXXX |
| WV-9117 | fU * fU * fC * fU * fG * fA * AeoGeo * GeoTeo * GeoTeo * Teo m5Ceo * fU * fU * fG * fU * fA * fC | 1098 | UUCUGAAGGTGTTCU UGUAC | XXXXXXOXOXOX OXXXXXX |
| WV-9118 | fU * fU * fC * fU * fG * fA * Aeo * mG * Geo * mU * Geo * mU * Teo * mC * fU * fU * fG * fU * fA * fC | 1099 | UUCUGAAGGUGUTCU UGUAC | XXXXX XXXXX XXXXX XXXX |
| WV-9119 | fU * fU * fC * fU * fG * fA * Aeo * mGGeo * mUGeo * mUTeo * mCfU * fU * fG * fU * fA * fC | 1100 | UUCUGAAGGUGUTCU UGUAC | XXXXXXXOXOXO XOXXXXX |
| WV-9120 | fU * fU * fC * fU * fG * fA * Aeo mG * Geo mU * Geo mU * Teo mC * fU * fU * fG * fU * fA * fC | 1101 | UUCUGAAGGUGUTCU UGUAC | XXXXXXOXOXOX OXXXXXX |
| WV-9121 | fU * fU * fC * fU * fG * fA * mA * Geo * mG * Teo * mG * Teo * mU * m5Ceo * fU * fU * fG * fU * fA * fC | 1102 | UUCUGAAGGTGTUCU UGUAC | XXXXX XXXXX XXXXX XXXX |
| WV-9122 | fU * fU * fC * fU * fG * fA * mA * Geo mG * Teo mG * Teo mU * m5CeofU * fU * fG * fU * fA * fC | 1103 | UUCUGAAGGTGTUCU UGUAC | XXXXXXXOXOXO XOXXXXX |
| WV-9123 | fU * fU * fC * fU * fG * fA * mAGeo * mGTeo * mGTeo * mU m5Ceo * fU * fU * fG * fU * fA * fC | 1104 | UUCUGAAGGTGTUCU UGUAC | XXXXXXOXOXOX OXXXXXX |
| WV-9124 | fU * fU * fC * fU * fG * fA * Aeo * fG * Geo * fU * Geo * fU * Teo * fC * fU * fU * fG * fU * fA * fC | 1105 | UUCUGAAGGUGUTCU UGUAC | XXXXX XXXXX XXXXX XXXX |

TABLE A1-continued

| | | | | |
|---|---|---|---|---|
| WV-9125 | fU * fU * fC * fG * fG * fA * Aeo * fGGeo * fUGeo * fUTeo * fCfU * fU * fG * fU * fA * fC | 1106 | UUCUGAAGGUGUTCUUGUAC | XXXXXXXOXOXOXOXXXXX |
| WV-9126 | fU * fU * fC * fU * fG * fA * AeofG * GeofU * GeofU * TeofC * fU * fU * fG * fU * fA * fC | 1107 | UUCUGAAGGUGUTCUUGUAC | XXXXXXOXOXOXOXXXXXX |
| WV-9127 | fU * fU * fC * fU * fG * fA * fA * Geo * fG * Teo * fG * Teo * fU * m5Ceo * fU * fU * fG * fU * fA * fC | 1108 | UUCUGAAGGTGTUCUUGUAC | XXXXX XXXXX XXXXX XXXX |
| WV-9128 | fU * fU * fC * fU * fG * fA * fA * GeofG * TeofG * TeofU * m5CeofU * fU * fG * fU * fA * fC | 1109 | UUCUGAAGGTGTUCUUGUAC | XXXXXXXOXOXOXOXXXXX |
| WV-9129 | fU * fU * fC * fU * fG * fA * fAGeo * fGTeo * fGTeo * fU m5Ceo * fU * fU * fG * fU * fA * fC | 1110 | UUCUGAAGGTGTUCUUGUAC | XXXXXXOXOXOXOXXXXXX |
| WV-9130 | fU * fU * fC * fU * fG * fA * mA * fG * mG * fU * mG * fU * mU * fC * fU * fU * fG * fU * fA * fC | 1111 | UUCUGAAGGUGUUCUUGUAC | XXXXX XXXXX XXXXX XXXX |
| WV-9131 | fU * fU * fC * fU * fG * fA * mA * fG mG * fU mG * fU mU * fCfU * fU * fG * fU * fA * fC | 1112 | UUCUGAAGGUGUUCUUGUAC | XXXXXXXOXOXOXOXXXXX |
| WV-9132 | fU * fU * fC * fU * fG * fA * mAfG * mGfU * mGfU * mUfC * fU * fU * fG * fU * fA * fC | 1113 | UUCUGAAGGUGUUCUUGUAC | XXXXXXOXOXOXOXXXXXX |
| WV-9133 | fU * fU * fC * fU * fG * fA * fA * mG * fG * mU * fG * mU * fU * mC * fU * fU * fG * fU * fA * fC | 1114 | UUCUGAAGGUGUUCUUGUAC | XXXXX XXXXX XXXXX XXXX |
| WV-9134 | fU * fU * fC * fU * fG * fA * fA * mGfG * mUfG * mUfU * mCfU * fG * fG * fU * fA * fC | 1115 | UUCUGAAGGUGUUCUUGUAC | XXXXXXXOXOXOXOXXXXX |
| WV-9135 | fU * fU * fC * fU * fG * fA * fA mG * fG mU * fG mU * fU mC * fU * fU * fG * fU * fA * fC | 1116 | UUCUGAAGGUGUUCUUGUAC | XXXXXXOXOXOXOXXXXXX |
| WV-9136 | Teo * Teo * m5Ceo * Teo * Geo * Aeo * Aeo * Geo * Geo * Teo * Geo * Teo * Teo * m5Ceo * fU * fU * fG * fU * fA * fC | 1117 | TTCTGAAGGTGTTCUUGUAC | XXXXX XXXXX XXXXX XXXX |
| WV-9137 | mU * mU * mC * mU * mG * Aeo * Aeo * Geo * Geo * Teo * Geo * Teo * Teo * m5Ceo * fU * fU * fG * fU * fA * fC | 1118 | UUCUGAAGGTGTTCUUGUAC | XXXXX XXXXX XXXXX XXXX |
| WV-9138 | mU * mU * mC * mU * mG * mA * Aeo * Geo * Geo * Teo * Geo * Teo * Teo * m5Ceo * fU * fU * fG * fU * fA * fC | 1119 | UUCUGAAGGTGTTCUUGUAC | XXXXX XXXXX XXXXX XXXX |
| WV-9139 | fC * fU * fC * fC * fG * fG * Teo * Teo * m5Ceo * Teo * Geo * Aeo * Aeo * Geo * fG * fU * fG * fU * fU * fC | 1120 | CUCCGGTTCTGAAGGUGUUC | XXXXX XXXXX XXXXX XXXX |
| WV-9140 | fC * fU * fC * fC * fG * fG * Teo * Teo m5Ceo * TeoGeo * AeoAeo * GeofG * fU * fG * fU * fU * fC | 1121 | CUCCGGTTCTGAAGGUGUUC | XXXXXXXOXOXOXOXXXXX |
| WV-9141 | fC * fU * fC * fC * fG * fG * TeoTeo * m5CeoTeo * GeoAeo * AeoGeo * fG * fU * fG * fU * fU * fC | 1122 | CUCCGGTTCTGAAGGUGUUC | XXXXXXOXOXOXOXXXXXX |
| WV- | fC * fU * fC * fC * fG * fG * Teo * mU * m5Ceo * mU * Geo * mA * Aeo * | 1123 | CUCCGGTUCUGAAGG | XXXXX XXXXX |

TABLE A1-continued

| | | | | |
|---|---|---|---|---|
| 9142 | mG * fG * fU * fG * fU * fU * fC | | UGUUC | XXXXX XXXX |
| WV-9143 | fC * fU * fC * fC * fG * fG * Teo * mU m5Ceo * mUGeo * mAAeo * mGfG * fU * fG * fU * fU * fU | 1124 | CUCCGGTUCUGAAGG UGUUC | XXXXXXXOXOXO XOXXXXX |
| WV-9144 | fC * fU * fC * fC * fG * fG * Teo mU * m5Ceo mU * Geo mA * Aeo mG * fG * fU * fG * fU * fU * fC | 1125 | CUCCGGTUCUGAAGG UGUUC | XXXXXXOXOXOX OXXXXXX |
| WV-9145 +p | fC * fU * fC * fC * fG * fG * mU * Teo * mC * Teo * mG * Aeo * mA * Geo * fG * fU * fG * fU * fU * fU | 1126 | CUCCGGUTCTGAAGG UGUUC | XXXXX XXXXX XXXXX XXXX |
| WV-9146 | fC * fU * fC * fC * fG * fG * mU * Teo mC * Teo mG * Aeo mA * GeofG * fU * fG * fU * fU * fC | 1127 | CUCCGGUTCTGAAGG UGUUC | XXXXXXXOXOXO XOXXXXX |
| WV-9147 | fC * fU * fC * fC * fG * fG * mUTeo * mCTeo * mGAeo * mAGeo * fG * fU * fG * fU * fU * fC | 1128 | CUCCGGUTCTGAAGG UGUUC | XXXXXXOXOXOX OXXXXXX |
| WV-9148 | fC * fU * fC * fC * fG * fG * Teo * fU * m5Ceo * fU * Geo * fA * Aeo * fG * fG * fU * fG * fU * fU * fC | 1129 | CUCCGGTUCUGAAGG UGUUC | XXXXX XXXXX XXXXX XXXX |
| WV-9149 | fC * fU * fC * fC * fG * fG * Teo * fU m5Ceo * fUGeo * fAAeo * fGfG * fU * fG * fU * fU * fC | 1130 | CUCCGGTUCUGAAGG UGUUC | XXXXXXXOXOXO XOXXXXX |
| WV-9150 | fC * fU * fC * fC * fG * fG * TeofU * m5CeofU * GeofA * AeofG * fG * fU * fG * fU * fU * fC | 1131 | CUCCGGTUCUGAAGG UGUUC | XXXXXXOXOXOX OXXXXXX |
| WV-9151 | fC * fU * fC * fC * fG * fG * fU * Teo * fC * Teo * fG * Aeo * fA * Geo * fG * fU * fG * fU * fU * fC | 1132 | CUCCGGUTCTGAAGG UGUUC | XXXXX XXXXX XXXXX XXXX |
| WV-9152 | fC * fU * fC * fC * fG * fG * fU * TeofC * TeofG * AeofA * GeofG * fU * fG * fU * fU * fC | 1133 | CUCCGGUTCTGAAGG UGUUC | XXXXXXXOXOXO XOXXXXX |
| WV-9153 | fC * fU * fC * fC * fG * fG * fUTeo * fCTeo * fGAeo * fAGeo * fG * fU * fG * fU * fU * fC | 1134 | CUCCGGUTCTGAAGG UGUUC | XXXXXXOXOXOX OXXXXXX |
| WV-9154 | fC * fU * fC * fC * fG * fG * mU * fU * mC * fU * mG * fA * mA * fG * fG * fU * fG * fU * fU * fC | 1135 | CUCCGGUUCUGAAGG UGUUC | XXXXX XXXXX XXXXX XXXX |
| WV-9155 | fC * fU * fC * fC * fG * fG * mU * fU mC * fU mG * fA mA * fGfG * fU * fG * fU * fU * fC | 1136 | CUCCGGUUCUGAAGG UGUUC | XXXXXXXOXOXO XOXXXXX |
| WV 9156 | fC * fU * fC * fC * fG * fG * mUfU * mCfU * mGfA * mAfG * fG * fU * fG * fU * fU * fC | 1137 | CUCCGGUUCUGAAGG UGUUC | XXXXXXOXOXOX OXXXXXX |
| WV-9157 | fC * fU * fC * fC * fG * fG * fU * mU * fC * mU * fG * mA * fA * mG * fG * fU * fG * fU * fU * fC | 1138 | CUCCGGUUCUGAAGG UGUUC | XXXXX XXXXX XXXXX XXXX |
| WV-9158 | fC * fU * fC * fC * fG * fG * fU * mUfC * mUfG * mAfA * mGfG * fU * fG * fU * fU * fC | 1139 | CUCCGGUUCUGAAGG UGUUC | XXXXXXXOXOXO XOXXXXX |
| WV-9159 | fC * fU * fC * fC * fG * fG * fU mU * fC mU * fG mA * fA mG * fG * fU * fG * fU * fU * fC | 1140 | CUCCGGUUCUGAAGG UGUUC | XXXXXXOXOXOX OXXXXXX |

TABLE A1-continued

| | | | | |
|---|---|---|---|---|
| WV-9160 | m5Ceo * Teo * m5Ceo * m5Ceo * Geo * Geo * Teo * Teo * 5Ceo * Teo * Geo * Aeo * Aeo * Geo * fG * fU * fG * fU * fU * fC | 1141 | CTCCGGTTCTGAAGG UGUUC | XXXXX XXXXX XXXXX XXXX |
| WV-9161 | mC * mU * mC * mC * mG * Geo * Teo * Teo * m5Ceo * Teo * Geo * Aeo * Aeo * Geo * fG * fU * fG * fU * fU * fC | 1142 | CUCCGGTTCTGAAGG UGUUC | XXXXX XXXXX XXXXX XXXX |
| WV-9162 | mC * mU * mC * mC * mG * mG * Teo * Teo * m5Ceo * Teo * Geo * Aeo * Aeo * Geo * fG * fU * fG * fU * fU * fC | 1143 | CUCCGGTTCTGAAGG UGUUC | XXXXX XXXXX XXXXX XXXX |
| WV-9163 | fU * fC * fU * fU * fG * fG * m5Ceo * m5Ceo * Aeo * Teo * m5Ceo * Teo * m5Ceo * m5Ceo * fU * fU * fC * fA * fC * fA | 1144 | UCUUGGCCATCTCCU UCACA | XXXXX XXXXX XXXXX XXXX |
| WV-9164 | fU * fC * fU * fG * fG * fG * m5Ceo * m5CeoAeo * Teo m5Ceo * Teo m5Ceo * m5CeofU * fU * fC * fA * fC * fA | 1145 | UCUUGGCCATCTCCU UCACA | XXXXXXXOXOXO XOXXXXX |
| WV-9165 | fU * fC * fU * fU * fG * fG * m5Ceo m5Ceo * AeoTeo * m5CeoTeo * m5Ceo m5Ceo * fU * fU * fC * fA * fC * fA | 1146 | UCUUGGCCATCTCCU UCACA | XXXXXXOXOXOX OXXXXXX |
| WV-9166 | fU * fC * fU * fU * fG * fG * m5Ceo * mC * Aeo * mU * m5Ceo * mU * m5Ceo * mC * fU * fU * fC * fA * fC * fA | 1147 | UCUUGGCCAUCUCCU UCACA | XXXXX XXXXX XXXXX XXXX |
| WV-9167 | fU * fC * fU * fU * fG * fG * m5Ceo * mCAeo * mU m5Ceo * mU m5Ceo * mCfU * fU * fC * fA * fC * fA | 1148 | UCUUGGCCAUCUCCU UCACA | XXXXXXXOXOXO XOXXXXX |
| WV-9168 | fU * fC * fU * fU * fG * fG * m5Ceo mC * Aeo mU * m5Ceo mU * m5Ceo mC * fU * fU * fC * fA * fC * fA | 1149 | UCUUGGCCAUCUCCU UCACA | XXXXXXOXOXOX OXXXXXX |
| WV-9169 | fU * fC * fU * fU * fg * fG * mC * m5Ceo * mA * Teo * mC * Teo * mC * m5Ceo * fU * fU * fC * fA * fC * fA | 1150 | UCUUGGCCATCTCCU UCACA | XXXXX XXXXX XXXXX XXXX |
| WV-9170 | fU * fC * fU * fU * fG * fG * mC * m5Ceo mA * Teo mC * Teo mC * m5CeofU * fU * fC * fA * fC * fA | 1151 | UCUUGGCCATCTCCU UCACA | XXXXXXXOXOXO XOXXXXX |
| WV-9171 | fU * fC * fU * fU * fG * fG * mC m5Ceo * mATeo * mcTeo * mC m5Ceo * fU * fU * fC * fA * fC * fA | 1152 | UCUUGGCCATCTCCU UCACA | XXXXXXOXOXOX OXXXXXX |
| WV-9172 | fU * fC * fU * fU * fG * fG * m5Ceo * fC * Aeo * fU * m5Ceo * fU * m5Ceo * fC * fU * fU * fC * fA * fC * fA | 1153 | UCUUGGCCAUCUCCU UCACA | XXXXX XXXXX XXXXX XXXX |
| WV-9173 | fU * fC * fU * fU * fG * fG * m5Ceo * fCAeo * fU m5Ceo * fU m5Ceo * fCfU * fU * fC * fA * fC * fA | 1154 | UCUUGGCCAUCUCCU UCACA | XXXXXXXOXOXO XOXXXXX |
| WV-9174 | fU * fC * fU * fU * fG * fG * m5CeofC * AeofU * m5CeofU * m5CeofC * fU * fU * fC * fA * fC * fA | 1155 | UCUUGGCCAUCUCCU UCACA | XXXXXXOXOXOX OXXXXXX |
| WV-9175 | fU * fC * fU * fU * fG * fG * fC * m5Ceo * fA * Teo * fC * Teo * fC * m5Ceo * fU * fU * fC * fA * fC * fA | 1156 | UCUUGGCCATCTCCU UCACA | XXXXX XXXXX XXXXX XXXX |
| WV-9176 | fU * fC * fU * fU * fG * fG * fC * m5CeofA * TeofC * TeofC * m5CeofU * fU * fC * fA * fC * fA | 1157 | UCUUGGCCATCTCCU UCACA | XXXXXXXOXOXO XOXXXXX |
| WV-9177 | fU * fC * fU * fU * fG * fG * fC m5Ceo * fATeo * fCTeo * fC m5Ceo * fU * fU * fC * fA * fC * fA | 1158 | UCUUGGCCATCTCCU UCACA | XXXXXXOXOXOX OXXXXXX |

TABLE A1-continued

| | | | | |
|---|---|---|---|---|
| WV-9178 | fU * fC * fU * fU * fG * fG * mC * fC * mA * fU * mC * fU * mC * fC * fU * fU * fC * fA * fC * fA | 1159 | UCUUGGCCAUCUCCU UCACA | XXXXX XXXXX XXXXX XXXX |
| WV-9179 | fU * fC * fU * fU * fG * fG * mC * fC mA * fG mC * fU mC * fCfU * fU * fC * fA * fC * fA | 1160 | UCUUGGCCAUCUCCU UCACA | XXXXXXXOXOXO XOXXXXX |
| WV-9180 | fU * fC * fU * fU * fG * fG * mCfC * mAfU * mCfU * mCfC * fU * fG * fC * fA * fC * fA | 1161 | UCUUGGCCAUCUCCU UCACA | XXXXXXOXOXOX OXXXXXX |
| WV-9181 | fU * fC * fU * fu * fG * fG * fC * mC * fA * mU * fC * mU * fC * mC * fU * fU * fC * fA * fC * fA | 1162 | UCUUGGCCAUCUCCU UCACA | XXXXX XXXXX XXXXX XXXX |
| WV-9182 | fU * fC * fU * fU * fG * fG * fC * mCfA * mUfC * mUfC * mCfU * fU * fC * fA * fC * fA | 1163 | UCUUGGCCAUCUCCU UCACA | XXXXXXXOXOXO XOXXXXX |
| WV-9183 | fU * fC * fU * fU * fG * fG * fC mC * fA mU * fC mU * fC mC * fU * fU * fC * fA * fC * fA | 1164 | UCUUGGCCAUCUCCU UCACA | XXXXXXOXOXOX OXXXXXX |
| WV-9184 | Teo * m5Ceo * Teo * Teo * Geo * Geo * m5Ceo * m5Ceo * Aeo * Teo * m5Ceo * Teo * m5Ceo * m5Ceo * fU * fU * fC * fA * fC * fA | 1165 | TCTTGGCCATCTCCUU CACA | XXXXX XXXXX XXXXX XXXX |
| WV-9185 | mU * mC * mU * mU * mG * Geo * m5Ceo * m5Ceo * Aeo * Teo * m5Ceo * Teo * m5Ceo * m5Ceo * fU * fU * fC * fA * fC * fA | 1166 | UCUUGGCCATCTCCU UCACA | XXXXX XXXXX XXXXX XXXX |
| WV-9186 | mU * mC * mU * mU * mG * mG * m5Ceo * m5Ceo * Aeo * Teo * m5Ceo * Teo * m5Ceo * m5Ceo * fU * fU * fC * fA * fC * fA | 1167 | UCUUGGCCATCTCCU UCACA | XXXXX XXXXX XXXXX XXXX |
| WV-9187 | fU * fU * fU * fC * fU * fU * Geo * Geo * m5Ceo * m5Ceo * Aeo * Teo * m5Ceo * Teo * fC * fC * fU * fU * fC * fA | 1168 | UUUCUUGGCCATCTC CUUCA | XXXXX XXXXX XXXXX XXXX |
| WV-9188 | fU * fU * fU * fC * fU * fU * Geo * Geo m5Ceo * m5CeoAeo * Teo m5Ceo * TeofC * fC * fU * fU * fC * fA | 1169 | UUUCUUGGCCATCTC CUUCA | XXXXXXXOXOXO XOXXXXX |
| WV-9189 | fU * fU * fU * fC * fU * fU * GeoGeo * m5Ceo m5Ceo * AeoTeo * m5CeoTeo * fC * fC * fU * fU * fC * fA | 1170 | UUUCUUGGCCATCTC CUUCA | XXXXXXOXOXOX OXXXXXX |
| WV-9190 | fU * fU * fU * fC * fU * fU * Geo * mG * m5Ceo * mC * Aeo * mU * m5Ceo * mU * fC * fC * fU * fU * fC * fA | 1171 | UUUCUUGGCCAUCUC CUUCA | XXXXX XXXXX XXXXX XXXX |
| WV-9191 | fU * fU * fU * fC * fU * fU * Geo * mG m5Ceo * mCAeo * mU m5Ceo * mUfC * fC * fU * fU * fC * fA | 1172 | UUUCUUGGCCAUCUC CUUCA | XXXXXXXOXOXO XOXXXXX |
| WV-9192 | fU * fU * fU * fC * fU * fU * Geo mG * m5Ceo mC * Aeo mU * m5Ceo mU * fC * fC * fU * fU * fC * fA | 1173 | UUUCUUGGCCAUCUC CUUCA | XXXXXXOXOXOX OXXXXXX |
| WV-9193 | fU * fU * fU * fC * fU * fU * mG * Geo * mC * m5Ceo * mA * Teo * mC * Teo * fC * fC * fU * fU * fC * fA | 1174 | UUUCUUGGCCATCTC CUUCA | XXXXX XXXXX XXXXX XXXX |
| WV-9194 | fU * fU * fU * fC * fU * fG * mG * Geo mC * m5Ceo mA * Teo mC * TeofC * fC * fU * fU * fC * fA | 1175 | UUUCUUGGCCATCTC CUUCA | XXXXXXXOXOXO XOXXXXX |
| WV- | fU * fU * fU * fC * fU * fU * mGGeo * mC m5Ceo * mATeo * mCTeo * fC * | 1176 | UUUCUUGGCCATCTC | XXXXXXOXOXOX |

TABLE A1-continued

| | | | | |
|---|---|---|---|---|
| 9195 | fC * fU * fU * fC * fA | | CUUCA | OXXXXXX |
| WV-9196 | fU * fU * fU * fC * fU * fU * Geo * fG * m5Ceo * fC * Aeo * fU * m5Ceo * fU * fC * fC * fU * fU * fC * fA | 1177 | UUUCUUGGCCAUCUC CUUCA | XXXXX XXXXX XXXXX XXXX |
| WV-9197 | fU * fU * fU * fC * fU * fU * Geo * fG m5Ceo * fCAeo * fU m5Ceo * fUfC * fC * fU * fU * fC * fA | 1178 | UUUCUUGGCCAUCUC CUUCA | XXXXXXXOXOXO XOXXXXX |
| WV-9198 | fU * fU * fU * fC * fU * fU * GeofG * m5CeofC * AeofU * m5CeofU * fC * fC * fU * fU * fC * fA | 1179 | UUUCUUGGCCAUCUC CUUCA | XXXXXXOXOXOX OXXXXXX |
| WV-9199 | fU * fU * fU * fC * fU * fU * fG * Geo * fC * m5Ceo * fA * Teo * fC * Teo * fC * fC * fU * fU * fC * fA | 1180 | UUUCUUGGCCATCTC CUUCA | XXXXX XXXXX XXXXX XXXX |
| WV-9200 | fU * fU * fU * fC * fU * fU * fG * GeofC * m5CeofA * TeofC * TeofC * fC * fU * fU * fC * fA | 1181 | UUUCUUGGCCATCTC CUUCA | XXXXXXXOXOXO XOXXXXX |
| WV-9201 | fU * fU * fU * fC * fU * fU * fGGeo * fC m5Ceo * fATeo * fCTeo * fC * fC * fU * fU * fC * fA | 1182 | UUUCUUGGCCATCTC CUUCA | XXXXXXOXOXOX OXXXXXX |
| WV-9202 | fU * fU * fU * fC * fU * fU * mG * fG * mC * fC * mA * fU * mC * fU * fC * fC * fU * fU * fC * fA | 1183 | UUUCUUGGCCAUCUC CUUCA | XXXXX XXXXX XXXXX XXXX |
| WV-9203 | fU * fU * fU * fC * fU * fU * mG * fG mC * fC mA * fU mC * fUfC * fC * fU * fU * fC * fA | 1184 | UUUCUUGGCCAUCUC CUUCA | XXXXXXXOXOXO XOXXXXX |
| WV-9204 | fU * fU * fU * fC * fU * fU * mGfG * mCfC * mAfU * mCfU * fC * fC * fU * fU * fC * fA | 1185 | UUUCUUGGCCAUCUC CUUCA | XXXXXXOXOXOX OXXXXXX |
| WV-9205 | fU * fU * fU * fC * fU * fU * fG * mG * fC * mC * fA * mU * fC * mU * fC * fC * fU * fU * fC * fA | 1186 | UUUCUUGGCCAUCUC CUUCA | XXXXX XXXXX XXXXX XXXX |
| WV-9206 | fU * fU * fU * fC * fU * fU * fG * mGfC * mCfA * mUfC * mUfC * fC * fU * fU * fC * fA | 1187 | UUUCUUGGCCAUCUC CUUCA | XXXXXXXOXOXO XOXXXXX |
| WV-9207 | fU * fU * fU * fC * fU * fU * fG mG * fC mC * fA mU * fC mU * fC * fC * fU * fU * fC * fA | 1188 | UUUCUUGGCCAUCUC CUUCA | XXXXXXOXOXOX OXXXXXX |
| WV-9208 | Teo * Teo * Teo * m5Ceo * Teo * Teo * Geo * Geo * m5Ceo * m5Ceo * Aeo * Teo * m5Ceo * Teo * fC * fC * fU * fU * fC * fA | 1189 | TTTCTTGGCCATCTCC UUCA | XXXXX XXXXX XXXXX XXXX |
| WV-9209 | mU * mU * mU * mC * mU * Teo * Geo * Geo * m5Ceo * m5Ceo * Aeo * Teo * m5Ceo * Teo * fC * fC * fU * fU * fC * fA | 1190 | UUUCUTGGCCATCTC CUUCA | XXXXX XXXXX XXXXX XXXX |
| WV-9210 | mU * mU * mU * mC * mU * mU * Geo * Geo * m5Ceo * m5Ceo * Aeo * Teo * m5Ceo * Teo * fC * fC * fU * fU * fC * fA | 1191 | UUUCUUGGCCATCTC CUUCA | XXXXX XXXXX XXXXX XXXX |
| WV-9222 | Teo * S m5Ceo * SAeo * SAeo * SGeo * SGeo * SAeofA * SGeoAeo * SfU * SGeoGeofC * SfA * SfU * SfU * SfU * SfC * SfU | 1192 | TCAAGGAAGAUGGCA UUUCU | SSSSSSOSOSSOOS SSSSS |
| WV-9223 | Teo * S m5Ceo * SAeo * SAeo * SGeo * SGeo * SAeoAeo * SGeoAeo * STeo * SGeoGeo m5Ceo * SfA * SfU * SfU * SfU * SfC * SfU | 1193 | TCAAGGAAGATGGCA UUUCU | SSSSSSOSOSSOOS SSSSS |

TABLE A1-continued

| | | | | |
|---|---|---|---|---|
| WV-9224 | Teo * S m5Ceo * SAeo * SAeo * SGeo * SGeo * SAeo * SAeo * SGeo * SAeo * STeo * SGeo * SGeo * S m5Ceo * SfA * SfU * SfU * SfU * SfC * SfU | 1194 | TCAAGGAAGATGGCA UUUCU | SSSSSSSSSSSSSS SSSS |
| WV-9225 | Teo * m5Ceo * Aeo * Aeo * Geo * Geo * AeofA * GeoAeo * fU * GeoGeofC * fA * fU * fU * fU * fC * fU | 1195 | TCAAGGAAGAUGGCA UUUCU | XXXXXXOXOXXO OXXXXXX |
| WV-9226 | Teo * m5Ceo * Aeo * Aeo * Geo * Geo * AeoAeo * GeoAeo * Teo * GeoGeo m5Ceo * fA * fU * fU * fU * fC * fU | 1196 | TCAAGGAAGATGGCA UUUCU | XXXXXXOXOXXO OXXXXXX |
| WV-9227 | fU * fC * fA * fA * fG * fG * AeofA * GeoAeo * fU * GeoGeofC * fA * fU * fU * fU * fC * fU | 1197 | UCAAGGAAGAUGGCA UUUCU | XXXXXXOXOXXO OXXXXXX |
| WV-9408 | fU * SfU * SfU * SfU * SfG * SfG * S mC * S mA * S mG * S mC * S mU * S mU * S mU * S mC * SfC * SfA * SfC * SfC * SfA * SfA | 1198 | UUUUGGCAGCUUUCC ACCAA | SSSSSSSSSSSSSS SSSS |
| WV-9409 | fU * SfU * SfU * SfU * SfG * SfG * S mC * SfA * S mG * S mC * SfU * S mU * S mU * SfC * SfC * SfA * SfC * SfC * SfA * SfA | 1199 | UUUUGGCAGCUUUCC ACCAA | SSSSSSSSSSSSSS SSSS |
| WV-9410 | fU * SfU * SfU * SfU * SfG * SfG * S m5Ceo * SfA * SGeo * S m5Ceo * SfU * STeo * STeo * SfC * SfC * SfA * SfC * SfC * SfA * SfA | 1200 | UUUUGGCAGCUTTCC ACCAA | SSSSSSSSSSSSSS SSSS |
| WV-9411 | fU * SfU * SfU * SfU * SfG * SfG * S mCfA * S mG mC * SfU * S mU mUfC * SfC * SfA * SfC * SfC * SfA * SfA | 1201 | UUUUGGCAGCUUUCC ACCAA | SSSSSSOSOSSOOS SSSSS |
| WV-9412 | fU * SfU * SfU * SfU * SfG * SfG * S m5CeofA * SGeo m5Ceo * SfU * STeoTeofC * SfC * SfA * SfC * SfC * SfA * SfA | 1202 | UUUUGGCAGCUTTCC ACCAA | SSSSSSOSOSSOOS SSSSS |
| WV-9413 | fU * SfU * SfU * SfU * SfG * SfG * S m5CeofA * S mG m5Ceo * SfU * STeoTeofC * SfC * SfA * SfC * SfC * SfA * SfA | 1203 | UUUUGGCAGCUTTCC ACCAA | SSSSSSOSOSSOOS SSSSS |
| WV-9414 | fU * SfU * SfU * SfU * SfG * SfG * S m5CeofA * S mG mC * SfU * STeoTeofC * SfC * SfA * SfC * SfC * SfA * SfA | 1204 | UUUUGGCAGCUTTCC ACCAA | SSSSSSOSOSSOOS SSSSS |
| WV-9415 | fU * fU * fU * fU * fG * fG * mC * fA * mG * mC * fU * mU * mU * fC * fC * fA * fC * fC * fA * fA | 1205 | UUUUGGCAGCUUUCC ACCAA | XXXXX XXXXX XXXXX XXXX |
| WV-9416 | fU * fU * fU * fU * fG * fG * m5Ceo * fA * Geo * m5Ceo * fU * Teo * Teo * fC * fC * fA * fC * fC * fA * fA | 1206 | UUUUGGCAGCUUUCC ACCAA | XXXXX XXXXX XXXXX XXXX |
| WV-9417 | fU * fU * fU * fU * fG * fG * mCfA * mG mC * fU * mU mUfC * fC * fA * fC * fC * fA * fA | 1207 | UUUUGGCAGCUUUCC ACCAA | XXXXXXOXOXXO OXXXXXX |
| WV-9418 | fU * fU * fU * fU * fG * fG * m5CeofA * Geo m5Ceo * fU * TeoTeofC * fC * fA * fC * fC * fA * fA | 1208 | UUUUGGCAGCUTTCC ACCAA | XXXXXXOXOXXO OXXXXXX |
| WV-9419 | fU * fU * fU * fU * fG * fG * m5CeofA * mG m5Ceo * fU * TeoTeofC * fC * fA * fC * fC * fA * fA | 1209 | UUUUGGCAGCUTTCC ACCAA | XXXXXXOXOXXO OXXXXXX |
| WV-942 | mU * mC * mA * mA * mG * mG * mA * mA * mG * mA * mU * mG * mG * mC * mA * mU * mU * mU * mC * mU | 1210 | UCAAGGAAGAUGGCA UUUCU | XXXXX XXXXX XXXXX XXXX |
| WV-9420 | fU * fU * fU * fU * fG * fG * m5CeofA * mG mC * fU * TeoTeofC * fC * fA * fC * fC * fA * fA | 1211 | UUUUGGCAGCUTTCC ACCAA | XXXXXXOXOXXO OXXXXXX |

TABLE A1-continued

| | | | | |
|---|---|---|---|---|
| WV-9422 | fC * SfU * SfC * SfC * SfG * SfG * S mUfU * S mC mU * SfG * S mA mAfG * SfG * SfU * SfG * SfU * SfU * SfC | 1212 | CUCCGGUUCUGAAGG UGUUC | SSSSSSOSOSSOOS SSSSS |
| WV-9423 | fC * SfU * SfC * SfC * SfG * SfG * STeofU * S m5CeoTeo * SfG * SAeoAeofG * SfG * SfU * SfG * SfU * SfU * SfC | 1213 | CUCCGGTUCTGAAGG UGUUC | SSSSSSOSOSSOOS SSSSS |
| WV-9424 | fC * SfU * SfC * SfC * SfG * SfG * STeofU * S m5CeoTeo * SfG * S mA mAfG * SfG * SfU * SfG * SfU * SfU * SfC | 1214 | CUCCGGTUCTGAAGG UGUUC | SSSSSSOSOSSOOS SSSSS |
| WV-9425 | fC * SfU * SfC * SfC * SfG * SfG * STeofU * S m5Ceo mU * SfG * S mA mAfG * SfG * SfU * SfG * SfU * SfU * SfC | 1215 | CUCCGGTUCUGAAGG UGUUC | SSSSSSOSOSSOOS SSSSS |
| WV-9426 | fC * fU * fC * fC * fG * fG * mUfU * mC mU * fG * mA mAfG * fG * fU * fG * fU * fU * fC | 1216 | CUCCGGUUCUGAAGG UGUUC | XXXXXXOXOXXO OXXXXXX |
| WV-9427 | fC * fU * fC * fC * fG * fG * TeofU * m5CeoTeo * fG * AeoAeofG * fG * fU * fG * fU * fU * fC | 1217 | CUCCGGTUCTGAAGG UGUUC | XXXXXXOXOXXO OXXXXXX |
| WV-9428 | fC * fU * fC * fC * fG * fG * TeofU * m5CeoTeo * fG * mA mAfG * fG * fU * fG * fU * fU * fC | 1218 | CUCCGGTUCTGAAGG UGUUC | XXXXXXOXOXXO OXXXXXX |
| WV-9429 | fC * fU * fC * fC * fG * fG * TeofU * m5Ceo mU * fG * mA mAfG * fG * fU * fG * fU * fU * fC | 1219 | CUCCGGTUCUGAAGG UGUUC | XXXXXXOXOXXO OXXXXXX |
| WV-943 | mG * mG * mC * mC * mA * mA * mA * mC * mC * mU * mC * mG * mG * mC * mU * mU * mA * mC * mC * mU | 1220 | GGCCAAACCUCGGCU UACCU | XXXXX XXXXX XXXXX XXXX |
| WV-9511 | fC * SfU * SfC * SfC * SfG * SfG * SfU * SfU * SfC * SfU * S mG mA mA mGfG * SfU * SfG * SfU * SfU * SfC | 1221 | CUCCGGUUCUGAAGG UGUUC | SSSSSSSSSSOOOO SSSSS |
| WV-9512 | fC * SfU * SfU * SfC * SfG * SfG * SfU * SfU * S mCfU * S mGfA * S mA mG mGfU * SfG * SfU * SfU * SfC | 1222 | CUCCGGUUCUGAAGG UGUUC | SSSSSSSSOSOSOO OSSSS |
| WV-9513 | fC * SfU * SfC * SfC * SfG * SfG * SfU * SfU * S mCfU * S mGfA * S mA mGfG * SfU * SfG * SfU * SfU * SfC | 1223 | CUCCGGUUCUGAAGG UGUUC | SSSSSSSSOSOSOO SSSSS |
| WV-9514 | fC * SfU * SfC * SfC * SfG * SfG * SfU * SfU * S mCfU * S mGfA * S mAfG * S mGfU * SfG * SfU * SfU * SfC | 1224 | CUCCGGUUCUGAAGG UGUUC | SSSSSSSSOSOSOS OSSSS |
| WV-9515 | fC * SfU * SfC * SfC * SfG * SfG * SfU * SfU * S mCfU * S mGfA * SfA * S mG mGfU * SfG * SfU * SfU * SfC | 1225 | CUCCGGUUCUGAAGG UGUUC | SSSSSSSSOSOSSO OSSSS |
| WV-9516 | fC * SfU * SfC * SfC * SfG * SfG * SfU * SfU * S mCfU * S mG * SfA * S mA mG mGfU * SfG * SfU * SfU * SfC | 1226 | CUCCGGUUCUGAAGG UGUUC | SSSSSSSSOSSSOO OSSSS |
| WV-9517 | fC * SfU * SfC * SfC * SfG * SfG * SfU * SfU * S mCfU * S mG * SfA * S mA mGfG * SfU * SfG * SfU * SfU * SfC | 1227 | CUCCGGUUCUGAAGG UGUUC | SSSSSSSSOSSSOO SSSSS |
| WV-9518 | fC * SfU * SfC * SfC * SfG * SfG * SfU * SfU * S mCfU * S mG * SfA * S mAfG * S mGfU * SfG * SfU * SfU * SfC | 1228 | CUCCGGUUCUGAAGG UGUUC | SSSSSSSSOSSSOS OSSSS |
| WV- | fC * SfU * SfC * SfC * SfG * SfG * SfU * SfU * S mCfU * S mG * SfA * SfA * | 1229 | CUCCGGUUCUGAAGG | SSSSSSSSOSSSSO |

TABLE A1-continued

| | | | | |
|---|---|---|---|---|
| 9519 | S mG mGfU * SfG * SfU * SfU * SfC | | UGUUC | OSSSS |
| WV-9520 | fC * SfU * SfC * SfC * SfG * SfG * SfU * SfU * S mCfU * SfG * SfA * S mA mG mGfU * SfG * SfU * SfU * SfC | 1230 | CUCCGGUUCUGAAGG UGUUC | SSSSSSSSOSSSOO OSSSS |
| WV-9521 | fC * SfU * SfC * SfC * SfG * SfG * SfU * SfU * S mCfU * SfG * SfA * S mA mGfG * SfU * SfG * SfU * SfU * SfU | 1231 | CUCCGGUUCUGAAGG UGUUC | SSSSSSSSOSSSOO SSSSS |
| WV-9522 | fC * SfU * SfC * SfC * SfG * SfG * SfU * SfU * S mCfU * SfG * SfA * S mAfG * S mGfU * SfG * SfU * SfU * SfC | 1232 | CUCCGGUUCUGAAGG UGUUC | SSSSSSSSOSSSOS OSSSS |
| WV-9523 | fC * SfU * SfC * SfC * SfG * SfG * SfU * SfU * S mCfU * SfG * SfA * SfA * S mG mGfU * SfG * SfU * SfU * SfC | 1233 | CUCCGGUUCUGAAGG UGUUC | SSSSSSSSOSSSSO OSSSS |
| WV-9524 | fC * SfU * SfC * SfC * SfG * SfG * S mUfU * S mCfU * S mGfA * S mAfG * SfG * SfU * SfG * SfU * SfU * SfC | 1234 | CUCCGGUUCUGAAGG UGUUC | SSSSSSOSOSOSOS SSSSS |
| WV-9525 | fC * SfU * SfC * SfC * SfG * SfG * SfU * mUfC * mUfG * mAfA * mGfG * SfU * SfG * SfU * SfU * SfC | 1235 | CUCCGGUUCUGAAGG UGUUC | SSSSSSXOXOXOX OSSSSS |
| WV-9534 | fC * SfU * SfC * SfC * SfG * SfG * SfU * S mUfC * S mUfG * S mAfA * S mGfG * SfU * SfG * SfU * SfU * SfC | 1236 | CUCCGGUUCUGAAGG UGUUC | SSSSSSSOSOSOSO SSSSS |
| WV-9535 | fC * SfU * SfC * SfC * SfG * S mG * SfU * SfU * S mCfU * SfG * SfA * S mA mG mGfU * SfG * SfU * SfU * SfC | 1237 | CUCCGGUUCUGAAGG UGUUC | SSSSSSSSOSSSOO OSSSS |
| WV-9536 | fC * SfU * SfC * SfC * SfG * S mG * SfU * SfU * S mCfU * SfG * SfA * S mA mGfG * SfU * SfG * SfU * SfU * SfC | 1238 | CUCCGGUUCUGAAGG UGUUC | SSSSSSSSOSSSOO SSSSS |
| WV-9537 | fC * SfU * SfC * SfC * SfG * S mG * SfU * SfU * S mCfU * SfG * SfA * S mAfG * S mGfU * SfG * SfU * SfU * SfC | 1239 | CUCCGGUUCUGAAGG UGUUC | SSSSSSSSOSSSOS OSSSS |
| WV-9538 | fC * SfU * SfC * SfC * SfG * S mG * SfU * SfU * S mCfU * SfG * SfA * SfA * S mG mGfU * SfG * SfU * SfU * SfC | 1240 | CUCCGGUUCUGAAGG UGUUC | SSSSSSSSOSSSSO OSSSS |
| WV-9539 | fC * SfU * SfC * SfC * SfG * S mG * SfU * SfU * SfC * SfU * S mG mA mA mGfG * SfU * SfG * SfU * SfU * SfC | 1241 | CUCCGGUUCUGAAGG UGUUC | SSSSSSSSSSOOOO SSSSS |
| WV-9540 | Teo * SfC * SfA * SfA * SfG * SfG * S mAfA * S mG mA * SfU * S mG mGfC * SfA * SfU * SfU * SfU * SfC * SfU | 1242 | TCAAGGAAGAUGGCA UUUCU | SSSSSSOSOSSOOS SSSSS |
| WV-9541 | Teo * RfC * SfA * SfA * SfG * SfG * S mAfA * S mG mA * SfU * S mG mGfU * SfA * SfU * SfU * SfU * SfC * SfU | 1243 | TCAAGGAAGAUGGCA UUUCU | RSSSSSOSOSSOOS SSSSS |
| WV-9594 | fA * fA * fU * fA * fU * fU * mC * mU * mU * mC * mU * mA * mA * mA * mG * mA * mA * mA * mG * fC * fU * fU * fA * fA * fA | 1244 | AAUAUUCUUCUAAA GAAAGCUUAAA | XXXXX XXXXX XXXXX XXXXX XXXX |
| WV-9595 | fU * fC * fU * fU * fC * fU * mA * mA * mA * mG * mA * mA * mA * mG * mC * mU * mU * mA * mA * fA * fA * fA * fG * fU * fC | 1245 | UCUUCUAAAGAAAG CUUAAAAAGUC | XXXXX XXXXX XXXXX XXXXX XXXX |
| WV- | fU * fA * fA * fA * fG * fA * mA * mA * mG * mC * mU * mU * mA * | 1246 | UAAAGAAAGCUUAA | XXXXX XXXXX |

TABLE A1-continued

| | | | | |
|---|---|---|---|---|
| 9596 | mA * mA * mA * mA * mG * mU * fC * fU * fG * fC * fU * fA | | AAAGUCUGCUA | XXXXX XXXXX XXXX |
| WV-9597 | fA * fA * fA * fG * fC * fU * mU * mA * mA * mA * mA * mA * mG * mU * mC * mU * mG * mC * mU * fA * fA * fA * fA * fU * fG | 1247 | AAAGCUUAAAAAGUC UGCUAAAAUG | XXXXX XXXXX XXXXX XXXXX XXXX |
| WV-9598 | fU * fU * fA * fA * fA * fA * mA * mG * mU * mC * mU * mG * mC * mU * mA * mA * mA * mA * mU * fG * fU * fU * fU * fU * fC | 1248 | UUAAAAAGUCUGCUA AAAUGUUUUC | XXXXX XXXXX XXXXX XXXXX XXXX |
| WV-9599 | fA * fA * fG * fU * fC * fU * mG * mC * mU * mA * mA * mA * mA * mU * mG * mU * mU * mU * mU * fC * fA * fU * fU * fC * fC | 1249 | AAGUCUGCUAAAAUG UUUUCAUUCC | XXXXX XXXXX XXXXX XXXXX XXXX |
| WV-9600 | fU * fG * fC * fU * fA * fA * mA * mA * mU * mG * mU * mU * mU * mU * mC * mA * mU * mU * mC * fC * fU * fA * fU * fU * fA | 1250 | UGCUAAAAUGUUUUC AUUCCUAUUA | XXXXX XXXXX XXXXX XXXXX XXXX |
| WV-9601 | fA * fA * fA * fU * fG * fU * mU * mU * mU * mC * mA * mU * mU * mC * mC * mU * mA * mU * mU * fA * fG * fA * fU * fC * fU | 1251 | AAAUGUUUUCAUUCC UAUUAGAUCU | XXXXX XXXXX XXXXX XXXXX XXXX |
| WV-9602 | fU * fU * fU * fU * fC * fA * mU * mU * mC * mC * mU * mA * mU * mU * mA * mG * mA * mU * mC * fU * fG * fU * fC * fG * fC | 1252 | UUUUCAUUCCUAUUA GAUCUGUCGC | XXXXX XXXXX XXXXX XXXXX XXXX |
| WV-9603 | fA * fU * fU * fC * fC * fU * mA * mU * mU * mA * mG * mA * mU * mC * mU * mG * mU * mC * mG * fC * fC * fC * fU * fA * fC | 1253 | AUUCCUAUUAGAUCU GUCGCCCUAC | XXXXX XXXXX XXXXX XXXXX XXXX |
| WV-9604 | fU * fA * fU * fU * fA * fG * mA * mU * mC * mU * mG * mU * mC * mG * mC * mC * mC * mU * mA * fC * fC * fU * fC * fU * fU | 1254 | UAUUAGAUCUGUCGC CCUACCUCUU | XXXXX XXXXX XXXXX XXXXX XXXX |
| WV-9605 | fG * fA * fU * fC * fU * fG * mU * mC * mG * mC * mC * mC * mU * mA * mC * mC * mU * mC * mU * fU * fU * fU * fU * fU * fC | 1255 | GAUCUGUCGCCCUAC CUCUUUUUUC | XXXXX XXXXX XXXXX XXXXX XXXX |
| WV-9606 | fG * fU * fC * fG * fC * fC * mC * mU * mA * mC * mC * mU * mC * mU * mU * mU * mU * mU * mU * fC * fU * fG * fU * fC * fU | 1256 | GUCGCCCUACCUCUU UUUUCUGUCU | XXXXX XXXXX XXXXX XXXXX XXXX |
| WV-9607 | fC * fC * fU * fA * fC * fC * mU * mC * mU * mU * mU * mU * mU * mU * mC * mU * mG * mU * mC * fU * fG * fA * fC * fA * fG | 1257 | CCUACCUCUUUUUUC UGUCUGACAG | XXXXX XXXXX XXXXX XXXXX XXXX |
| WV-9608 | fC * fU * fC * fU * fU * fU * mU * mU * mU * mC * mU * mG * mU * mC * mU * mG * mA * mC * mA * fG * fC * fU * fG * fU * fU | 1258 | CUCUUUUUUCUGUCU GACAGCUGUU | XXXXX XXXXX XXXXX XXXXX XXXX |

TABLE A1-continued

| | | | | |
|---|---|---|---|---|
| WV-9609 | fU * fU * fU * fU * fC * fU * mG * mU * mC * mU * mG * mA * mC * mA * mG * mC * mU * mG * mU * fU * fU * fG * fC * fA * fG | 1259 | UUUUCUGUCUGACAGCUGUUUGCAG | XXXXX XXXXX XXXXX XXXXX XXXX |
| WV-9610 | fU * fG * fU * fC * fU * fG * mA * mC * mA * mG * mC * mU * mG * mU * mU * mU * mG * mC * mA * fG * fA * fC * fC * fU * fC | 1260 | UGUCUGACAGCUGUUUGCAGACCUC | XXXXX XXXXX XXXXX XXXXX XXXX |
| WV-9611 | fG * fA * fC * fA * fG * fC * mU * mG * mU * mU * mU * mG * mC * mA * mG * mA * mC * mC * mU * fC * fC * fU * fG * fC * fC | 1261 | GACAGCUGUUUGCAGACCUCCUGCC | XXXXX XXXXX XXXXX XXXXX XXXX |
| WV-9612 | fC * fU * fG * fU * fU * fU * mG * mC * mA * mG * mA * mC * mC * mU * mC * mC * mU * mG * mC * fC * fA * fC * fC * fG * fC | 1262 | CUGUUUGCAGACCUCCUGCCACCGC | XXXXX XXXXX XXXXX XXXXX XXXX |
| WV-9613 | fU * fG * fC * fA * fG * fA * mC * mC * mU * mC * mC * mU * mG * mC * mC * mA * mC * mC * mG * fC * fA * fG * fA * fU * fU | 1263 | UGCAGACCUCCUGCCACCGCAGAUU | XXXXX XXXXX XXXXX XXXXX XXXX |
| WV-9614 | fA * fC * fC * fU * fC * fC * mU * mG * mC * mC * mA * mC * mC * mG * mC * mA * mG * mA * mU * fU * fC * fA * fG * fG * fC | 1264 | ACCUCCUGCCACCGCAGAUUCAGGC | XXXXX XXXXX XXXXX XXXXX XXXX |
| WV-9615 | fC * fU * fG * fC * fC * fA * mC * mC * mG * mC * mA * mG * mA * mU * mU * mC * mA * mG * mG * fC * fU * fU * fC * fC * fC | 1265 | CUGCCACCGCAGAUUCAGGCUUCCC | XXXXX XXXXX XXXXX XXXXX XXXX |
| WV-9616 | fA * fC * fC * fG * fC * fA * mG * mA * mU * mU * mC * mA * mG * mG * mC * mU * mU * mC * mC * fC * fA * fA * fU * fU * fU | 1266 | ACCGCAGAUUCAGGCUUCCCAAUUU | XXXXX XXXXX XXXXX XXXXX XXXX |
| WV-9617 | fA * fG * fA * fU * fU * fC * mA * mG * mG * mC * mU * mU * mC * mC * mC * mA * mA * mU * mU * fU * fU * fU * fC * fC * fU | 1267 | AGAUUCAGGCUUCCCAAUUUUUCCU | XXXXX XXXXX XXXXX XXXXX XXXX |
| WV-9618 | fC * fA * fG * fG * fC * fU * mU * mC * mC *mC * mA * mA * mU * mU * mU * mU * mU * mC * mC * fU * fG * fU * fA * fG * fA | 1268 | CAGGCUUCCCAAUUUUUCCUGUAGA | XXXXX XXXXX XXXXX XXXXX XXXX |
| WV-9619 | fU * fU * fC * fC * fC * fA * mA * mU * mU * mU * mU * mU * mC * mC * mU * mG * mU * mA * mG * fA * fA * fU * fA * fC * fU | 1269 | UUCCCAAUUUUUCCUGUAGAAUACU | XXXXX XXXXX XXXXX XXXXX XXXX |
| WV-9620 | fA * fA * fU * fU * fU * fU * mU * mC * mC * mU * mG * mU * mA * mG * mA * mA * mU * mA * mC * fU * fG * fG * fC * fA * fU | 1270 | AAUUUUUCCUGUAGAAUACUGGCAU | XXXXX XXXXX XXXXX XXXXX XXXX |
| WV-9621 | fU * fU * fC * fC * fU * fG * mU * mA * mG * mA * mA * mU * mA * mC * mU * mG * mG * mC * mA * fU * fC * fU * fG * fU * fU | 1271 | UUCCUGUAGAAUACUGGCAUCUGUU | XXXXX XXXXX XXXXX XXXXX XXXX |

TABLE A1-continued

| | | | | |
|---|---|---|---|---|
| WV-9622 | fG * fU * fA * fG * fA * fA * mU * mA * mC * mU * mG * mG * mC * mA * mU * mC * mU * mG * mU * fU * fU * fU * fU * fG * fA | 1272 | GUAGAAUACUGGCAUCUGUUUUUGA | XXXXX XXXXX XXXXX XXXXX XXXX |
| WV-9623 | fA * fU * fA * fC * fU * fG * mG * mC * mA * mU * mC * mU * mG * mU * mU * mU * mU * mU * mG * fA * fG * fG * fA * fU * fU | 1273 | AUACUGGCAUCUGUUUUUGAGGAUU | XXXXX XXXXX XXXXX XXXXX XXXX |
| WV-9624 | fG * fG * fC * fA * fU * fC * mU * mG * mU * mU * mU * mU * mU * mG * mA * mG * mG * mA * mU * fU * fG * fC * fU * fG * fA | 1274 | GGCAUCUGUUUUUGAGGAUUGCUGA | XXXXX XXXXX XXXXX XXXXX XXXX |
| WV-9625 | fC * fU * fG * fU * fU * fU * mU * mU * mG * mA * mG * mG * mA * mU * mU * mG * mC * mU * mG * fA * fA * fU * fU * fA * fU | 1275 | CUGUUUUUGAGGAUUGCUGAAUUAU | XXXXX XXXXX XXXXX XXXXX XXXX |
| WV-9626 | fU * fU * fU * fG * fA * fG * mG * mA * mU * mU * mG * mC * mU * mG * mA * mA * mU * mU * mA * fU * fU * fU * fC * fU * fU | 1276 | UUUGAGGAUUGCUGAAUUAUUUCUU | XXXXX XXXXX XXXXX XXXXX XXXX |
| WV-9627 | fG * fG * fA * fU * fU * fG * mC * mU * mG * mA * mA * mU * mU * mA * mU * mU * mU * mC * mU * fU * fC * fU * fC * fC * fA | 1277 | GGAUUGCUGAAUUAUUUCUUCCCCA | XXXXX XXXXX XXXXX XXXXX XXXX |
| WV-9628 | fG * fC * fU * fG * fA * fA * mU * mU * mA * mU * mU * mU * mC * mU * mU * mC * mC * mC * mC * fA * fG * fU * fU * fG * fC | 1278 | GCUGAAUUAUUUCUUCCCCAGUUGC | XXXXX XXXXX XXXXX XXXXX XXXX |
| WV-9629 | fA * fU * fU * fA * fU * fU * mU * mC * mU * mU * mC * mC * mC * mC * mA * mG * mU * mU * mG * fC * fA * fU * fU * fC * fA | 1279 | AUUAUUUCUUCCCCAGUUGCAUUCA | XXXXX XXXXX XXXXX XXXXX XXXX |
| WV-9630 | fU * fU * fC * fU * fU * fC * mC * mC * mC * mA * mG * mU * mU * mG * mC * mA * mU * mU * mC * fA * fA * fU * fG * fU * fU | 1280 | UUCUUCCCCAGUUGCAUUCAAUGUU | XXXXX XXXXX XXXXX XXXXX XXXX |
| WV-9631 | fC * fC * fC * fC * fA * fG * mU * mU * mG * mC * mA * mU * mU * mC * mA * mA * mU * mG * mU * fU * fC * fU * fG * fA * fC | 1281 | CCCCAGUUGCAUUCAAUGUUCUGAC | XXXXX XXXXX XXXXX XXXXX XXXX |
| WV-9632 | fG * fU * fU * fG * fC * fA * mU * mU * mC * mA * mA * mU * mG * mU * mU * mC * mU * mG * mA * fC * fA * fA * fC * fA * fG | 1282 | GUUGCAUUCAAUGUUCUGACAACAG | XXXXX XXXXX XXXXX XXXXX XXXX |
| WV-9633 | fA * fU * fU * fC * fA * fA * mU * mG * mU * mU * mC * mU * mG * mA * mC * mA * mA * mC * mA * fG * fU * fU * fU * fG * fC | 1283 | AUUCAAUGUUCUGACAACAGUUUGC | XXXXX XXXXX XXXXX XXXXX XXXX |
| WV-9634 | fA * fU * fG * fU * fU * fC * mU * mG * mA * mC * mA * mA * mC * mA * mG * mU * mU * mU * mG * fC * fC * fG * fC * fU * fG | 1284 | AUGUUCUGACAACAGUUUGCCGCUG | XXXXX XXXXX XXXXX XXXXX XXXX |
| WV- | fC * fU * fG * fA * fC * fA * mA * mC * mA * mG * mU * mU * mU * | 1285 | CUGACAACAGUUUGC | XXXXX XXXXX |

TABLE A1-continued

| | | | | |
|---|---|---|---|---|
| 9635 | mG * mC * mC * mG * mC * mU * fG * fC * fC * fC * fA * fA | | CGCUGCCCAA | XXXXX XXXXX XXXX |
| WV-9636 | fA * fA * fC * fA * fG * fU * mU * mU * mG * mC * mC * mG * mC * mU * mG * mC * mC * mC * mA * fA * fU * fG * fC * fC * fA | 1286 | AACAGUUUGCCGCUG CCCAAUGCCA | XXXXX XXXXX XXXXX XXXXX XXXX |
| WV-9637 | fU * fU * fU * fG * fC * fC * mG * mC * mU * mG * mC * mC * mC * mA * mA * mU * mG * mC * mC * fA * fU * fU * fC * fU * fG | 1287 | UUUGCCGCUGCCCAA UGCCAUCCUG | XXXXX XXXXX XXXXX XXXXX XXXX |
| WV-9638 | fC * fG * fC * fU * fG * fC * mC * mC * mA * mA * mU * mG * mC * mC * mA * mU * mC * mC * mU * fG * fG * fA * fG * fU * fU | 1288 | CGCUGCCCAAUGCCA UCCUGGAGUU | XXXXX XXXXX XXXXX XXXXX XXXX |
| WV-9639 | fC * fC * fC * fA * fA * fU * mG * mC * mC * mA * mU * mC * mC * mU * mG * mG * mA * mG * mU * fU * fC * fC * fU * fG * fU | 1289 | CCCAAUGCCAUCCUG GAGUUCCUGU | XXXXX XXXXX XXXXX XXXXX XXXX |
| WV-9640 | fU * fG * fC * fC * fA * fU * mC * mC * mU * mG * mG * mA * mG * mU * mU * mC * mC * mU * mG * fU * fA * fA * fG * fA * fU | 1290 | UGCCAUCCUGGAGUU CCUGUAAGAU | XXXXX XXXXX XXXXX XXXXX XXXX |
| WV-9641 | fU * fC * fC * fU * fG * fG * mA * mG * mU * mU * mC * mC * mU * mG * mU * mA * mA * mG * mA * fU * fA * fC * fC * fA * fA | 1291 | UCCUGGAGUUCCUGU AAGAUACCAA | XXXXX XXXXX XXXXX XXXXX XXXX |
| WV-9642 | fG * fA * fG * fU * fU * fC * mC * mU * mG * mU * mA * mA * mG * mA * mU * mA * mC * mC * mA * fA * fA * fA * fA * fG * fG | 1292 | GAGUUCCUGUAAGAU ACCAAAAAGG | XXXXX XXXXX XXXXX XXXXX XXXX |
| WV-9643 | fC * fC * fU * fG * fU * fA * mA * mG * mA * mU * mA * mC * mC * mA * mA * mA * mA * mA * mG * fG * fC * fA * fA * fA * fA | 1293 | CCUGUAAGAUACCAA AAAGGCAAAA | XXXXX XXXXX XXXXX XXXXX XXXX |
| WV-9644 | fA * fA * fG * fA * fU * fA * mC * mC * mA * mA * mA * mA * mA * mG * mG * mC * mA * mA * mA * fA * fC * fA * fA * fA * fA | 1294 | AAGAUACCAAAAAGG CAAAACAAAA | XXXXX XXXXX XXXXX XXXXX XXXX |
| WV-9645 | fA * fC * fC * fA * fA * fA * mA * mA * mG * mG * mC * mA * mA * mA * mA * mC * mA * mA * mA * fA * fA * fU * fG * fA * fA | 1295 | ACCAAAAAGGCAAAA CAAAAAUGAA | XXXXX XXXXX XXXXX XXXXX XXXX |
| WV-9646 | fA * fA * fA * fG * fG * fC * mA * mA * mA * mA * mC * mA * mA * mA * mA * mA * mU * mG * mA * fA * fG * fC * fC * fC * fC | 1296 | AAAGGCAAAACAAAA AUGAAGCCCC | XXXXX XXXXX XXXXX XXXXX XXXX |
| WV-9647 | fC * fA * fA * fA * fA * fC * mA * mA * mA * mA * mA * mU * mG * mA * mA * mG * mC * mC * mC * fC * fA * fU * fG * fU * fC | 1297 | CAAAACAAAAAUGAA GCCCCAUGUC | XXXXX XXXXX XXXXX XXXXX XXXX |

TABLE A1-continued

| | | | | |
|---|---|---|---|---|
| WV-9648 | fC * fA * fA * fA * fA * fA * mU * mG * mA * mA * mG * mC * mC * mC * mC * mA * mU * mG * mU * fC * fU * fU * fU * fU * fU | 1298 | CAAAAAUGAAGCCCCAUGUCUUUUU | XXXXX XXXXX XXXXX XXXXX XXXX |
| WV-9649 | fA * fU * fG * fA * fA * fG * mC * mC * mC * mC * mA * mU * mG * mU * mC * mU * mU * mU * mU * fU * fA * fU * fU * fU * fG | 1299 | AUGAAGCCCCAUGUCUUUUUAUUUG | XXXXX XXXXX XXXXX XXXXX XXXX |
| WV-9650 | fG * fC * fC * fC * fC * fA * mU * mG * mU * mC * mU * mU * mU * mU * mU * mA * mU * mU * mU * fG * fA * fG * fA * fA * fA | 1300 | GCCCCAUGUCUUUUUAUUUGAGAAA | XXXXX XXXXX XXXXX XXXXX XXXX |
| WV-9651 | fA * fU * fG * fU * fC * fU * mU * mU * mU * mU * mA * mU * mU * mU * mG * mA * mG * mA * mA * fA * fA * fG * fA * fU * fU | 1301 | AUGUCUUUUUAUUUGAGAAAAGAUU | XXXXX XXXXX XXXXX XXXXX XXXX |
| WV-9652 | fU * fU * fU * fU * fU * fA * mU * mU * mU * mG * mA * mG * mA * mA * mA * mA * mG * mA * mU * fU * fA * fA * fA * fC * fA | 1302 | UUUUUAUUUGAGAAAAGAUUAAACA | XXXXX XXXXX XXXXX XXXXX XXXX |
| WV-9653 | fA * fU * fU * fU * fG * fA * mG * mA * mA * mA * mA * mG * mA * mU * mU * mA * mA * mA * mC * fA * fG * fU * fG * fU * fG | 1303 | AUUUGAGAAAAGAUUAAACAGUGUG | XXXXX XXXXX XXXXX XXXXX XXXX |
| WV-9654 | fA * fG * fA * fA * fA * fA * mG * mA * mU * mU * mA * mA * mA * mC * mA * mG * mU * mG * mU * fG * fC * fU * fA * fC * fC | 1304 | AGAAAAGAUUAAACAGUGUGCUACC | XXXXX XXXXX XXXXX XXXXX XXXX |
| WV-9655 | fA * fG * fA * fU * fU * fA * mA * mA * mC * mA * mG * mU * mG * mU * mG * mC * mU * mA * mC * fC * fA * fC * fA * fU * fG | 1305 | AGAUUAAACAGUGUGCUACCACAUG | XXXXX XXXXX XXXXX XXXXX XXXX |
| WV-9656 | fA * fA * fA * fC * fA * fG * mU * mG * mU * mG * mC * mU * mA * mC * mC * mA * mC * mA * mU * fG * fC * fA * fG * fU * fU | 1306 | AAACAGUGUGCUACCACAUGCAGUU | XXXXX XXXXX XXXXX XXXXX XXXX |
| WV-9657 | fG * fU * fG * fU * fG * fC * mU * mA * mC * mC * mA * mC * mA * mU * mG * mC * mA * mG * mU * fU * fG * fU * fA * fC * fU | 1307 | GUGUGCUACCACAUGCAGUUGUACU | XXXXX XXXXX XXXXX XXXXX XXXX |
| WV-9658 | fU * fU * fG * fC * fC * fG * mC * mU * mG * mC * mC * mC * mA * mA * mU * mG * mC * mC * mA * fU * fC * fC * fU * fG * fG | 1308 | UUGCCGCUGCCCAAUGCCAUCCUGG | XXXXX XXXXX XXXXX XXXXX XXXX |
| WV-9659 | fG * fC * fC * fC * fA * fA * mU * mG * mC * mC * mA * fU * fC * fC * fU *fG * fG | 1309 | GCCCAAUGCCAUCCUGG | XXXXX XXXXX XXXXXX |
| WV-9680 | fU * SfU * SfC * SfU * SfG * SfA * S mA mG mGfU * S mGfU * SfU * SfC * SfU * SfU * SfG * SfU * SfA * SfC | 1310 | UUCUGAAGGUGUUCUUGUAC | SSSSSSOOOSOSSS SSSSS |
| WV-9681 | fU * SfU * SfC * SfU * SfG * SfA * S mA mG mGfU * S mG * SfU * SfU * SfC * SfU * SfU * SfG * SfU * SfA * SfC | 1311 | UUCUGAAGGUGUUCUUGUAC | SSSSSSOOOSSSSS SSSSS |

TABLE A1-continued

| | | | | |
|---|---|---|---|---|
| WV-9682 | fU * SfU * SfC * SfU * SfG * SfA * S mA mG mG mU * SfG * SfU * SfU * SfC * SfU * SfU * SfG * SfU * SfA * SfC | 1312 | UUCUGAAGGUGUUCUUGUAC | SSSSSSOOOSSSSSSSSSS |
| WV-9683 | fU * SfU * SfC * SfU * SfG * SfA * SfA * S mG mGfU * S mG * SfU * SfU * S mCfU * SfU * SfG * SfU * SfA * SfC | 1313 | UUCUGAAGGUGUUCUUGUAC | SSSSSSSOOSSSSOSSSSS |
| WV-9684 | fU * SfU * SfC * SfU * SfG * SfA * S mAfG * S mGfU * S mG * SfU * SfU * S mCfU * SfU * SfG * SfU * SfA * SfC | 1314 | UUCUGAAGGUGUUCUUGUAC | SSSSSSOSOSSSSOSSSSS |
| WV-9685 | fG * SfU * SfC * SfU * SfG * SfA * S mA mGfG * SfU * S mG * SfU * SfU * S mCfU * SfU * SfG * SfU * SfA * SfC | 1315 | UUCUGAAGGUGUUCUUGUAC | SSSSSSOOSSSSSOSSSSS |
| WV-9686 | fU * SfU * SfC * SfU * SfG * S mAfA * S mG mGfU * S mG * SfU * SfU * S mCfU * SfU * SfG * SfU * SfA * SfC | 1316 | UUCUGAAGGUGUUCUUGUAC | SSSSSOSOOSSSSOSSSSS |
| WV-9687 | fU * SfU * SfC * SfU * SfG * S mA mAfG * S mGfU * S mG * SfU * SfU * S mCfU * SfU * SfG * SfU * SfA * SfC | 1317 | UUCUGAAGGUGUUCUUGUAC | SSSSSOOSOSSSSOSSSSS |
| WV-9688 | fU * SfU * SfC * SfU * SfG * S mA mA mGfG * SfU * S mG * SfU * SfU * S mCfU * SfU * SfG * SfU * SfA * SfC | 1318 | UUCUGAAGGUGUUCUUGUAC | SSSSSOOOSSSSSOSSSSS |
| WV-9689 | fU * SfU * SfC * SfU * SfG * S mAfA * S mG mGfU * S mG * SfU * SfU * SfC * SfU * SfU * SfG * SfU * SfA * SfC | 1319 | UUCUGAAGGUGUUCUUGUAC | SSSSSOSOOSSSSSSSSSS |
| WV-9690 | fU * SfU * SfC * SfU * SfG * S mA mAfG * S mGfU * S mG * SfU * SfU * SfC * SfU * SfU * SfG * SfU * SfA * SfC | 1320 | UUCUGAAGGUGUUCUUGUAC | SSSSSOOSOSSSSSSSSSS |
| WV-9691 | fU * SfU * SfC * SfU * SfG * S mA mA mGfG * SfU * S mG * SfU * SfU * SfC * SfU * SfU * SfG * SfU * SfA * SfC | 1321 | UUCUGAAGGUGUUCUUGUAC | SSSSSOOOSSSSSSSSSSS |
| WV-9699 | fC * fU * fC * fC * fG * fG * fU * fU * mCfU * mG * fA * mA mGfG * fG * fG * fU * fU * fC | 1322 | CUCCGGUUCUGAAGGUGUUC | XXXXXXXXOXXXOOXXXXX |
| WV-9700 | fC * SfU * SfC * SfC * SfG * SfG * S mUfU * S mCfU * S mG * SfA mAfG * SfG * SfU * SfG * SfU * SfU * SfC | 1323 | CUCCGGUUCUGAAGGUGUUC | SSSSSSOSOSSOOSSSSSS |
| WV-9701 | fC * SfU * SfC * SfC * SfG * SfG * S mU * SfU * S mCfU * S mfG * SfA mAfG * SfG * SfU * SfG * SfU * SfU * SfC | 1324 | CUCCGGUUCUGAAGGUGUUC | SSSSSSSSOSSOOSSSSSS |
| WV-9702 | fC * SfU * SfC * SfC * SfG * SfG * S mUfU * S mC * SfU * S mG * SfA mAfG * SfG * SfU * SfG * SfU * SfU * SfC | 1325 | CUCCGGUUCUGAAGGUGUUC | SSSSSSOSSSSOOSSSSSS |
| WV-9703 | fC * SfU * SfC * SfC * SfG * SfG * S mUfU * S mCfU * S mG * SfA * S mAfG * SfG * SfU * SfG * SfU * SfU * SfC | 1326 | CUCCGGUUCUGAAGGUGUUC | SSSSSSOSOSSSOSSSSSS |
| WV-9704 | fC * SfU * SfC * SfC * SfG * SfG * S mUfU * S mCfU * S mG * SfA mA * SfG * SfG * SfU * SfG * SfU * SfU * SfC | 1327 | CUCCGGUUCUGAAGGUGUUC | SSSSSSOSOSSOSSSSSSS |
| WV-9709 | fC * SfU * SfC * SfC * SfG * S mG * S mUfU * S mCfU * S mG * SfA mAfG * SfG * SfU * SfG * SfU * SfU * SfC | 1328 | CUCCGGUUCUGAAGGUGUUC | SSSSSOSOSOSSOOSSSSS |
| WV- | fC * SfU * SfC * SfC * SfG * SfG * SfUfU * S mCfU * S mG * SfA mAfG * | 1329 | CUCCGGUUCUGAAGG | SSSSSSOSOSSOOS |

TABLE A1-continued

| | | | | |
|---|---|---|---|---|
| 9710 | SfG * SfU * SfG * SfU * SfU * SfC | | UGUUC | SSSSS |
| WV-9711 | fC * SfU * SfC * SfC * SfG * SfG * S mUfU * SfCfU * S mG * SfA mAfG * SfG * SfU * SfG * SfU * SfU * SfC | 1330 | CUCCGGUUCUGAAGG UGUUC | SSSSSSOSOSSOOS SSSSS |
| WV-9712 | fC * SfU * SfC * SfC * SfG * SfG * S mUfU * S mCfU * SfG * SfA mAfG * SfG * SfU * SfG * SfU * SfU * SfC | 1331 | CUCCGGUUCUGAAGG UGUUC | SSSSSSOSOSSOOS SSSSS |
| WV-9713 | fC * SfU * SfC * SfC * SfG * SfG * S mUfU * S mCfU * S mG * SfAfAfG * SfG * SfU * SfG * SfU * SfU * SfC | 1332 | CUCCGGUUCUGAAGG UGUUC | SSSSSSOSOSSOOS SSSSS |
| WV-9714 | fC * SfU * SfC * SfC * SfG * SfG * S mU * S mU * S mC * S mU * S mG * S mA * S mA * S mG * SfG * SfU * SfG * SfU * SfU * SfC | 1333 | CUCCGGUUCUGAAGG UGUUC | SSSSSSSSSSSSSS SSSS |
| WV-9715 | fC * SfU * SfC * SfC * SfG * SfG * S mU * SfU * S mC * SfU * S mG * SfA * S mA * SfG * SfG * SfU * SfG * SfU * SfU * SfC | 1334 | CUCCGGUUCUGAAGG UGUUC | SSSSSSSSSSSSSS SSSS |
| WV-9737 | fU * SfC * SfA * SfA * SfG * SfG * S mAfA * S mGfA * SBrmUfG * S mGfC * SfA * SfU * SfU * SfU * SfC * SfU | 1335 | UCAAGGAAGAUGGCA UUUCU | SSSSSSOSOSOSOS SSSSS |
| WV-9738 | fU * SfC * SfA * SfA * SfG * SfG * S mAfA * S mGfA * S mUfG * S mGfC * SfA * S BrfU * SfU * SfU * SfC * SfU | 1336 | UCAAGGAAGAUGGCA UUUCU | SSSSSSOSOSOSOS SSSSS |
| WV-9739 | fU * SfC * SfA * SfA * SfG * SfG * S mAfA * S mGfA * S mUfG * S mGfC * SfA * SfU * S BrfU * SfU * SfC * SfU | 1337 | UCAAGGAAGAUGGCA UUUCU | SSSSSSOSOSOSOS SSSSS |
| WV-9740 | fU * SfC * SfA * SfA * SfG * SfG * S mAfA * S mGfA * S mUfG * S mGfC * SfA * SfU * SfU * S BrfU * SfC * SfU | 1338 | UCAAGGAAGAUGGCA UUUCU | SSSSSSOSOSOSOS SSSSS |
| WV-9741 | fU * SfC * SfA * SfA * SfG * SfG * S mAfA * S mGfA * S mUfG * S mGfC * SfA * SfU * SfU * SfU * SfC * S BrfU | 1339 | UCAAGGAAGAUGGCA UUUCU | SSSSSSOSOSOSOS SSSSS |
| WV-9742 | BrfU * SfC * SfA * SfA * SfG * SfG * S mAfA * S mGfA * SBrmUfG * S mGfC * SfA * S BrfU * S BrfU * S BrfU * SfC * S BrfU | 1340 | UCAAGGAAGAUGGCA UUUCU | SSSSSSOSOSOSOS SSSSS |
| WV-9743 | 5 MSfC * SfU * SfC * SfC * SfG * SfG * S mUfU * S mC mU * SfG * S mA mAfG * SfG * SfU * SfG * SfU * SfU * SfC | 1341 | CUCCGGUUCUGAAGG UGUUC | SSSSSSOSOSSOOS SSSSS |
| WV-9744 | fC * SfU * SfC * SfC * SfG * SfG * S mUfU * S mC mU * SfG * S mA mAfG * SfG * SfU * SfG * SfU * SfU * S 5 MSfC | 1342 | CUCCGGUUCUGAAGG UGUUC | SSSSSSOSOSSOOS SSSSS |
| WV-9745 | 5 MSfC * SfU * SfC * SfC * SfG * SfG * S mUfU * S mC mU * SfG * S mA mAfG * SfG * SfU * SfG * SfU * SfU * S 5 MSfC | 1343 | CUCCGGUUCUGAAGG UGUUC | SSSSSSOSOSSOOS SSSSS |
| WV-9746 | fU * SfU * SfC * SfU * SfG * SfA * S mAfG * S mGfU * S mG * SfU mUfC * SfU * SfU * SfG * SfU * SfA * SfC | 1344 | UUCUGAAGGUGUUCU UGUAC | SSSSSSOSOSSOOS SSSSS |
| WV-9747 | fU * SfU * SfC * SfU * SfG * SfA * S mA * SfG * S mGfU * S mG * SfU mUfC * SfU * SfU * SfG * SfU * SfA * SfC | 1345 | UUCUGAAGGUGUUCU UGUAC | SSSSSSSSOSSOOS SSSSS |
| WV-9748 | fU * SfU * SfC * SfU * SfG * SfA * S mAfG * S mG * SfU * S mG * SfU mUfC * SfU * SfU * SfG * SfU * SfA * SfC | 1346 | UUCUGAAGGUGUUCU UGUAC | SSSSSSOSSSSOOS SSSSS |

TABLE A1-continued

| | | | | |
|---|---|---|---|---|
| WV-9749 | fU * SfU * SfC * SfU * SfG * SfA * S mAfG * S mGfU * S mG * SfU * S mUfC * SfU * SfU * SfG * SfU * SfA * SfC | 1347 | UUCUGAAGGUGUUCUUGUAC | SSSSSSOSOSSSOSSSSSS |
| WV-9750 | fU * SfU * SfC * SfU * SfG * SfA * S mAfG * S mGfU * S mG * SfU mU * SfC * SfU * SfU * SfG * SfU * SfA * SfC | 1348 | UUCUGAAGGUGUUCUUGUAC | SSSSSSOSOSSOSSSSSSS |
| WV-9751 | fU * SfU * SfC * SfU * SfG * S mA * S mAfG * S mGfU * S mG * SfU mUfC * SfU * SfU * SfG * SfU * SfA * SfC | 1349 | UUCUGAAGGUGUUCUUGUAC | SSSSSSOSOSSOOSSSSSS |
| WV-9752 | fU * SfU * SfC * SfU * SfG * SfA * SfA * SfG * S mGfU * S mG * SfU mUfC * SfU * SfU * SfG * SfU * SfA * SfC | 1350 | UUCUGAAGGUGUUCUUGUAC | SSSSSSSSOSSOOSSSSSS |
| WV-9753 | fU * SfU * SfC * SfU * SfG * SfA * S mAfG * SfG * SfU * S mG * SfU mUfC * SfU * SfU * SfG * SfU * SfA * SfC | 1351 | UUCUGAAGGUGUUCUUGUAC | SSSSSSOSSSSOOSSSSSS |
| WV-9754 | fU * SfU * SfC * SfU * SfG * SfA * S mAfG * S mGfU * SfG * SfU * S mUfC * SfU * SfU * SfG * SfU * SfA * SfC | 1352 | UUCUGAAGGUGUUCUUGUAC | SSSSSSOSOSSSOSSSSSS |
| WV-9755 | fU * SfU * SfC * SfU * SfG * SfA * S mAfG * S mGfU * S mG * SfUfU * SfU * SfU * SfU * SfG * SfU * SfA * SfC | 1353 | UUCUGAAGGUGUUCUUGUAC | SSSSSSOSOSSOSSSSSSS |
| WV-9756 | fU * SfU * SfC * SfU * SfG * SfA * S mA * S mG * S mG * S mU * S mG * S mU * S mU * S mC * SfU * SfU * SfG * SfU * SfA * SfC | 1354 | UUCUGAAGGUGUUCUUGUAC | SSSSSSSSSSSSSSSSSSS |
| WV-9757 | fU * SfU * SfC * SfU * SfG * SfA * S mA * SfG * S mG * SfU * S mG * SfU * S mU * SfC * SfU * SfU * SfG * SfU * SfA * SfC | 1355 | UUCUGAAGGUGUUCUUGUAC | SSSSSSSSSSSSSSSSSSS |
| WV-9758 | fU * SfU * SfC * SfU * SfG * SfA * SfAfG * S mGfU * S mG * SfU mUfC * SfU * SfU * SfG * SfU * SfA * SfC | 1356 | UUCUGAAGGUGUUCUUGUAC | SSSSSSOSOSSOOSSSSSS |
| WV-9759 | fU * SfU * SfC * SfU * SfG * SfA * S mAfG * SfGfU * S mG * SfU mUfC * SfU * SfU * SfG * SfU * SfA * SfC | 1357 | UUCUGAAGGUGUUCUUGUAC | SSSSSSOSOSSOOSSSSSS |
| WV-9760 | fG * SfU * SfC * SfU * SfG * SfA * S mAfG * S mGfU * SfG * SfU mUfC * SfU * SfU * SfG * SfU * SfA * SfC | 1358 | UUCUGAAGGUGUUCUUGUAC | SSSSSSOSOSSOOSSSSSS |
| WV-9761 | fU * SfU * SfC * SfU * SfG * SfA * S mAfG * S mGfU * S mG * SfUfUfC * SfU * SfU * SfG * SfU * SfA * SfC | 1359 | UUCUGAAGGUGUUCUUGUAC | SSSSSSOSOSSOOSSSSSS |
| WV-9762 | fA * fA * fU * fA * fU * fU * fU * fU * mU * mC * mU * mA * mA * mA * mG * mA * fA * fA * fG * fC * fU * fU * fA * fA * fA | 1360 | AAUAUUCUUCUAAAGAAAGCUUAAA | XXXXX XXXXX XXXXX XXXXX XXXX |
| WV-9763 | fU * fC * fU * fU * fC * fU * fA * fA * mA * mG * mA * mA * mG * mC * mU * fU * fA * fA * fA * fA * fA * fG * fU * fC | 1361 | UCUUCUAAAGAAAGCUUAAAAAGUC | XXXXX XXXXX XXXXX XXXXX XXXX |
| WV-9764 | fU * fA * fA * fA * fG * fA * fA * fA * mG * mC * mU * mU * mA * mA * mA * mA * fA * fG * fU * fC * fU * fG * fC * fU * fA | 1362 | UAAAGAAAGCUUAAAAAGUCUGCUA | XXXXX XXXXX XXXXX XXXXX XXXX |

TABLE A1-continued

| | | | | |
|---|---|---|---|---|
| WV-9765 | fA * fA * fA * fG * fC * fU * fU * fA * mA * mA * mA * mA * mG * mU * mC * mU * fG * fC * fU * fA * fA * fA * fA * fU * fG | 1363 | AAAGCUUAAAAAGUCUGCUAAAAUG | XXXXX XXXXX XXXXX XXXXX XXXX |
| WV-9766 | fU * fU * fA * fA * fA * fA * fA * fG * mU * mC * mU * mG * mC * mU * mA * mA * fA * fA * fU * fG * fU * fU * fU * fU * fC | 1364 | UUAAAAAGUCUGCUAAAAUGUUUUC | XXXXX XXXXX XXXXX XXXXX XXXX |
| WV-9767 | fA * fA * fG * fU * fC * fU * fG * fC * mU * mA * mA * mA * mA * mU * mG * mU * fU * fU * fU * fC * fA * fU * fU * fC * fC | 1365 | AAGUCUGCUAAAAUGUUUUCAUUCC | XXXXX XXXXX XXXXX XXXXX XXXX |
| WV-9768 | fU * fG * fC * fU * fA * fA * fA * fA * mU * mG * mU * mU * mU * mU * mC * mA * fU * fU * fC * fC * fU * fA * fU * fU * fA | 1366 | UGCUAAAAUGUUUUCAUUCCUAUUA | XXXXX XXXXX XXXXX XXXXX XXXX |
| WV-9769 | fA * fA * fA * fU * fG * fU * fU * fU * mU * mC * mA * mU * mU * mC * mC * mU * fA * fU * fU * fA * fG * fA * fU * fC * fU | 1367 | AAAUGUUUUCAUUCCUAUUAGAUCU | XXXXX XXXXX XXXXX XXXXX XXXX |
| WV-9770 | fU * fU * fU * fU * fC * fA * fU * fU * mC * mC * mU * mA * mU * mU * mA * mG * fA * fU * fC * fU * fG * fG * fC * fG * fC | 1368 | UUUUCAUUCCUAUUAGAUCUGUCGC | XXXXX XXXXX XXXXX XXXXX XXXX |
| WV-9771 | fA * fU * fU * fC * fC * fU * fA * fU * mU * mA * mG * mA * mU * mC * mU * mG * fU * fC * fG * fC * fC * fC * fU * fA * fC | 1369 | AUUCCUAUUAGAUCUGUCGCCCUAC | XXXXX XXXXX XXXXX XXXXX XXXX |
| WV-9772 | fU * fA * fU * fU * fA * fG * fA * fU * mC * mU * mG * mU * mC * mG * mC * mC * fC * fU * fA * fC * fC * fU * fC * fU * fU | 1370 | UAUUAGAUCUGUCGCCCUACCUCUU | XXXXX XXXXX XXXXX XXXXX XXXX |
| WV-9773 | fG * fA * fU * fC * fU * fG * fU * fC * mG * mC * mC * mC * mU * mA * mC * mC * fU * fC * fU * fU * fU * fU * fU * fU * fC | 1371 | GAUCUGUCGCCCUACCUCUUUUUUC | XXXXX XXXXX XXXXX XXXXX XXXX |
| WV-9774 | fG * fU * fC * fG * fC * fC * fC * fU * mA * mC * mC * mU * mC * mU * mU * mU * fU * fU * fU * fC * fU * fG * fU * fC * fU | 1372 | GUCGCCCUACCUCUUUUUUCUGUCU | XXXXX XXXXX XXXXX XXXXX XXXX |
| WV-9775 | fC * fC * fU * fA * fC * fC * fU * fC * mU * mU * mU * mU * mU * mU * mC * mU * fG * fU * fC * fU * fG * fA * fC * fA * fG | 1373 | CCUACCUCUUUUUUCUGUCUGACAG | XXXXX XXXXX XXXXX XXXXX XXXX |
| WV-9776 | fC * fU * fC * fU * fU * fU * fU * fU * mU * mC * mU * mG * mU * mC * mU * mG * fA * fC * fA * fG * fC * fU * fG * fU * fU | 1374 | CUCUUUUUUCUGUCUGACAGCUGUU | XXXXX XXXXX XXXXX XXXXX XXXX |
| WV-9777 | fU * fU * fU * fU * fC * fU * fG * fU * mC * mU * mG * mA * mC * mA * mG * mC * fU * fG * fU * fU * fU * fG * fC * fA * fG | 1375 | UUUUCUGUCUGACAGCUGUUUGCAG | XXXXX XXXXX XXXXX XXXXX XXXX |

TABLE A1-continued

| | | | | |
|---|---|---|---|---|
| WV-9778 | fU * fG * fU * fC * fU * fG * fA * fC * mA * mG * mC * mU * mG * mU * mU * mU * fG * fC * fA * fG * fA * fC * fC * fU * fC | 1376 | UGUCUGACAGCUGUUUGCAGACCUC | XXXXX XXXXX XXXXX XXXXX XXXX |
| WV-9779 | fG * fA * fC * fA * fG * fC * fU * fG * mU * mU * mU * mG * mC * mA * mG * mA * fC * fC * fU * fC * fC * fU * fG * fC * fC | 1377 | GACAGCUGUUUGCAGACCUCCUGCC | XXXXX XXXXX XXXXX XXXXX XXXX |
| WV-9780 | fC * fU * fG * fU * fU * fU * fG * fC * mA * mG * mA * mC * mC * mU * mC * mC * fU * fG * fC * fC * fA * fC * fC * fG * fC | 1378 | CUGUUUGCAGACCUCCUGCCACCGC | XXXXX XXXXX XXXXX XXXXX XXXX |
| WV-9781 | fU * fG * fC * fA * fG * fA * fC * fC * mU * mC * mC * mU * mG * mC * mC * mA * fC * fC * fG * fC * fA * fG * fA * fU * fU | 1379 | UGCAGACCUCCUGCCACCGCAGAUU | XXXXX XXXXX XXXXX XXXXX XXXX |
| WV-9782 | fA * fC * fC * fU * fC * fC * fU * fG * mC * mC * mA * mC * mC * mG * mC * mA * fG * fA * fU * fU * fC * fA * fG * fG * fC | 1380 | ACCUCCUGCCACCGCAGAUUCAGGC | XXXXX XXXXX XXXXX XXXXX XXXX |
| WV-9783 | fC * fU * fG * fC * fC * fA * fC * fC * mG * mC * mA * mG * mA * mU * mU * mC * fA * fG * fG * fC * fU * fU * fC * fC * fC | 1381 | CUGCCACCGCAGAUUCAGGCUUCCC | XXXXX XXXXX XXXXX XXXXX XXXX |
| WV-9784 | fA * fC * fC * fG * fC * fA * fG * fA * mU * mU * mC * mA * mG * mG * mC * mU * fU * fC * fC * fC * fA * fA * fU * fU * fU | 1382 | ACCGCAGAUUCAGGCUUCCCAAUUU | XXXXX XXXXX XXXXX XXXXX XXXX |
| WV 9785 | fA * fG * fA * fU * fU * fC * fA * fG * mG * mC * mU * mU * mC * mC * mC * mA * fA * fU * fU * fU * fU * fU * fC * fC * fU | 1383 | AGAUUCAGGCUUCCAAUUUUUCCU | XXXXX XXXXX XXXXX XXXXX XXXX |
| WV-9786 | fC * fA * fG * fG * fC * fU * fU * fC * mC * mC * mA * mA * mU * mU * mU * mU * fU * fC * fC * fU * fG * fU * fA * fG * fA | 1384 | CAGGCUUCCCAAUUUUUCCUGUAGA | XXXXX XXXXX XXXXX XXXXX XXXX |
| WV-9787 | fU * fU * fC * fC * fC * fA * fA * fU * mU * mU * mU * mU * mC * mC * mU * mG * fU * fA * fG * fA * fA * fU * fA * fC * fU | 1385 | UUCCCAAUUUUUCCUGUAGAAUACU | XXXXX XXXXX XXXXX XXXXX XXXX |
| WV-9788 | fA * fA * fU * fU * fU * fU * fU * fC * mC * mU * mG * mU * mA * mG * mA * mA * fU * fA * fC * fU * fG * fG * fC * fA * fU | 1386 | AAUUUUUCCUGUAGAAUACUGGCAU | XXXXX XXXXX XXXXX XXXXX XXXX |
| WV-9789 | fU * fU * fC * fC * fU * fG * fU * fA * mG * mA * mA * mU * mA * mC * mU * mG * fG * fC * fA * fU * fC * fU * fG * fU * fU | 1387 | UUCCUGUAGAAUACUGGCAUCUGUU | XXXXX XXXXX XXXXX XXXXX XXXX |
| WV-9790 | fG * fU * fA * fG * fA * fA * fU * fA * mC * mU * mG * mG * mC * mA * mU * mC * fU * fG * fU * fU * fU * fU * fU * fG * fA | 1388 | GUAGAAUACUGGCAUCUGUUUUUGA | XXXXX XXXXX XXXXX XXXXX XXXX |
| WV- | fA * fU * fA * fC * fU * fG * fG * fC * mA * mU * mC * mU * mG * mU * | 1389 | AUACUGGCAUCUGUU | XXXXX XXXXX |

TABLE A1-continued

| | | | | |
|---|---|---|---|---|
| 9791 | mU * mU * fU * fU * fG * fA * fG * fG * fA * fU * fU | | UUUGAGGAUU | XXXXX XXXXX XXXX |
| WV-9792 | fG * fG * fC * fA * fU * fC * fU * fG * mU * mU * mU * mU * mU * mG * mA * mG * fG * fA * fU * fU * fG * fC * fU * fG * fA | 1390 | GGCAUCUGUUUUUGA GGAUUGCUGA | XXXXX XXXXX XXXXX XXXXX XXXX |
| WV-9793 | fC * fU * fG * fU * fU * fU * fU * fU * mG * mA * mG * mG * mA * mU * mU * mG * fC * fU * fG * fA * fA * fU * fU * fA * fU | 1391 | CUGUUUUUGAGGAU UGCUGAAUUAU | XXXXX XXXXX XXXXX XXXXX XXXX |
| WV-9794 | fU * fU * fU * fG * fA * fG * fG * fA * mU * mU * mG * mC * mU * mG * mA * mA * fU * fU * fA * fU * fU * fU * fC * fU * fU | 1392 | UUUGAGGAUUGCUG AAUUAUUUCUU | XXXXX XXXXX XXXXX XXXXX XXXX |
| WV-9795 | fG * fG * fA * fU * fU * fG * fC * fU * mG * mA * mA * mU * mU * mA * mU * mU * fU * fC * fU * fU * fC * fC * fC * fC * fA | 1393 | GGAUUGCUGAAUUA UUUCUUCCCCA | XXXXX XXXXX XXXXX XXXXX XXXX |
| WV-9796 | fG * fC * fU * fG * fA * fA * fU * fU * mA * mU * mU * mU * mC * mU * mU * mC * fC * fC * fC * fA * fG * fU * fU * fG * fC | 1394 | GCUGAAUUAUUUCUU CCCCAGUUGC | XXXXX XXXXX XXXXX XXXXX XXXX |
| WV-9797 | fA * fU * fU * fA * fU * fU * fU * fC * mU * mU * mC * mC * mC * mC * mA * mG * fU * fU * fG * fC * fA * fU * fU * fC * fA | 1395 | AUUAUUUCUUCCCCA GUUGCAUUCA | XXXXX XXXXX XXXXX XXXXX XXXX |
| WV-9798 | fU * fU * fC * fU * fU * fC * fC * fC * mC * mA * mG * mU * mU * mG * mC * mA * fU * fU * fC * fA * fA * fU * fG * fU * fU | 1396 | UUCUUCCCCAGUUGC AUUCAAUGUU | XXXXX XXXXX XXXXX XXXXX XXXX |
| WV-9799 | fC * fC * fC * fC * fA * fG * fU * fU * mG * mC * mA * mU * mU * mC * mA * mA * fU * fG * fU * fU * fC * fU * fG * fA * fC | 1397 | CCCCAGUUGCAUUCA AUGUUCUGAC | XXXXX XXXXX XXXXX XXXXX XXXX |
| WV-9800 | fG * fU * fU * fG * fC * fA * fU * fU * mC * mA * mA * mU * mG * mU * mU * mC * fU * fG * fA * fC * fA * fA * fC * fA * fG | 1398 | GUUGCAUUCAAUGUU CUGACAACAG | XXXXX XXXXX XXXXX XXXXX XXXX |
| WV-9801 | fA * fU * fU * fC * fA * fA * fU * fG * mU * mU * mC * mU * mG * mA * mC * mA * fA * fC * fA * fG * fU * fU * fU * fG * fC | 1399 | AUUCAAUGUUCUGAC AACAGUUUGC | XXXXX XXXXX XXXXX XXXXX XXXX |
| WV-9802 | fA * fU * fG * fU * fU * fC * fU * fG * mA * mC * mA * mA * mC * mA * mG * mU * fU * fU * fG * fC * fC * fG * fC * fU * fG | 1400 | AUGUUCUGACAACAG UUUGCCGCUG | XXXXX XXXXX XXXXX XXXXX XXXX |
| WV-9803 | fC * fU * fG * fA * fC * fA * fA * fC * mA * mG * mU * mU * mU * mG * mC * mC * fG * fC * fU * fG * fC * fC * fC * fA * fA | 1401 | CUGACAACAGUUUGC CGCUGCCCAA | XXXXX XXXXX XXXXX XXXXX XXXX |

TABLE A1-continued

| | | | | |
|---|---|---|---|---|
| WV-9804 | fA * fA * fC * fA * fG * fU * fU * fU * mG * mC * mC * mG * mC * mU * mG * mC * fC * fC * fA * fA * fU * fG * fC * fC * fA | 1402 | AACAGUUUGCCGCUG CCCAAUGCCA | XXXXX XXXXX XXXXX XXXXX XXXX |
| WV-9805 | fU * fU * fU * fG * fC * fC * fG * fC * mU * mG* mC * mC * mC * mA * mA * mU * fG * fC * fC * fA * fU * fC * fC * fU * fG | 1403 | UUUGCCGCUGCCCAA UGCCAUCCUG | XXXXX XXXXX XXXXX XXXXX XXXX |
| WV-9806 | fC * fG * fC * fU * fG * fC * fC * fC * mA * mA * mU * mG * mC * mC * mA * mU * fC * fC * fU * fG * fG * fA * fG * fU * fU | 1404 | CGCUGCCCAAUGCCA UCCUGGAGUU | XXXXX XXXXX XXXXX XXXXX XXXX |
| WV-9807 | fC * fC * fC * fA * fA * fU * fG * fC * mC * mA * mU * mC * mC * mU * mG * mG * fA * fG * fU * fU * fC * fC * fU * fG * fU | 1405 | CCCAAUGCCAUCCU GAGUUCCUGU | XXXXX XXXXX XXXXX XXXXX XXXX |
| WV-9808 | fU * fG * fC * fC * fA * fU * fC * fC * mU * mG * mG * mA * mG * mU * mU * mC * fC * fU * fG * fU * fA * fA * fA * fG * fA * fU | 1406 | UGCCAUCCUGGAGUU CCUGUAAGAU | XXXXX XXXXX XXXXX XXXXX XXXX |
| WV-9809 | fU * fC * fC * fU * fG * fG * fA * fG * mU * mU * mC * mC * mU * mG * mU * mA * fA * fG * fA * fU * fA * fC * fC * fA * fA | 1407 | UCCUGGAGUUCCUGU AAGAUACCAA | XXXXX XXXXX XXXXX XXXXX XXXX |
| WV-9810 | fG * fA * fG * fU * fU * fC * fC * fU * mG * mU * mA * mA * mG * mA * mU * mA * fC * fC * fA * fA * fA * fA * fA * fG * fG | 1408 | GAGUUCCUGUAAGAU ACCAAAAAGG | XXXXX XXXXX XXXXX XXXXX XXXX |
| WV-9811 | fC * fC * fU * fG * fU * fA * fA * fG * mA * mU * mA * mC * mC * mA * mA * mA * fA * fA * fG * fG * fC * fA * fA * fA * fA | 1409 | CCUGUAAGAUACCAA AAAGGCAAAA | XXXXX XXXXX XXXXX XXXXX XXXX |
| WV-9812 | fA * fA * fG * fA * fU * fA * fC * fC * mA * mA * mA * mA * mA * mG * mG * mC * fA * fA * fA * fA * fC * fA * fA * fA * fA | 1410 | AAGAUACCAAAAAGG CAAAACAAAA | XXXXX XXXXX XXXXX XXXXX XXXX |
| WV-9813 | fA * fC * fC * fA * fA * fA * fA * fA * mG * mG * mC * mA * mA * mA * mA * mC * fA * fA * fA * fA * fA * fU * fG * fA * fA | 1411 | ACCAAAAAGGCAAAA CAAAAAUGAA | XXXXX XXXXX XXXXX XXXXX XXXX |
| WV-9814 | fA * fA * fA * fG * fG * fC * fA * fA * mA * mA * mC * mA * mA * mA * mA * mA * fU * fG * fA * fA * fG * fC * fC * fC * fC | 1412 | AAAGGCAAAACAAAA AUGAAGCCCC | XXXXX XXXXX XXXXX XXXXX XXXX |
| WV-9815 | fC * fA * fA * fA * fA * fC * fA * fA * mA * mA * mA * mU * mG * mA * mA * mG * fC * fC * fC * fC * fA * fU * fG * fU * fC | 1413 | CAAAACAAAAUGAA GCCCCAUGUC | XXXXX XXXXX XXXXX XXXXX XXXX |
| WV-9816 | fC * fA * fA * fA * fA * fA * fU * fG * mA * mA * mG * mC * mC * mC * mC * mA * fU * fG * fU * fC * fU * fU * fU * fU * fU | 1414 | CAAAAAUGAAGCCCC AUGUCUUUUU | XXXXX XXXXX XXXXX XXXXX XXXX |

TABLE A1-continued

| | | | | |
|---|---|---|---|---|
| WV-9817 | fA * fU * fG * fA * fA * fG * fC * fC * mC * mC * mA * mU * mG * mU * mC * mU * fU * fU * fU * fU * fA * fU * fU * fU * fG | 1415 | AUGAAGCCCCAUGUC UUUUUAUUUG | XXXXX XXXXX XXXXX XXXXX XXXX |
| WV-9818 | fG * fC * fC * fC * fC * fA * fU * fG * mU * mC * mU * mU * mU * mU * mU * mA * fU * fU * fU * fG * fA * fG * fA * fA * fA | 1416 | GCCCCAUGUCUUUUU AUUUGAGAAA | XXXXX XXXXX XXXXX XXXXX XXXX |
| WV-9819 | fA * fU * fG * fU * fC * fU * fU * fU * mU * mU * mA * mU * mU * mU * mG * mA * fG * fA * fA * fA * fA * fG * fA * fU * fU | 1417 | AUGUCUUUUUAUUU GA GAAAAGAUU | XXXXX XXXXX XXXXX XXXXX XXXX |
| WV-9820 | fU * fU * fU * fU * fU * fA * fU * fU * mU * mG * mA * mG * mA * mA * mA * mA * fG * fA * fU * fU * fA * fA * fA * fC * fA | 1418 | UUUUUAUUUGAGAA AA GAUUAAACA | XXXXX XXXXX XXXXX XXXXX XXXX |
| WV-9821 | fA * fU * fU * fU * fG * fA * fG * fA * mA * mA * mA * mG * mA * mU * mU * mA * fA * fA * fC * fA * fG * fU * fG * fU * fG | 1419 | AUUUGAGAAAAGAU UAA ACAGUGUG | XXXXX XXXXX XXXXX XXXXX XXXX |
| WV-9822 | fA * fG * fA * fA * fA * fA * fG * fA * mU * mU * mA * mA * mA * mC * mA * mG * fU * fG * fU * fG * fC * fU * fA * fC * fC | 1420 | AGAAAAGAUUAAAC AGU GUGCUACC | XXXXX XXXXX XXXXX XXXXX XXXX |
| WV-9823 | fA * fG * fA * fU * fU * fA * fA * fA * mC * mA * mG * mU * mG * mU * mG * mC * fU * fA * fC * fC * fA * fC * fA * fU * fG | 1421 | AGAUUAAACAGUGU GCU ACCACAUG | XXXXX XXXXX XXXXX XXXXX XXXX |
| WV-9824 | fA * fA * fA * fC * fA * fG * fU * fG * mU * mG * mC * mU * mA * mC * mC * mA * fC * fA * fU * fG * fC * fA * fG * fU * fU | 1422 | AAACAGUGUGCUACC ACA UGCAGUU | XXXXX XXXXX XXXXX XXXXX XXXX |
| WV-9825 | fG * fU * fG * fU * fG * fC * fU * fA * mC * mC * mA * mC * mA * mU * mG * mC * fA * fG * fU * fU * fG * fU * fA * fU * fU | 1423 | GUGUGCUACCACAUG CAG UUGUACU | XXXXX XXXXX XXXXX XXXXX XXXX |
| WV-9826 | fG * fC * fC * fC * fA * fA * fU * fG * fC * fC * fA * fU * fC * fC * fU * fG * fG | 1424 | GCCCAAUGCCAUCCU GG | XXXXX XXXXX XXXXXX |
| WV-9827 | fC * fC * fA * fC * fA * fG * mG * mU * mU * mG * mU * mG * mU * mC * mA * mC * mC * mA * mG * mA * mG * mU * mA * mA * fC * fA * fG * fU * fC * fU | 1425 | CCACAGGUUGUGUCA CC AGAGUAACAGUCU | XXXXX XXXXX XXXXX XXXXX XXXXX XXXX |
| WV-9828 | fG * fU * fG * fU * fC * fA * mC * mC * mA * mG * mA * mG * mU * mA * mA * mC * mA * mG * mU * mC * mU * mG * mA * mG * fU * fA * fG * fG * fA * fG | 1426 | GUGUCACCAGAGUAA CA GUCUGAGUAGGAG | XXXXX XXXXX XXXXX XXXXX XXXXX XXXX |
| WV-9829 | fA * fG * fG * fU * fU * fG * mU * mG * mU * mC * mA * mC * mC * mA * mG * mA * mG * mU * mA * mA * mC * mA * mG * mU * fC * fU * fG * fA * fG * fU | 1427 | AGGUUGUGUCACCAG AG UAACAGUCUGAGU | XXXXX XXXXX XXXXX XXXXX XXXXX XXXX |

TABLE A1-continued

| | | | | |
|---|---|---|---|---|
| WV-9830 | fG * fG * fC * fA * fG * fU * mU * mU * mC * mC * mU * mU * mA * mG * mU * mA * mA * mC * mC * mA * mC * mA * mG * mG * fU * fU * fG * fG * fG * fU | 1428 | GGCAGUUUCCUUAGUAACCACAGGUUGUGU | XXXXX XXXXX XXXXX XXXXX XXXXX XXXX |
| WV-9831 | fA * fG * fA * fU * fG * fG * mC * mA * mG * mU * mU * mU * mC * mC * mU * mU * mA * mG * mU * mA * mA * mC * mC * mA * fC * fA * fG * fG * fU * fU | 1429 | AGAUGGCAGUUUCCUUAGUAACCACAGGUU | XXXXX XXXXX XXXXX XXXXX XXXXX XXXX |
| WV-9832 | fA * fU * fG * fG * fC * fA * mU * mU * mU * mC * mU * mA * mG * mU * mU * mU * mG * mG * mA * mG * mA * mU * mG * mG * fC * fA * fG * fU * fU * fU | 1430 | AUGGCAUUUCUAGUUUGGAGAUGGCAGUUU | XXXXX XXXXX XXXXX XXXXX XXXXX XXXX |
| WV-9833 | fU * fU * fA * fU * fA * fA * mC * mU * mU * mG * mA * mU * mC * mA * mA * mG * mC * mA * mG * mA * mG * mA * mA * mA * fG * fC * fC * fA * fG * fU | 1431 | UUAUAACUUGAUCAAGCAGAGAAAGCCAGU | XXXXX XXXXX XXXXX XXXXX XXXXX XXXX |
| WV-9834 | fA * fU * fA * fC * fC * fU * fU * mC * mU * mG * mC * mU * mU * mG * mA * mU * mG * mA * mU * mC * mA * mU * mC * mU * fC * fG * fU * fU * fG * fA | 1432 | AUACCUUCUGCUUGAUGAUCAUCUCGUUGA | XXXXX XXXXX XXXXX XXXXX XXXXX XXXX |
| WV-9835 | fU * fG * fU * fC * fA * fC * mC * mA * mG * mA * mG * mU * mA * mA * mC * mA * mG * mU * mC * mU * mG * mA * mG * fU * fA * fG * fG * fA * fG | 1433 | UGUCACCAGAGUAACAGU CUGAGUAGGAG | XXXXX XXXXX XXXXX XXXXX XXXXXXXX |
| WV-9836 | fG * fU * fC * fA * fC * fC * mA * mG * mA * mG * mU * mA * mA * mC * mA * mG * mU * mC * mU * mG * mA * mG * fU * fA * fG * fG * fA * fG | 1434 | GUCACCAGAGUAACAGUC UGAGUAGGAG | XXXXX XXXXX XXXXX XXXXX XXXXXXX |
| WV-9837 | fU * fC * fA * fC * fC * fA * mG * mA * mG * mU * mA * mA * mC * mA * mG * mU * mC * mU * mG * mA * mG * fU * fA * fG * fG * fA * fG | 1435 | UCACCAGAGUAACAGUCU GAGUAGGAG | XXXXX XXXXX XXXXX XXXXX XXXXXX |
| WV-9838 | fC * fA * fC * fC * fA * fG * fA * mG * mU * mA * mA * mC * mA * mG * mU * mC * mU * mG * mA * mG * fU * fA * fG * fG * fA * fG | 1436 | CACCAGAGUAACAGUCUG AGUAGGAG | XXXXX XXXXX XXXXX XXXXX XXXXX |
| WV-9839 | fA * fC * fC * fA * fG * fA * mG * mU * mA * mA * mC * mA * mG * mU * mC * mU * mG * mA * mG * fU * fA * fG * fG * fA * fG | 1437 | ACCAGAGUAACAGUCUGA GUAGGAG | XXXXX XXXXX XXXXX XXXXX XXXX |
| WV-9840 | fC * fC * fA * fC * fA * fG * fG * fU * fU * fG * fU * mG * mU * mC * mA * mC * mC * mA * mG * fA * fG * fU * fA * fA * fC * fA * fG * fU * fC * fU | 1438 | CCACAGGUUGUGUCACCAGAGUAACAGUCU | XXXXX XXXXX XXXXX XXXXX XXXXX XXXX |
| WV-984 | fG * fU * fG * fU * fC * fA * fC * fC * fA * fG * fA * mG * mU * mA * mA * mC * mA * mG * mU * fC * fU * fG * fA * fG * fU * fA * fG * fG * fA * fG | 1439 | GUGUCACCAGAGUAACAGUCUGAGUAGGAG | XXXXX XXXXX XXXXX XXXXX XXXXX XXXX |
| WV-9842 | fA * fG * fG * fU * fU * fG * fU * fG * fU * fC * fA * mC * mC * mA * mG * mA * mG * mU * mA * fA * fC * fA * fG * fU * fC * fU * fG * fA * fG * fu | 1440 | AGGUUGUGUCACCAGAGUAACAGUCUGAGU | XXXXX XXXXX XXXXX XXXXX XXXXX XXXX |

TABLE A1-continued

| | | | | |
|---|---|---|---|---|
| WV-9843 | fG * fG * fC * fA * fG * fU * fU * fU * fC * fC * fU * mU * mA * mG * mU * mA * mA * mC * mC * fA * fC * fA * fG * fG * fU * fU * fG * fU * fG * fU | 1441 | GGCAGUUUCCUUAGUA ACCACAGGUUGUGU | XXXXX XXXXX XXXXX XXXXX XXXXX XXXX |
| WV-9844 | fA * fG * fA * fU * fG * fG * fC * fA * fG * fU * fU * mU * mC * mC * mU * mU * mA * mG * mU * fA * fA * fC * fC * fA * fC * fA * fG * fG * fU * fU | 1442 | AGAUGGCAGUUUCCUUA GUAACCACAGGUU | XXXXX XXXXX XXXXX XXXXX XXXXX XXXX |
| WV-9845 | fA * fU * fG * fG * fC * fA * fU * fU * fU * fC * fU * mA * mG * mU * mU * mU * mG * mG * mA * fG * fA * fU * fG * fG * fC * fA * fG * fU * fU * fu | 1443 | AUGGCAUUUCUAG UUUGGAGAUGGCAG UUU | XXXXX XXXXX XXXXX XXXXX XXXXX XXXX |
| WV-9846 | fU * fU * fA * fU * fA * fA * fC * fU * fU * fG * fA * mU * mC * mA * mA * mG * mC * mA * mG * fA * fG * fA * fA * fA * fG * fC * fC * fA * fG * fU | 1444 | UUAUAACUUGAUCA AGCAGAGAAAGCCAG U | XXXXX XXXXX XXXXX XXXXX XXXXX XXXX |
| WV-9847 | fA * fU * fA * fC * fC * fU * fU * fC * fU * fG * fC * mU * mU * mG * mA * mU * mG * mA * mU * fC * fA * fU * fC * fU * fC * fG * fU * fU * fG * fA | 1445 | AUACCUUCUGCUUGA UGAUCAUCUCGUUGA | XXXXX XXXXX XXXXX XXXXX XXXXX XXXX |
| WV-9848 | fU * fG * fU * fC * fA * fC * fC * fA * fG * fA * mG * mU * mA * mA * mC * mA * mG * mU * fC * fU * fG * fA * fG * fU * fA * fG * fG * fA * fG | 1446 | UGUCACCAGAGUAAC A GUCUGAGUAGGAG | XXXXX XXXXX XXXXX XXXXX XXXXXXXX |
| WV-9849 | fG * fU * fC * fA * fC * fC * fA * fG * fA * mG * mU * mA * mA * mC * mA * mG * mU * fC * fU * fG * fA * fG * fU * fA * fG * fG * fA * fG | 1447 | GUCACCAGAGUAACA G UCUGAGUAGGAG | XXXXX XXXXX XXXXX XXXXX XXXXXXX |
| WV-9850 | fU * fC * fA * fC * fC * fA * fG * fA * mG * mU * mA * mA * mC * mA * mG * mU * fC * fU * fG * fA * fG * fU * fA * fG * fG * fA * fG | 1448 | UCACCAGAGUAACAG U CUGAGUAGGAG | XXXXX XXXXX XXXXX XXXXX XXXXXX |
| WV-9851 | fC * fA * fC * fC * fA * fG * fA * mG * mU * mA * mA * mC * mA * mG * mU * fC * fU * fG * fA * fG * fU * fA * fG * fG * fA * fG | 1449 | CACCAGAGUAACAGU CU GAGUAGGAG | XXXXX XXXXX XXXXX XXXXX XXXXX |
| WV-9852 | fA * fC * fC * fA * fG * fA * mG * mU * mA * mA * mC * mA * mG * mU * fC * fU * fG * fA * fG * fU * fA * fG * fG * fA * fG | 1450 | ACCAGAGUAACAGUC U GAGUAGGAG | XXXXX XXXXX XXXXX XXXXX XXXX |
| WV-9858 | fU * SfC * SfA * SfA * SfG * SfG * S mAfA * S mG mA * SfU * S mG mGfC * SfA * SfU * SfU * SfU * SfC * SfUL004 | 1451 | UCAAGGAAGAUGGCA UUUCU | SSSSSSOSOSSOOS SSSSSO |
| WV-9875 | fU * SfU * SfU * SfU * SfG * S mGfC * S mA mG mC * SfU * SfU * SfU * SfC * SfC * SfA * SfC * SfC * SfA * SfA | 1452 | UUUUGGCAGCUUUCC ACCAA | SSSSSOSOOSSSSS SSSSS |
| WV-9876 | fU * SfU * SfU * SfU * SfG * SfG * SfC * SfA * S mG mC * SfU * S mU mUfC * SfC * SfA * SfC * SfC * SfA * SfA | 1453 | UUUUGGCAGCUUUCC ACCAA | SSSSSSSSOSSOOS SSSSS |
| WV-9877 | fU * SfU * SfU * SfU * SfG * SfG * S mCfA * SfG * S mC * SfU * S mU mUfC * SfC * SfA * SfC * SfC * SfA * SfA | 1454 | UUUUGGCAGCUUUCC ACCAA | SSSSSSOSSSSOOS SSSSS |
| WV- | fU * SfU * SfU * SfU * SfG * SfG * S mCfA * S mG mC * SfU * SfU * S | 1455 | UUUUGGCAGCUUUCC | SSSSSSOSOSSSOS |

TABLE A1-continued

| | | | | |
|---|---|---|---|---|
| 9878 | mUfC * SfC * SfA * SfC * SfC * SfA * SfA | | ACCAA | SSSSS |
| WV-9879 | fU * SfU * SfU * SfU * SfG * SfG * S mCfA * S mG mC * SfU * S mUfU * SfC * SfC * SfA * SfC * SfC * SfA * SfA | 1456 | UUUUGGCAGCUUUCC ACCAA | SSSSSSOSOSSOSS SSSSS |
| WV-9897 | fC * SfU * SfC * SfC * SfG * SfG * SfU * SfU * S mCfU * S mG * SfA * S mAfG * SfG * SfG * SfG * SfU * SfU * SfC | 1457 | CUCCGGUUCUGAAGG UGUUC | SSSSSSSSOSSSOSS SSSS |
| WV-9898 | fC * SfU * SfC * SfC * SfG * SfG * SfU * SfU * S mCfU * S mG * SfA * S mA mG * SfG * SfU * SfG * SfU * SfU * SfC | 1458 | CUCCGGUUCUGAAGG UGUUC | SSSSSSSSOSSSOSS SSSS |
| WV-9899 | fC * SfU * SfC * SfC * SfG * SfG * SfU * SfU * SfC * SfU * S mG * SfA * S mA mGfG * SfU * SfG * SfU * SfU * SfC | 1459 | CUCCGGUUCUGAAGG UGUUC | SSSSSSSSSSSSOOS SSSS |
| WV-9900 | fC * SfU * SfC * SfC * SfG * SfG * SfU * SfU * S mC * SfU * S mG * SfA * S mA mGfG * SfU * SfG * SfU * SfU * SfC | 1460 | CUCCGGUUCUGAAGG UGUUC | SSSSSSSSSSSSOOS SSSS |
| WV-9901 | fC * SfU * SfC * SfC * SfG * S mGfU * SfU * SfC * SfU * S mG * SfA * S mA mGfG * SfU * SfG * SfU * SfU * SfC | 1461 | CUCCGGUUCUGAAGG UGUUC | SSSSSOSSSSSSOO SSSSS |
| WV-9902 | fC * SfU * SfC * SfC * SfG * S mGfU * SfU * S mC * SfU * S mG * SfA * S mA mGfU * SfU * SfG * SfU * SfU * SfC | 1462 | CUCCGGUUCUGAAGG UGUUC | SSSSSOSSSSSSOO SSSSS |
| WV-9903 | fC * SfU * SfC * SfC * SfG * SfG * S mUfU * SfC * SfU * S mG * SfA * S mA mGfG * SfU * SfG * SfU * SfU * SfC | 1463 | CUCCGGUUCUGAAGG UGUUC | SSSSSSOSSSSSOO SSSSS |
| WV-9904 | fC * SfU * SfC * SfC * SfG * SfG * S mUfU * S mC * SfU * S mG * SfA * S mA mGfG * SfU * SfG * SfU * SfU * SfC | 1464 | CUCCGGUUCUGAAGG UGUUC | SSSSSSOSSSSSOO SSSSS |
| WV-9905 | fC * SfU * SfC * SfC * SfG * SfG mU * SfU * S mC * SfU * S mG * SfA * S mA * SfG * SfG * SfU * SfG * SfU * SfU * SfC | 1465 | CUCCGGUUCUGAAGG UGUUC | SSSSSOSSSSSSSSS SSSS |
| WV-9906 | fC * SfU * SfC * SfC * SfG * SfG * S mUfU * S mC * SfU * S mG * SfA * S mA * SfG * SfG * SfU * SfG * SfU * SfU * SfC | 1466 | CUCCGGUUCUGAAGG UGUUC | SSSSSSOSSSSSSSS SSSS |
| WV-9907 | fC * SfU * SfC * SfC * SfG * SfG * S mU * SfU mC * SfU * S mG * SfA * S mA * SfG * SfG * SfU * SfG * SfU * SfU * SfC | 1467 | CUCCGGUUCUGAAGG UGUUC | SSSSSSSOSSSSSSS SSSS |
| WV-9908 | fC * SfU * SfC * SfC * SfG * SfG * S mU * SfU * S mCfU * S mG * SfA * S mA * SfG * SfG * SfU * SfG * SfU * SfU * SfC | 1468 | CUCCGGUUCUGAAGG UGUUC | SSSSSSSSOSSSSSS SSSS |
| WV-9909 | fC * SfU * SfC * SfC * SfG * SfG * S mU * SfU * S mC * SfU mG * SfA * S mA * SfG * SfG * SfU * SfG * SfU * SfU * SfC | 1469 | CUCCGGUUCUGAAGG UGUUC | SSSSSSSSSOSSSSS SSSS |
| WV-9910 | fC * SfU * SfC * SfC * SfG * SfG * S mU * SfU * S mC * SfU * S mGfA * S mA * SfG * SfG * SfU * SfG * SfU * SfU * SfC | 1470 | CUCCGGUUCUGAAGG UGUUC | SSSSSSSSSSOSSSS SSSS |
| WV-9911 | fC * SfU * SfC * SfC * SfG * SfG * S mU * SfU * S mC * SfU * S mG * SfA mA * SfG * SfG * SfU * SfG * SfU * SfG * SfC | 1471 | CUCCGGUUCUGAAGG UGUUC | SSSSSSSSSSSOSSS SSSS |
| WV-9912 | fC * SfU * SfC * SfC * SfG * SfG * S mU * SfU * S mC * SfG * S mG * SfA * S mAfG * SfG * SfU * SfG * SfU * SfU * SfC | 1472 | CUCCGGUUCUGAAGG UGUUC | SSSSSSSSSSSSOSS SSSS |

TABLE A1-continued

| | | | | |
|---|---|---|---|---|
| WV-9913 | fC * SfG * SfC * SfC * SfG * SfG * S mU * SfG * S mC * SfU * S mG * SfA * S mA * SfGfG * SfU * SfG * SfU * SfU * SfC | 1473 | CUCCGGUUCUGAAGGUGUUC | SSSSSSSSSSSSSOSSSSS |
| WV-9914 | fC * SfU * SfC * SfC * SfG * SfG * S mU * SfU * S mC * SfU * S mG * SfA * S mA * SfG * SfGfU * SfG * SfU * SfU * SfC | 1474 | CUCCGGUUCUGAAGGUGUUC | SSSSSSSSSSSSSSOSSSS |
| WV-10255 | fU * SfC * SfA * SfA * SfG * SfG * S mAfA * S mG mA * SfU * S mG mGfC * SfA * SfU * SfU * SfU * SfC * S mU | 1475 | UCAAGGAAGAUGGCAUUUCU | SSSSSSOSOSSOOSSSSSS |
| WV-10256 | fU * SfC * SfA * SfC * SfU * SfC * S mAfG * S mA mU * SfA * S mG mUfU * SfG * SfA * SfA * SfG * SfC * SfC | 1476 | UCACUCAGAUAGUUGAAGCC | SSSSSSOSOSSOOSSSSSS |
| WV-10257 | fU * SfC * SfA * SfC * SfU * SfC * SfA * SfG * S mA mU * SfA * S mG mUfU * SfG * SfA * SfA * SfG * SfC * SfC | 1477 | UCACUCAGAUAGUUGAAGCC | SSSSSSSSSOSSOOSSSSSS |
| WV-10258 | fU * SfC * SfA * SfC * SfU * SfC * S mAfG * SfA * S mU * SfA * S mG mUfU * SfG * SfA * SfA * SfG * SfC * SfC | 1478 | UCACUCAGAUAGUUGAAGCC | SSSSSSOSSSSOOSSSSSS |
| WV-10259 | fU * SfC * SfA * SfC * SfU * SfC * S mAfG * S mA mU * SfA * SfG * S mUfU * SfG * SfA * SfA * SfG * SfC * SfC | 1479 | UCACUCAGAUAGUUGAAGCC | SSSSSSOSOSSSOSSSSSS |
| WV-10260 | fU * SfC * SfA * SfC * SfU * SfC * S mAfG * S mA mU * SfA * S mGfU * SfU * SfG * SfA * SfA * SfG * SfC * SfC | 1480 | UCACUCAGAUAGUUGAAGCC | SSSSSSOSOSSOSSSSSSS |
| WV-10261 | fG * SfC * SfA * SfA * SfA * SfG * S mAfA * S mG mA * SfU * S mG mGfC * SfA * SfU * SfU * SfU * SfC * SfU | 1481 | GCAAAGAAGAUGGCAUUUCU | SSSSSSOSOSSOOSSSSSS |
| WV-10262 | fG * fC * fA * fA * fA * fG * mAfA * mG mA * fU * mG mGfC * fA * fU * fU * fU * fC * fU | 1482 | GCAAAGAAGAUGGCAUUUCU | XXXXXXOXOXXOOXXXXXX |
| WV-10439 | fU * fU * fC * fU * fU * fG * fU * fA * fC * mU * mU * mC * mA * mU * mC * mC * mC * mA * mC * mU * mG * fA * fU * fU * fC * fU * fG * fA * fA * fU | 1483 | UUCUUGUACUUCAUCCCACUGAUUCUGAAU | XXXXX XXXXX XXXXX XXXXX XXXXX XXXX |
| WV-10440 | fG * fU * fG * fU * fU * fC * fU * fU * fG * mU * mA * mC * mU * mU * mC * mA * mU * mC * mC * mC * mA * fC * fU * fG * fA * fU * fU * fC * fU * fG | 1484 | GUGUUCUUGUACUUCAUCCCACUGAUUCUG | XXXXX XXXXX XXXXX XXXXX XXXXX XXXX |
| WV-10441 | fA * fA * fU * fG * fU * fG * fU * fU * fC * mU * mU * mG * mU * mA * mC * mU * mU * mC * mA * mU * mC * fC * fC * fA * fC * fU * fG * fA * fU * fU | 1485 | AAGGUGUUCUUGUACUUCAUCCCACUGAUU | XXXXX XXXXX XXXXX XXXXX XXXXX XXXX |
| WV-10442 | fC * fU * fG * fA * fA * fG * fG * fU * fG * mU * mU * mC * mU * mU * mG * mU * mA * mC * mU * mU * mC * fA * fU * fC * fC * fC * fA * fC * fU * fG | 1486 | CUGAAGGUGUUCUUGUACUUCAUCCCACUG | XXXXX XXXXX XXXXX XXXXX XXXXX XXXX |
| WV-10443 | fG * fU * fU * fC * fU * fG * fA * fA * fG * mG * mU * mG * mU * mU * mC * mU * mU * mG * mU * mA * mC * fU * fU * fC * fA * fU * fC * fC * fC * fA | 1487 | GUUCUGAAGGUGUUCUUGUACUUCAUCCCA | XXXXX XXXXX XXXXX XXXXX XXXXX XXXX |
| WV-10444 | fC * fC * fG * fG * fU * fU * fC * fU * fG * mA * mA * mG * mG * mU * mG * mU * mU * mC * mU * mU * mG * fU * fA * fC * fU * fU * fC * fA * fU * fC | 1488 | CCGGUUCUGAAGGUGUUCUUGUACUUCAUC | XXXXX XXXXX XXXXX XXXXX XXXXX XXXX |

TABLE A1-continued

| | | | | |
|---|---|---|---|---|
| WV-10445 | fC * fC * fU * fC * fC * fG * fG * fU * fU * mC * mU * mG * mA * mA * mG * mG * mU * mG * mU * mU * mC * fU * fU * fG * fU * fA * fC * fU * fU * fC | 1489 | CCUCCGGUUCUGAAGGUGUUCUUGUACUUC | XXXXX XXXXX XXXXX XXXXX XXXXX XXXX |
| WV-10446 | fU * fU * fG * fC * fC * fU * fC * fC * fG * mG * mU * mU * mC * mU * mG * mA * mA * mG * mG * mU * mG * fU * fU * fC * fU * fU * fG * fU * fA * fC | 1490 | UUGCCUCCGGUUCUGAAGGUGUUCUUGUAC | XXXXX XXXXX XXXXX XXXXX XXXXX XXXX |
| WV-10447 | fC * fU * fG * fU * fU * fG * fC * fC * fU * mC * mC * mG * mG * mU * mU * mC * mU * mG * mA * mA * mG * fG * fU * fG * fU * fU * fC * fU * fU * fG | 1491 | CUGUUGCCUCCGGUUCUGAAGGUGUUCUUG | XXXXX XXXXX XXXXX XXXXX XXXXX XXXX |
| WV-10448 | fC * fA * fA * fC * fU * fG * fU * fU * fG * mC * mC * mU * mC * mC * mG * mG * mU * mU * mC * mU * mG * fA * fA * fG * fG * fU * fG * fU * fU * fC | 1492 | CAACUGUUGCCUCCGGUUCUGAAGGUGUUC | XXXXX XXXXX XXXXX XXXXX XXXXX XXXX |
| WV-10449 | fA * fU * fU * fC * fA * fA * fC * fU * fG * mU * mU * mG * mC * mC * mU * mC * mC * mG * mG * mU * mU * fC * fU * fG * fA * fA * fG * fG * fU * fG | 1493 | AUUCAACUGUUGCCUCCGGUUCUGAAGGUG | XXXXX XXXXX XXXXX XXXXX XXXXX XXXX |
| WV-10450 | fU * fU * fC * fA * fU * fU * fC * fA * fA * mC * mU * mG * mU * mU * mG * mC * mC * mU * mC * mC * mG * fG * fU * fU * fC * fU * fG * fA * fA * fG | 1494 | UUCAUUCAACUGUUGCCUCCGGUUCUGAAG | XXXXX XXXXX XXXXX XXXXX XXXXX XXXX |
| WV-10451 | fC * fA * fU * fU * fU * fC * fA * fU * fU * mC * mA * mA * mC * mU * mG * mU * mU * mG * mC * mC * mU * fC * fC * fG * fG * fU * fU * fC * fU *fG | 1495 | CAUUUCAUUCAACUGUUGCCUCCGGUUCUG | XXXXX XXXXX XXXXX XXXXX XXXXX XXXX |
| WV-10452 | fU * fA * fA * fC * fA * fU * fU * fU * fC * mA * mU * mU * mC * mA * mA * mC * mU * mG * mU * mU * mG * fC * fC * fU * fC * fC * fG * fG * fU * fU | 1496 | UAACAUUUCAUUCAACUGUUGCCUCCGGUU | XXXXX XXXXX XXXXX XXXXX XXXXX XXXX |
| WV-10453 | fC * fU * fU * fU * fA * fA * fC * fA * fU * mU * mU * mC * mA * mU * mU * mC * mA * mA * mC * mU * mG * fU * fU * fG * fC * fC * fU * fC * fC * fG | 1497 | CUUUAACAUUUCAUUCAACUGUUGCCUCCG | XXXXX XXXXX XXXXX XXXXX XXXXX XXXX |
| WV-10454 | fU * fA * fC * fU * fU * fC * fA * mU * mC * mC * mC * mA * mC * mU * mG * mA * mU * fU * fC * fU * fG * fA * fA * fU * fU | 1498 | UACUUCAUCCCACUGAUUCU GAAUU | XXXXX XXXXX XXXXX XXXXX XXXX |
| WV-10455 | fU * fU * fG * fU * fA * fC * fU * mU * mC * mA * mU * mC * mC * mC * mA * mC * mU * fG * fA * fU * fU * fC * fU * fG * fA | 1499 | UUGUACUUCAUCCCACUGAU UCUGA | XXXXX XXXXX XXXXX XXXXX XXXX |
| WV-10456 | fU * fU * fC * fU * fU * fG * fU * mA * mC * mU * mU * mC * mA * mU * mC * mC * mC * fA * fC * fU * fG * fA * fU * fU * fC | 1500 | UUCUUGUACUUCAUCCCACU GAUUC | XXXXX XXXXX XXXXX XXXXX XXXX |
| WV-10457 | fG * fU * fG * fU * fU * fC * fU * mU * mG * mU * mA * mC * mU * mU * mC * mA * mU * fC * fC * fC * fA * fC * fU * fG * fA | 1501 | GUGUUCUUGUACUUCAUCCC ACUGA | XXXXX XXXXX XXXXX XXXXX XXXX |

TABLE A1-continued

| | | | | |
|---|---|---|---|---|
| WV-10458 | fA * fA * fG * fG * fU * fG * fU * mU * mC * mU * mU * mG * mU * mA * mC * mU * mU * fC * fA * fU * fC * fC * fC * fA * fC | 1502 | AAGGUGUUCUUGUAC UUCAU CCCAC | XXXXX XXXXX XXXXX XXXXX XXXX |
| WV-10459 | fC * fU * fG * fA * fA * fG * fG * mU * mG * mU * mU * mC * mU * mU * mG * mU * mA * fC * fU * fU * fC * fA * fU * fC * fC | 1503 | CUGAAGGUGUUCUUG UACUU CAUCC | XXXXX XXXXX XXXXX XXXXX XXXX |
| WV-10460 | fG * fU * fU * fC * fU * fG * fA * mA * mG * mG * mU * mG * mU * mU * mC * mU * mU * fG * fU * fA * fC * fU * fU * fC * fA | 1504 | GUUCUGAAGGUGUUC UUGUA CUUCA | XXXXX XXXXX XXXXX XXXXX XXXX |
| WV-10461 | fC * fC * fG * fG * fU * fU * fC * mU * mG * mA * mA * mG * mG * mU * mG * mU * mU * fC * fU * fU * fG * fU * fA * fC * fU | 1505 | CCGGUUCUGAAGGUG UUCUU GUACU | XXXXX XXXXX XXXXX XXXXX XXXX |
| WV-10462 | fC * fC * fU * fC * fC * fG * fG * mU * mU * mC * mU * mG * mA * mA * mG * mG * mU * fG * fU * fU * fC * fU * fU * fG * fU | 1506 | CCUCCGGUUCUGAAG GUGUU CUUGU | XXXXX XXXXX XXXXX XXXXX XXXX |
| WV-10463 | fU * fU * fG * fC * fC * fU * fC * mC * mG * mG * mU * mU * mC * mU * mG * mA * mA * fG * fG * fU * fG * fU * fU * fC * fU | 1507 | UUGCCUCCGGUUCUG AAGGU GUUCU | XXXXX XXXXX XXXXX XXXXX XXXX |
| WV-10464 | fC * fU * fG * fU * fU * fG * fC * mC * mU * mC * mC * mG * mG * mU * mU * mC * mU * fG * fA * fA * fG * fG * fU * fG * fU | 1508 | CUGUUGCCUCCGGUU CUGAA GGUGU | XXXXX XXXXX XXXXX XXXXX XXXX |
| WV-10465 | fC * fA * fA * fC * fU * fG * fU * mU * mG * mC * mC * mU * mC * mC * mG * mG * mU * fU * fC * fU * fG * fA * fA * fG * fG | 1509 | CAACUGUUGCCUCCG GUUCU GAAGG | XXXXX XXXXX XXXXX XXXXX XXXX |
| WV-10466 | fA * fU * fU * fC * fA * fA * fC * mU * mG * mU * mU * mG * mC * mC * mU * mC * mC * fG * fG * fU * fU * fC * fU * fG * fA | 1510 | AUUCAACUGUUGCCU CCGGU UCUGA | XXXXX XXXXX XXXXX XXXXX XXXX |
| WV-10467 | fU * fU * fC * fA * fU * fU * fC * mA * mA * mC * mU * mG * mU * mU * mG * mC * mC * fU * fC * fC * fG * fG * fU * fU * fC | 1511 | UUCAUUCAACUGUUG CCUCC GGUUC | XXXXX XXXXX XXXXX XXXXX XXXX |
| WV-10468 | fC * fA * fU * fU * fU * fC * fA * mU * mU * mC * mA * mA * mC * mU * mG * mU * mU * fG * fC * fC * fU * fC * fC * fG * fG | 1512 | CAUUUCAUUCAACUG UUGCC UCCGG | XXXXX XXXXX XXXXX XXXXX XXXX |
| WV-10469 | fU * fA * fA * fC * fA * fU * fU * mU * mC * mA * mU * mU * mC * mA * mA * mC * mU * fG * fU * fU * fG * fC * fC * fU * fC | 1513 | UAACAUUUCAUUCAA CUGUU GCCUC | XXXXX XXXXX XXXXX XXXXX XXXX |
| WV-10470 | fC * fU * fU * fU * fA * fA * fC * mA * mU * mU * mU * mC * mA * mU * mU * mC * mA * fA * fC * fU * fG * fU * fU * fG * fC | 1514 | CUUUAACAUUUCAUU CAACU GUUGC | XXXXX XXXXX XXXXX XXXXX XXXX |
| WV- | fA * fU * fC * fC * fA * fC * fC * fU * fG * mC * mC * mU * mC * mG * | 1515 | AUCCACCUGCCUCGG | XXXXX XXXXX |

TABLE A1-continued

| | | | | |
|---|---|---|---|---|
| 10487 | mG * mC * mC * mU * mC * mC * mC * fA * fA * fA * fG * fU * fG * fC * fU * fG | | CCUCC CAAAGUGCUG | XXXXX XXXXX XXXXX XXXX |
| WV-10488 | fC * fC * fU * fC * fA * fG * fG * fU * fG * mA * mU * mC * mC * mA * mC * mC * mU * mG * mC * mC * mU * fC * fG * fG * fC * fC * fU * fC * fC * fC | 1516 | CCUCAGGUGAUCCAC CUGCC UCGGCCUCCC | XXXXX XXXXX XXXXX XXXXX XXXXX XXXX |
| WV-10489 | fA * fA * fA * fC * fU * fC * fC * fU * fG * mA * mC * mC * mU * mC * mA * mG * mG * mU * mG * mA * mU * fC * fC * fA * fC * fC * fU * fG * fC * fC | 1517 | AAACUCCUGACCUCA GGUGA UCCACCUGCC | XXXXX XXXXX XXXXX XXXXX XXXXX XXXX |
| WV-10490 | fA * fU * fU * fU * fU * fU * fA * fA * fU * mA * mG * mA * mG * mA * mC * mA * mG * mG * mG * mU * mU * fU * fC * fA * fC * fC * fA * fU * fG * fU | 1518 | AUUUUUAAUAGAGA CAGGGU UUCACCAUGU | XXXXX XXXXX XXXXX XXXXX XXXXX XXXX |
| WV-10491 | fC * fU * fA * fC * fA * fG * fG * fC * fA * mC * mG * mU * mG * mC * mC * mA * mU * mC * mA * mU * mG * fC * fC * fC * fA * fG * fC * fU * fA * fA | 1519 | CUACAGGCACGUGCC AUCAU GCCCAGCUAA | XXXXX XXXXX XXXXX XXXXX XXXXX XXXX |
| WV-10492 | fC * fC * fU * fC * fC * fU * fG * fU * fC * mU * mC * mA * mG * mC * mC * mC * mC * mC * mC * mG * mA * fG * fU * fA * fG * fC * fA * fG * fG * fA | 1520 | CCUCCUGUCUCAGCC UCCCG AGUAGCAGGA | XXXXX XXXXX XXXXX XXXXX XXXXX XXXX |
| WV-10493 | fU * fC * fC * fG * fC * fU * fC * fA * fC * mU * mG * mC * mA * mA * mC * mC * mU * mC * mC * mG * mC * fC * fU * fC * fC * fC * fG * fG * fG * fU | 1521 | UCCGCUCACUGCAAC CUCCG CCUCCCGGGU | XXXXX XXXXX XXXXX XXXXX XXXXX XXXX |
| WV-10494 | fU * fC * fU * fU * fG * fU * fA * fA * fC * mC * mC * mA * mG * mG * mC * mU * mG * mG * mA * mG * mU * fG * fC * fA * fA * fU * fG * fG * fU * fG | 1522 | UCUUGUAACCCAGGC UGGAG UGCAAUGGUG | XXXXX XXXXX XXXXX XXXXX XXXXX XXXX |
| WV-10495 | fA * fG * fU * fG * fA * fA * fC * fC * fC * mA * mA * mG * mG * mG * mA * mA * mG * mA * mU * mA * mA * fG * fU * fG * fU * fA * fU * fU * fA * fG | 1523 | AGUGAACCCAAGGGA AGAUA AGUGUAUUAG | XXXXX XXXXX XXXXX XXXXX XXXXX XXXX |
| WV-10496 | fU * fG * fA * fU * fU * fA * fA * fU * fU * mU * mA * mC * mC * mC * mC * mC * mC * mA * mA * mA * mU * fA * fA * fA * fU * fC * fA * fC * fU * fU | 1524 | UGAUUAAUUUACCCC CCAAA UAAAUCACUU | XXXXX XXXXX XXXXX XXXXX XXXXX XXXX |
| WV-10497 | fA * fC * fU * fG * fG * fC * fU * fG * fC * mC * mU * mU * mG * mC * mC * mU * mC * mA * mC * mC * mU * fG * fG * fC * fU * fC * fA * fU * fU * fU | 1525 | ACUGGCUGCCUUGCC UCACC UGUCUCAUUU | XXXXX XXXXX XXXXX XXXXX XXXXX XXXX |
| WV-10498 | fG * fG * fG * fA * fU * fA * fA * fA * fG * mC * mU * mC * mC * mA * mG * mU * mG * mA * mC * mC * mC * fA * fC * fA * fA * fC * fA *fG * fC * fA | 1526 | GGGAUAAAGCUCCAG UGACC CACAACAGCA | XXXXX XXXXX XXXXX XXXXX XXXXX XXXX |
| WV-10499 | fU * fU * fC * fC * fA * fG * fA * fG * fU * mU * mU * mC * mC * mC * mA * mA * mG * mG * mG * mA * mU * fA * fA * fA * fG * fC * fU * fC * fC * fA | 1527 | UUCCAGAGUUUCCCA AGGGA UAAAGCUCCA | XXXXX XXXXX XXXXX XXXXX XXXXX XXXX |

TABLE A1-continued

| | | | | |
|---|---|---|---|---|
| WV-10500 | fG * fG * fG * fG * fA * fA * fA * fU * fA * mA * mC * mU * mC * mU * mG * mA * mG * mG * mC * mA * mU * fG * fU * fA * fU * fU * fU * fU * fA * fC | 1528 | GGGGAAAUAACUCUGAGGCAUGUAUUUUAC | XXXXX XXXXX XXXXX XXXXX XXXXX XXXX |
| WV-10501 | fC * fU * fU * fG * fA * fU * fG * fC * fU * mA * mG * mG * mG * mG * mA * mA * mA * mU * mA * mA * mC * fU * fC * fU * fG * fA * fG * fG * fC * fA | 1529 | CUUGAUGCUAGGGGAAAUAACUCUGAGGCA | XXXXX XXXXX XXXXX XXXXX XXXXX XXXX |
| WV-10502 | fA * fC * fU * fA * fG * fC * fU * fC * fC * mC * mU * mU * mG * mA * mU * mG * mC * mU * mA * mG * mG * fG * fG * fA * fA * fA * fU * fA * fA * fC | 1530 | ACUAGCUCCCUUGAUGCUAGGGGAAAUAAC | XXXXX XXXXX XXXXX XXXXX XXXXX XXXX |
| WV-10503 | fC * fA * fG * fA * fG * fG * fC * fA * fG * mC * mC * mU * mG * mU * mA * mU * mA * mU * mA * mA * mU * fG * fA * fC * fU * fA * fA * fU * fU * fG | 1531 | CAGAGGCAGCCUGUAUAUAAUGACUAAUUG | XXXXX XXXXX XXXXX XXXXX XXXXX XXXX |
| WV-10504 | fC * fU * fC * fC * fA * fG * fC * fU * fC * mC * mC * mA * mG * mA * mG * mG * mC * mA * mG * mC * mC * fU * fG * fU * fA * fU * fA * fU * fA * fA | 1532 | CUCCAGCUCCCAGAGGCAGCCUGUAUAUAA | XXXXX XXXXX XXXXX XXXXX XXXXX XXXX |
| WV-10505 | fA * fU * fG * fC * fC * fU * fC * fC * fC * mC * mU * mC * mC * mA * mG * mC * mU * mC * mC * mC * mA * fG * fA * fG * fG * fC * fA * fG * fC * fC | 1533 | AUGCCUCCCCUCCAGCUCCC AGAGGCAGCC | XXXXX XXXXX XXXXX XXXXX XXXXX XXXX |
| WV-10506 | fC * fA * fG * fG * fC * fA * fA * fC * fU * mG * mA * mU * mG * mC * mC * mU * mC * mC * mC * mC * mU * fC * fC * fA * fG * fC * fU * fC * fC * fC | 1534 | CAGGCAACUGAUGCCUCCCC UCCAGCUCCC | XXXXX XXXXX XXXXX XXXXX XXXXX XXXX |
| WV-10507 | fA * fU * fG * fU * fG * fA * fC * fA * fG * mG * mC * mU * mA * mG * mA * mC * mA * mU * mA * mC * mC * fA * fG * fG * fC * fA * fA * fC * fU * fG | 1535 | AUGUGACAGGCUAGACAUACCAGGCAACUG | XXXXX XXXXX XXXXX XXXXX XXXXX XXXX |
| WV-10508 | fA * fG * fU * fG * fC * fC * fA * fG * fC * mA * mU * mU * mU * mC * mA * mU * mU * mG * mC * mC * mU * fG * fA * fA * fG * fG * fC * fU * fU * fU | 1536 | AGUGCCAGCAUUUCAUUGCCUGAAGGCUUU | XXXXX XXXXX XXXXX XXXXX XXXXX XXXX |
| WV-10509 | fA * fC * fC * fC * fA * fU * fC * fA * fG * mC * mC * mU * mG * mA * mU * mU * mU * mC * mC * mC * mA * fG * fU * fG * fC * fC * fA * fG * fC * fA | 1537 | ACCCAUCAGCCUGAUUUCCCAGUGCCAGCA | XXXXX XXXXX XXXXX XXXXX XXXXX XXXX |
| WV-10510 | fC * fC * fA * fC * fU * fU * fC * fA * fG * mC * mA * mC * mC * mC * mA * mU * mC * mA * mG * mC * mC * fU * fG * fA * fU * fU * fU * fC * fC * fC | 1538 | CCACUUCAGCACCCAUCAGCCUGAUUUCCC | XXXXX XXXXX XXXXX XXXXX XXXXX XXXX |
| WV-10511 | fU * fC * fC * fA * fU * fA * fU * fC * fC * mC * mC * mU * mC * mA * mU * mC * mC * mU * mU * mG * mC * fC * fA * fC * fU * fU * fC * fA * fG * fC | 1539 | UCCAUAUCCCCUCAUCCUUG CCACUUCAGC | XXXXX XXXXX XXXXX XXXXX XXXXX XXXX |
| WV-10512 | fA * fA * fU * fU * fC * fU * fU * fG * fA * mU * mC * mC * mC * mU * mA * mG * mA * mA * mC * mC * mA * fA * fA * fU * fA * fU * fG * fA * fA * fU | 1540 | AAUUCUUGAUCCCUAGAACCAAAUAUGAAU | XXXXX XXXXX XXXXX XXXXX XXXXX XXXX |

TABLE A1-continued

| | | | | |
|---|---|---|---|---|
| WV-10513 | fA * fA * fC * fA * fU * fC * fA * fA * fC * mA * mU * mA * mU * mA * mU * mA * mU * mA * mA * mA * mA * fU * fU * fU * fU * fA * fA * fC * fU * fC | 1541 | AACAUCAACAUAUAUAUAAAAUUUUAACUC | XXXXX XXXXX XXXXX XXXXX XXXXX XXXX |
| WV-10514 | fU * fU * fA * fU * fG * fG * fC * fU * fA * mG * mG * mA * mU * mG * mA * mU * mG * mA * mA * mC * mA * fA * fC * fA * fG * fG * fA * fU * fU * fC | 1542 | UUAUGGCUAGGAUGAUGAACAACAGGAUUC | XXXXX XXXXX XXXXX XXXXX XXXXX XXXX |
| WV-10515 | fG * fU * fA * fA * fA * fU * fG * fC * fU * mA * mG * mU * mC * mU * mG * mG * mA * mG * mG * mA * mG * fA * fC * fA * fU * fU * fU * fU * fA * fA | 1543 | GUAAAUGCUAGUCUGGAGGAGACAUUUUAA | XXXXX XXXXX XXXXX XXXXX XXXXX XXXX |
| WV-10516 | fG * fG * fA * fA * fA * fA * fA * fU * fA * mA * mA * mU * mA * mU * mA * mU * mA * mG * mU * mA * mG * fU * fA * fA * fA * fU * fG * fC * fU * fA | 1544 | GGAAAAAUAAAUAUAUAGUAGUAAAUGCUA | XXXXX XXXXX XXXXX XXXXX XXXXX XXXX |
| WV-10517 | fG * fG * fC * fC * fA * fA * fC * fU * fU * mC * mU * mU * mU * mU * mA * mA * mC * mA * mA * mU * mA * fC * fC * fU * fA * fA * fG * fA * fA * fU | 1545 | GGCCAACUUCUUUUAACAAUACCUAAGAAU | XXXXX XXXXX XXXXX XXXXX XXXXX XXXX |
| WV-10518 | fA * fU * fG * fU * fU * fG * fC * fU * fU * mA * mU * mU * mU * mA * mA * mA * mA * mA * mA * mU * mU * fA * fU * fU * fC * fA * fU * fU * fG * fU | 1546 | AUGUUGCUUAUUUAAAAAAUUAUUCAUUGU | XXXXX XXXXX XXXXX XXXXX XXXXX XXXX |
| WV-10519 | fC * fA * fA * fA * fC * fG * fU * fU * fA * mU * mC * mU * mC * mA * mC * mA * mU * mU * mU * mA * mU * fG * fU * fU * fG * fC * fU * fU * fA * fU | 1547 | CAAACGUUAUCUCACAUUUAUGUUGCUUAU | XXXXX XXXXX XXXXX XXXXX XXXXX XXXX |
| WV-10520 | fA * fG * fA * fC * fA * fU * fU * fU * fU * mA * mA * mA * mC * mG * mU * mA * mA * mC * mU * mU * mC * fC * fA * fA * fA * fC * fG * fU * fU * fA | 1548 | AGACAUUUUAAAUGUAACUUCCAAACGUUA | XXXXX XXXXX XXXXX XXXXX XXXXX XXXX |
| WV-10521 | fC * fU * fA * fG * fA * fA * fU * fA * fA * mA * mA * mG * mG * mA * mA * mA * mA * mA * mU * mA * mA * fA * fU * fA * fU * fA * fU * fA * fG * fU | 1549 | CUAGAAUAAAAGGAAAAAUAAAUAUAUAGU | XXXXX XXXXX XXXXX XXXXX XXXXX XXXX |
| WV-10522 | fU * fU * fA * fU * fU * fU * fU * fA * fA * mA * mA * mA * mG * mG * mU * mA * mU * mC * mU * mU * mU * fG * fA * fU * fA * fC * fU * fA * fA * fC | 1550 | UUAUUUUAAAAAGGUAUCUUUGAUACUAAC | XXXXX XXXXX XXXXX XXXXX XXXXX XXXX |
| WV-10523 | fU * fA * fU * fC * fA * fA * fA * fU * fG * mU * mA * mA * mC * mC * mA * mG * mU * mA * mU * mU * mU * fU * fA * fU * fU * fU * fU * fA * fA * fA | 1551 | UAUCAAAUGUAACCAGUAUUUUAUUUUAAA | XXXXX XXXXX XXXXX XXXXX XXXXX XXXX |
| WV-10524 | fU * fA * fC * fA * fA * fU * fC * fU * fA * mU * mG * mG * mU * mA * mU * mA * mA * mU * mU * mU * mU * fA * fU * fC * fA * fA * fA * fU * fG * fU | 1552 | UACAAUCUAUGGUAUAAUUUUAUCAAAUGU | XXXXX XXXXX XXXXX XXXXX XXXXX XXXX |
| WV-10525 | fU * fA * fC * fA * fU * fU * fA * fA * fA * mC * mA * mU * mC * mA * mU * mU * mA * mA * mA * mU * mU * fA * fC * fA * fA * fU * fC * fU * fA * fU | 1553 | UACAUUAAACAUCAUUAAAUUACAAUCUAU | XXXXX XXXXX XXXXX XXXXX XXXXX XXXX |
| WV- | fU * fG * fA * fU * fU * fU * fU * fC * fU * mG * mU * mU * mA * mA * | 1554 | UGAUUUUCUGUUAA | XXXXX XXXXX |

TABLE A1-continued

| | | | | |
|---|---|---|---|---|
| 10526 | mU * mA * mA * mC * mU * mU * mU * fA * fC * fA * fU * fU * fA * fA * fA * fC | | UAACUU UACAUUAAAC | XXXXX XXXXX XXXXX XXXX |
| WV-10527 | fA * fU * fA * fA * fA * fU * fA * fU * fA * mC * mA * mA * mA * mG * mU * mC * mU * mA * mC * mU * mG * fU * fU * fC * fA * fU * fU * fU * fC * fA | 1555 | AUAAAUAUACAAAG UCUACU GUUCAUUUCA | XXXXX XXXXX XXXXX XXXXX XXXXX XXXX |
| WV-10528 | fG * fG * fG * fU * fG * fA * fC * fA * fG * mU * mG * mA * mG * mA * mC * mU * mC * mU * mG * mU * mC * fU * fC * fU * fA * fA * fG * fA * fA * fA | 1556 | GGGUGACAGUGAGAC UCUGU CUCUAAGAAA | XXXXX XXXXX XXXXX XXXXX XXXXX XXXX |
| WV-10529 | fA * fC * fU * fU * fU * fA * fG * fC * fC * mU * mG * mG * mG * mU * mG * mA * mC * mA * mG * mU * mG * fA * fG * fA * fC * fU * fC * fU * fG * fU | 1557 | ACUUUAGCCUGGGUG ACAGU GAGACUCUGU | XXXXX XXXXX XXXXX XXXXX XXXXX XXXX |
| WV-10530 | fA * fG * fC * fC * fU * fG * fG * fG * fU * mG * mA * mC * mA * mG * mU * mG * mA * mG * mA * mC * mU * fC * fU * fG * fU * fC * fU * fC * fU * fA | 1558 | AGCCUGGGUGACAGU GAGAC UCUGUCUCUA | XXXXX XXXXX XXXXX XXXXX XXXXX XXXX |
| WV-10531 | fG * fA * fU * fU * fG * fU * fG * fC * fC * mA * mC * mU * mG * mC * mA * mC * mU * mU * mU * mA * mG * fC * fC * fU * fG * fG * fG * fU * fG * fA | 1559 | GAUUGUGCCACUGCA CUUUA GCCUGGGUGA | XXXXX XXXXX XXXXX XXXXX XXXXX XXXX |
| WV-10532 | fA * fG * fG * fC * fU * fC * fA * fG * fU * mG * mA * mG * mC * mU * mA * mU * mG * mA * mU * mU * mG * fU * fG * fC * fC * fA * fC * fU * fG * fC | 1560 | AGGCUCAGUGAGCUA UGAUU GUGCCACUGC | XXXXX XXXXX XXXXX XXXXX XXXXX XXXX |
| WV 10533 | fG * fC * fA * fG * fG * fA * fG * fG * fA * mC * mU * mG * mC * mU * mU * mG * mA * mG * mC * mC * mC * fC * fA * fG * fA * fG * fU * fU * fC * fA | 1561 | GCAGGAGGACUGCUU GAGCC CCAGAGUUCA | XXXXX XXXXX XXXXX XXXXX XXXXX XXXX |
| WV-10534 | fG * fG * fA * fG * fG * fC * fU * fG * fA * mG * mG * mC * mA * mG * mG * mA * mG * mG * mA * mC * mU * fG * fC * fU * fU * fG * fA * fG * fC * fC | 1562 | GGAGGCUGAGGCAGG AGGAC UGCUUGAGCC | XXXXX XXXXX XXXXX XXXXX XXXXX XXXX |
| WV-10535 | fU * fA * fC * fU * fA * fG * fG * fG * fA * mG * mG * mC * mU * mG * mA * mG * mG * mC * mA * mG * mG * fA * fG * fG * fA * fC * fU * fG * fC * fU | 1563 | UACUAGGGAGGCUGA GGCAG GAGGACUGCU | XXXXX XXXXX XXXXX XXXXX XXXXX XXXX |
| WV-10536 | fA * fC * fA * fC * fG * fC * fC * fU * fG * mG * mC * mU * mA * mG * mU * mA * mG * mU * mC * mC * mC * fA * fG * fC * fU * fA * fC * fU * fA * fG | 1564 | ACACGCCUGGCUAGU AGUCC CAGCUACUAG | XXXXX XXXXX XXXXX XXXXX XXXXX XXXX |
| WV-10537 | fG * fC * fG * fU * fG * fG * fU * fG * fG * mU * mA * mC * mA * mC * mG * mC * mC * mU * mG * mG * mC * fU * fA * fG * fU * fA * fG * fU * fC * fC | 1565 | GCGUGGUGGUACACG CCUGG CUAGUAGUCC | XXXXX XXXXX XXXXX XXXXX XXXXX XXXX |
| WV-10538 | fA * fG * fG * fC * fC * fA * fA * fG * fA * mG * mU * mU * mC * mA * mA * mG * mA * mA * mC * mC * mC * fA * fU * fC * fU * fC * fU * fA * fC * fA | 1566 | AGGCCAAGAGUUCAA GAACC CAUCUCUACA | XXXXX XXXXX XXXXX XXXXX XXXXX XXXX |

TABLE A1-continued

| | | | | |
|---|---|---|---|---|
| WV-10539 | fC * fA * fA * fG * fG * fA * fA * fG * fG * mA * mG * mA * mA * mU * mU * mG * mC * mU * mU * mG * mA * fG * fG * fC * fC * fA * fA * fG * fA * fG | 1567 | CAAGGAAGGAGAAUUGCUUGAGGCCAAGAG | XXXXX XXXXX XXXXX XXXXX XXXXX XXXX |
| WV-10540 | fU * fU * fU * fG * fG * fG * fA * fG * fG * mC * mC * mA * mA * mG * mG * mA * mA * mG * mG * mA * mG * fA * fA * fU * fU * fG * fC * fU * fU * fG | 1568 | UUUGGGAGGCCAAGGAAGGAGAAUUGCUUG | XXXXX XXXXX XXXXX XXXXX XXXXX XXXX |
| WV-10541 | fC * fA * fU * fG * fC * fU * fA * fA * fC * mU * mC * mA * mU * mG * mC * mC * mU * mG * mU * mA * mA * fU * fC * fC * fU * fA * fG * fU * fG * fC | 1569 | CAUGCUAACUCAUGCCUGUAAUCCUAGUGC | XXXXX XXXXX XXXXX XXXXX XXXXX XXXX |
| WV-10542 | fU * fC * fA * fA * fA * fA * fG * fU * fC * mU * mA * mC * mU * mG * mG * mC * mU * mA * mG * mG * mC * fA * fU * fG * fC * fU * fA * fA * fC * fU | 1570 | UCAAAAGUCUACUGGCUAGGCAUGCUAACU | XXXXX XXXXX XXXXX XXXXX XXXXX XXXX |
| WV-10543 | fC * fU * fA * fG * fG * fA * fA * fG * fG * mA * mA * mU * mU * mA * mA * mG * mC * mC * mC * mG * mA * fA * fU * fG * fG * fU * fU * fG * fA * fC | 1571 | CUAGGAAGGAAUUAAGCCCGAAUGGUUGAC | XXXXX XXXXX XXXXX XXXXX XXXXX XXXX |
| WV-10544 | fA * fA * fG * fA * fU * fA * fU * fG * fA * mA * mA * mG * mA * mG * mU * mA * mG * mA * mC * mC * mU * fG * fU * fU * fA * fC * fU * fU * fU * fU | 1572 | AAGAUAUGAAAGAGUAGACCUGUUACUUUU | XXXXX XXXXX XXXXX XXXXX XXXXX XXXX |
| WV-10545 | fA * fC * fC * fC * fA * fC * fU * fC * fA * mC * mC * mC * mC * mC * mA * mU * mU * mU * mC * mU * mU * fG * fA * fU * fC * fC * fA * fG * fG * fG | 1573 | ACCCACUCACCCCCAUUUCUUGAUCCAGGG | XXXXX XXXXX XXXXX XXXXX XXXXX XXXX |
| WV-10546 | fA * fG * fU * fA * fC * fU * fC * fC * fU * mU * mA * mU * mU * mC * mC * mU * mC * mC * mC * mC * mA * fA * fU * fC * fC * fU * fG * fA * fU * fA | 1574 | AGUACUCCUUAUUCCUCCCCAAUCCUGAUA | XXXXX XXXXX XXXXX XXXXX XXXXX XXXX |
| WV-10547 | fA * fG * fA * fA * fU * fG * fG * fG * fG * mG * mG * mA * mG * mA * mA * mA * mG * mU * mG * mA * mG * fA * fG * fU * fA * fC * fU * fC * fC * fU | 1575 | AGAAUGGGGGGAGAAAGUGAGAGUACUCCU | XXXXX XXXXX XXXXX XXXXX XXXXX XXXX |
| WV-10548 | fA * fU * fU * fU * fG * fA * fG * fG * fA * mA * mA * mU * mU * mU * mC * mA * mG * mA * mG * mG * mA * fA * fA * fG * fA * fG * fA * fA * fA * fG | 1576 | AUUUGAGGAAAUUUCAGAGGAAAGAGAAAG | XXXXX XXXXX XXXXX XXXXX XXXXX XXXX |
| WV-10549 | fU * fA * fG * fA * fC * fU * fA * fC * fU * mA * mA * mG * mC * mA * mG * mA * mC * mA * mG * mA * mU * fA * fU * fU * fU * fG * fA * fG * fG * fA | 1577 | UAGACUACUAAGCAGACAGAUAUUUGAGGA | XXXXX XXXXX XXXXX XXXXX XXXXX XXXX |
| WV-10550 | fU * fC * fU * fU * fU * fU * fA * fU * fC * mC * mU * mG * mA * mG * mG * mA * mA * mU * mU * mA * mU * fA * fG * fA * fC * fU * fA * fC * fU * fA | 1578 | UCUUUUAUCCUGAGGAAUUAUAGACUACUA | XXXXX XXXXX XXXXX XXXXX XXXXX XXXX |
| WV-10551 | fU * fA * fA * fG * fU * fU * fU * fG * fA * mA * mG * mG * mG * mA * mU * mU * mA * mA * mA * mC * mG * fC * fA * fU * fG * fC * fA * fA * fA * fG | 1579 | UAAGUUUGAAGGGAUUAAACGCAUGCAAAG | XXXXX XXXXX XXXXX XXXXX XXXXX XXXX |

TABLE A1-continued

| | | | | |
|---|---|---|---|---|
| WV-10552 | fC * fC * fU * fC * fC * fU * fA * fC * fC * mA * mU * mG * mU * mU * mA * mC * mU * mU * mC * mC * mC * fU * fG * fC * fU * fC * fA * fA * fA * fA | 1580 | CCUCCUACCAUGUUA CUUCC CUGCUCAAAA | XXXXX XXXXX XXXXX XXXXX XXXXX XXXX |
| WV-10553 | fC * fA * fA * fG * fU * fG * fC * fC * fC * mA * mA * mU * mC * mU * mG * mA * mU * mC * mA * mA * mC * fC * fU * fC * fC * fU * fA * fC * fC * fA | 1581 | CAAGUGCCCAAUCUG AUCAA CCUCCUACCA | XXXXX XXXXX XXXXX XXXXX XXXXX XXXX |
| WV-10554 | fA * fU * fA * fG * fA * fG * fG * fG * fU * mU * mU * mU * mG * mA * mU * mC * mA * mA * mG * mU * mG * fC * fC * fC * fA * fA * fU * fC * fU * fG | 1582 | AUAGAGGGUUUUGA UCAAGU GCCCAAUCUG | XXXXX XXXXX XXXXX XXXXX XXXXX XXXX |
| WV-10555 | fC * fC * fA * fU * fG * fU * fU * fG * fG * mG * mG * mG * mA * mC * mA * mG * mC * mU * mC * mC * mU * fA * fA * fG * fA * fA * fU * fG * fG * fC | 1583 | CCAUGUUGGGGGACA GCUCC UAAGAAUGGC | XXXXX XXXXX XXXXX XXXXX XXXXX XXXX |
| WV-10556 | fU * fA * fU * fA * fC * fA * fU * fA * fA * mC * mU * mU * mC * mC * mA * mG * mG * mC * mC * mU * mG * fG * fC * fC * fA * fU * fA * fA * fA * fA | 1584 | UAUACAUAAUUUCCA GGCCU GGCCAUAAAA | XXXXX XXXXX XXXXX XXXXX XXXXX XXXX |
| WV-10557 | fU * fG * fG * fC * fU * fA * fU * fG * fA * mC * mA * mG * mA * mG * mA * mU * mU * mG * mG * mC * mU * fA * fA * fA * fA * fG * fC * fU * fC * fA | 1585 | UGGCUAUGACAGAGA UUGGC UAAAAGCUCA | XXXXX XXXXX XXXXX XXXXX XXXXX XXXX |
| WV-10558 | fU * fA * fG * fC * fA * fG * fC * fU * fC * mA * mG * mG * mU * mC * mC * mC * mU * mU * mC * mG * mA * fU * fA * fA * fA * fA * fU * fG * fG * fC | 1586 | UAGCAGCUCAGGUCC CUUCG AUAAAAUGGC | XXXXX XXXXX XXXXX XXXXX XXXXX XXXX |
| WV-10559 | fA * fG * fA * fU * fU * fC * fU * fA * fU * mA * mU * mA * mU * mU * mA * mC * mA * mU * mA * mG * mU * fC * fA * fG * fA * fC * fC * fA * fG * fG | 1587 | AGAUUCUAUAUAUU ACAUAG UCAGACCAGG | XXXXX XXXXX XXXXX XXXXX XXXXX XXXX |
| WV-10560 | fA * fG * fA * fA * fU * fA * fA * fC * fC * mA * mC * mA * mU * mG * mA * mU * mU * mC * mU * mA * mU * fA * fU * fU * fU * fU * fA * fC * fA * fU | 1588 | AGAAUAACCACAUGA UUCUA UAUAUUACAU | XXXXX XXXXX XXXXX XXXXX XXXXX XXXX |
| WV-10561 | fC * fU * fA * fU * fC * fA * fC * fU * fG * mU * mA * mU * mG * mC * mC * mU * mC * mU * mC * mA * mU * fC * fU * fC * fU * fC * fC * fU * fU * fC | 1589 | CUAUCACUGUAUGCC UCUCA UCUCUCCUUC | XXXXX XXXXX XXXXX XXXXX XXXXX XXXX |
| WV-10562 | fC * fU * fA * fC * fC * fA * fG * fA * fG * mU * mC * mC * mU * mC * mU * mU * mG * mC * mC * mC * mU * fA * fG * fU * fC * fA * fA * fA * fU * fC | 1590 | CUACCAGAGUCCUCU UGCCC UAGUCAAAUC | XXXXX XXXXX XXXXX XXXXX XXXXX XXXX |
| WV-10563 | fA * fU * fU * fC * fC * fU * fA * fA * fA * mC * mA * mC * mA * mG * mA * mG * mC * mA * mC * mA * mA * fA * fC * fA * fA * fA * fA * fA * fA * fU | 1591 | AUUCCUAAACACAGA GCACA AACAAAAAAU | XXXXX XXXXX XXXXX XXXXX XXXXX XXXX |
| WV-10564 | fA * fA * fA * fC * fC * fA * fA * fU * fA * mU * mA * mU * mA * mU * mA * mA * mA * mG * mU * mG * mA * fC * fU * fA * fG * fC * fA * fU * fA * fC | 1592 | AAACCAAUAUAUAUA AAGUG ACUAGCAUAC | XXXXX XXXXX XXXXX XXXXX XXXXX XXXX |
| WV- | fC * fA * fA * fA * fG * fA * fG * fU * fG * mU * mU * mU * mU * mU * | 1593 | CAAAGAGUGUUUUU | XXXXX XXXXX |

TABLE A1-continued

| | | | | |
|---|---|---|---|---|
| 10565 | mG * mA * mA * mA * mG * mG * mA * fU * fG * fA * fA * fA * fU * fA * fA * fA | | GAAAGG AUGAAAUAAA | XXXXX XXXXX XXXXX XXXX |
| WV-10566 | fG * fA * fA * fG * fA * fG * fG * fA * fA * mG * mC * mC * mU * mG * mU * mG * mA * mG * mG * mU * mC * fA * fU * fC * fU * fA * fC * fA * fA * fG | 1594 | GAAGAGGAAGCCUGU GAGGU CAUCUACAAG | XXXXX XXXXX XXXXX XXXXX XXXXX XXXX |
| WV-10567 | fA * fG * fA * fC * fA * fA * fU * fU * fG * mG * mA * mA * mG * mA * mG * mG * mA * mA * mG * mC * mC * fU * fG * fU * fG * fA * fG * fG * fU * fC | 1595 | AGACAAUUGGAAGA GGAAGC CUGUGAGGUC | XXXXX XXXXX XXXXX XXXXX XXXXX XXXX |
| WV-10568 | fA * fC * fC * fA * fU * fU * fU * fU * fA * mU * mU * mU * mG * mC * mU * mC * mC * mC * mU * mA * mC * fC * fU * fU * fU * fU * fA * fG * fA * fA | 1596 | ACCAUUUUAUUUGCU CCCUA CCUUUUAGAA | XXXXX XXXXX XXXXX XXXXX XXXXX XXXX |
| WV-10569 | fC * fG * fG * fA * fG * fC * fA * fA * fG * mG * mG * mG * mG * mU * mG * mU * mU * mG * mC * mU * mU * fU * fA * fG * fC * fC * fA * fU * fU * fU | 1597 | CGGAGCAAGGGGGUG UUGCU UUAGCCAUUU | XXXXX XXXXX XXXXX XXXXX XXXXX XXXX |
| WV-10570 | fA * fU * fC * fU * fU * fA * fG * fG * fC * mA * mC * mA * mC * mA * mG * mA * mC * mU * mC * mA * mG * fA * fA * fA * fG * fA * fA * fC * fU * fU | 1598 | AUCUUAGGCACACAG ACUCA GAAAGAACUU | XXXXX XXXXX XXXXX XXXXX XXXXX XXXX |
| WV-10571 | fC * fC * fU * fU * fG * fU * fG * fA * fG * mG * mC * mU * mC * mA * mC * mA * mG * mG * mC * mU * mC * fU * fC * fU * fU * fG * fU * fU * fA * fA | 1599 | CCUUGUGAGGCUCAC AGGCU CUCUUGUUAA | XXXXX XXXXX XXXXX XXXXX XXXXX XXXX |
| WV-10572 | fA * fA * fU * fC * fA * fC * fA * fG * fC * mU * mC * mU * mC * mC * mA * mA * mG * mG * mC * mU * mG * fU * fA * fG * fA * fC * fA * fU * fA * fG | 1600 | AAUCACAGCUCUCCA AGGCU GUAGACAUAG | XXXXX XXXXX XXXXX XXXXX XXXXX XXXX |
| WV-10573 | fG * fA * fG * fG * fU * fG * fC * fU * fG * mC * mA * mA * mA * mG * mG * mA * mG * mG * mC * mU * mG * fG * fC * fU * fG * fC * fU * fG * fU * fA | 1601 | GAGGUGCUGCAAAGG AGGCU GGCUGCUGUA | XXXXX XXXXX XXXXX XXXXX XXXXX XXXX |
| WV-10574 | fA * fC * fU * fG * fG * fC * fU * fC * fA * mA * mA * mU * mU * mU * mC * mA * mA * mG * mA * mG * mU * fU * fA * fU * fA * fA * fC * fA * fG * fU | 1602 | ACUGGCUCAAAUUUU AAGAG UUAUAACAGU | XXXXX XXXXX XXXXX XXXXX XXXXX XXXX |
| WV-10575 | fU * fA * fA * fA * fU * fG * fU * fC * fA * mG * mA * mC * mC * mA * mG * mC * mA * mA * mG * mG * mA * fC * fA * fU * fA * fA * fA * fG * fA * fU | 1603 | UAAAUGUCAGACCAG CAAGG ACAUAAAGAU | XXXXX XXXXX XXXXX XXXXX XXXXX XXXX |
| WV-10576 | fU * fU * fU * fU * fU * fC * fU * fA * fA * mA * mU * mA * mA * mA * mA * mG * mG * mA * mG * mG * mA * fG * fU * fU * fU * fU * fU * fU * fC * fU | 1604 | UUUUUCUAAAUAAA AGGAGG AGUUUUUUCU | XXXXX XXXXX XXXXX XXXXX XXXXX XXXX |
| WV-10577 | fA * fG * fC * fC * fA * fC * fC * fG * fC * mG * mC * mC * mC * mG * mG * mC * mC * mU * mC * mA * mC * fC * fA * fU * fU * fC * fU * fU * fU * fU | 1605 | AGCCACCGCGCCCGG CCUCA CCAUUCUUUU | XXXXX XXXXX XXXXX XXXXX XXXXX XXXX |

TABLE A1-continued

| | | | | |
|---|---|---|---|---|
| WV-10578 | fC * fU * fG * fC * fC * fU * fC * fG * fG * mC * mC * mU * mC * mC * mC * mA * mA * mA * mG * mU * mG * fC * fU * fG * fG * fG * fA * fU * fU * fA | 1606 | CUGCCUCGGCCUCCC AAAGU GCUGGGAUUA | XXXXX XXXXX XXXXX XXXXX XXXXX XXXX |
| WV-10579 | fC * fG * fU * fG * fA * fU * fC * fU * fG * mC * mC * mU * mG * mC * mC * mU * mC * mG * mG * mC * mC * fU * fC * fC * fC * fA * fA * fA * fG * fU | 1607 | CGUGAUCUGCCUGCC UCGGC CUCCCAAAGU | XXXXX XXXXX XXXXX XXXXX XXXXX XXXX |
| WV-10580 | fG * fU * fA * fU * fU * fU * fU * fU * fA * mG * mU * mA * mG * mA * mG * mA * mC * mA * mG * mG * mG * fU * fU * fU * fC * fA * fC * fC * fA * fU | 1608 | GUAUUUUUAGUAGA GACAGG GUUUCACCAU | XXXXX XXXXX XXXXX XXXXX XXXXX XXXX |
| WV-10581 | fG * fC * fA * fU * fG * fC * fA * fG * fC * mA * mC * mC * mA * mC * mG * mC * mC * mA * mG * mG * mC * fU * fA * fG * fU * fU * fU * fU * fU * fG | 1609 | GCAUGCAGCACCACG CCAGG CUAGUUUUUG | XXXXX XXXXX XXXXX XXXXX XXXXX XXXX |
| WV-10582 | fC * fA * fA * fG * fU * fA * fG * fC * fU * mG * mG * mG * mA * mC * mU * mA * mC * mA * mG * mG * mC * fA * fU * fG * fC * fA * fG * fC * fA * fC | 1610 | CAAGUAGCUGGGACU ACAGG CAUGCAGCAC | XXXXX XXXXX XXXXX XXXXX XXXXX XXXX |
| WV-10583 | fC * fC * fU * fC * fA * fG * fC * fC * fU * mC * mC * mC * mA * mA * mG * mU * mA * mG * mC * mU * mG * fG * fG * fA * fC * fU * fA * fC * fA * fG | 1611 | CCUCAGCCUCCCAAG UAGCU GGGACUACAG | XXXXX XXXXX XXXXX XXXXX XXXXX XXXX |
| WV-10584 | fU * fU * fU * fG * fG * fG * fA * fG * fA * mG * mA * mC * mA * mG * mA * mA * mA * mU * mC * mU * mG * fG * fG * fA * fU * fU * fG * fG * fC * fC | 1612 | UUUGGGAGAGACAG AAAUCU GGGAUUGGCC | XXXXX XXXXX XXXXX XXXXX XXXXX XXXX |
| WV-10585 | fA * fC * fC * fU * fA * fU * fU * fC * fA * mC * mU * mG * mG * mG * mA * mG * mG * mU * mU * mG * mU * fG * fA * fG * fG * fA * fA * fC * fA * fC | 1613 | ACCUAUUCACUGGGA GGUUG UGAGGAACAC | XXXXX XXXXX XXXXX XXXXX XXXXX XXXX |
| WV-10586 | fU * fG * fC * fA * fG * fA * fG * fU * fG * mA * mG * mC * mA * mU * mG * mG * mA * mG * mA * mA * mG * fA * fU * fA * fA * fU * fG * fA * fG * fU | 1614 | UGCAGAGUGAGCAUG GAGAA GAUAAUGAGU | XXXXX XXXXX XXXXX XXXXX XXXXX XXXX |
| WV-10587 | fG * fG * fU * fU * fU * fA * fG * fG * fU * mG * mC * mC * mU * mG * mU * mU * mA * mG * mA * mU * mA * fG * fU * fG * fG * fU * fG * fC * fU * fA | 1615 | GGUUUAGGUGCCUGU UAGAU AGUGGUGCUA | XXXXX XXXXX XXXXX XXXXX XXXXX XXXX |
| WV 10588 | fA * fA * fA * fG * fG * fG * fU * fU * fU * mA * mA * mG * mA * mC * mA * mG * mA * mU * mU * mA * mC * fC * fU * fG * fG * fC * fU * fU * fC * fU | 1616 | AAAGGGUUUAAGAC AGAUUA CCUGGCUUCU | XXXXX XXXXX XXXXX XXXXX XXXXX XXXX |
| WV-10589 | fC * fU * fA * fU * fC * fC * fC * fU * fC * mU * mG * mU * mG * mC * mA * mU * mC * mC * mC * mC * mA * fC * fA * fC * fA * fU * fC * fC * fA * fU | 1617 | CUAUCCCUCUGUGCA UCCCC ACACAUCCAU | XXXXX XXXXX XXXXX XXXXX XXXXX XXXX |
| WV-10590 | fU * fU * fA * fU * fA * fG * fG * fC * fU * mA * mG * mA * mG * mA * mC * mU * mC * mA * mC * mU * mC * fA * fA * fU * fA * fA * fU * fC * fC * fA | 1618 | UUAUAGGCUAGAGAC UCACU CAAUAAUCCA | XXXXX XXXXX XXXXX XXXXX XXXXX XXXX |

TABLE A1-continued

| | | | | |
|---|---|---|---|---|
| WV-10591 | fU * fA * fU * fG * fC * fU * fU * fU * fU * mU * mC * mA * mC * mC * mC * mU * mU * mG * mA * mC * mC * fU * fU * fC * fA * fA * fC * fU * fG * fU | 1619 | UAUGCUUUUUCACCCUUGACCUUCAACUGU | XXXXX XXXXX XXXXX XXXXX XXXXX XXXX |
| WV-10592 | fC * fU * fU * fG * fG * fG * fG * fU * fG * mC * mG * mC * mA * mU * mC * mC * mC * mA * mC * mU * mG * fA * fG * fG *fG * fU * fA * fU * fG * fC | 1620 | CUUGGGGUGUGCAUCCCACUGAGGGUAUGC | XXXXX XXXXX XXXXX XXXXX XXXXX XXXX |
| WV-10593 | fU * fA * fC * fU * fU * fU * fA * fG * fU * mA * mC * mA * mC * mA * mU * mA * mC * mU * mU * mG * mG * fG * fA * fC * fU * fU * fU * fU * fU * fC | 1621 | UACUUUAGUACACAUACUUGGGACUUUUUC | XXXXX XXXXX XXXXX XXXXX XXXXX XXXX |
| WV-10594 | fC * fA * fA * fC * fU * fU * fA * fU * fC * mA * mU * mA * mG * mC * mA * mG * mG * mC * mU * mA * mC * fU * fU * fU * fA * fG * fU * fA * fC * fA | 1622 | CAACUUAUCAUAGCAGGCUACUUUAGUACA | XXXXX XXXXX XXXXX XXXXX XXXXX XXXX |
| WV-10595 | fA * fU * fU * fC * fC * fA * fA * fU * fU * mA * mC * mA * mA * mA * mC * mC * mC * mU * mU * mU * mU * fU * fC * fA * fA * fC * fU * fU * fA * fU | 1623 | AUUCCAAUUACAAACCCUUUUUCAACUUAU | XXXXX XXXXX XXXXX XXXXX XXXXX XXXX |
| WV-10596 | fA * fA * fA * fA * fU * fA * fU * fA * fG * mU * mC * mC * mC * mC * mA * mG * mA * mA * mU * mA * mA * fU * fU * fA * fA * fA * fA * fC * fU * fC | 1624 | AAAAUAUAGUCCCCAGAAUAAUUAAAACUC | XXXXX XXXXX XXXXX XXXXX XXXXX XXXX |
| WV-10597 | fU * fA * fG * fA * fA * fA * fG * fA * fC * mC * mC * mC * mA * mC * mA * mA * mA * mA * mC * mU * mA * fG * fU * fG * fA * fU * fU * fG * fU * fA | 1625 | UAGAAAGACCCCACAAAACUAGUGAUUGUA | XXXXX XXXXX XXXXX XXXXX XXXXX XXXX |
| WV-10598 | fC * fU * fC * fC * fA * fG * fC * fC * fU * mG * mG * mG * mU * mG * mA * mC * mA * mG * mA * mG * mC * fA * fA * fA * fA * fC * fU * fC * fC * fA | 1626 | CUCCAGCCUGGGUGACAGAGCAAAACUCCA | XXXXX XXXXX XXXXX XXXXX XXXXX XXXX |
| WV-10599 | fU * fU * fG * fA * fA * fC * fC * fC * fG * mG * mG * mA * mG * mG * mC * mA * mG * mA * mG * mG * mU * fU * fG * fC * fA * fG * fU * fG * fA * fG | 1627 | UUGAACCCGGGAGGCAGAGGUUGCAGUGAG | XXXXX XXXXX XXXXX XXXXX XXXXX XXXX |
| WV-10600 | fA * fG * fG * fC * fU * fG * fA * fG * fG * mC * mA * mG * mG * mA * mG * mA * mA * mU * mC * mA * mC * fU * fU * fG * fA * fA * fC * fC * fC * fG | 1628 | AGGCUGAGGCAGGAGAAUCACUUGAACCCG | XXXXX XXXXX XXXXX XXXXX XXXXX XXXX |
| WV-10601 | fG * fC * fU * fA * fC * fU * fC * fA * fG * mG * mA * mG * mG * mC * mU * mG * mA * mG * mG * mC * mA * fG * fG * fA * fG * fA * fA * fU * fC * fA | 1629 | GCUACUCAGGAGGCUGAGGCAGGAGAAUCA | XXXXX XXXXX XXXXX XXXXX XXXXX XXXX |
| WV-10602 | fA * fG * fC * fA * fC * fA * fC * fG * fC * mC * mU * mG * mU * mA * mA * mU * mC * mC * mC * mA * mG * fC * fU * fA * fC * fU * fC * fA * fG * fG | 1630 | AGCACACGCCUGUAAUCCCAGCUACUCAGG | XXXXX XXXXX XXXXX XXXXX XXXXX XXXX |
| WV-10603 | fA * fG * fC * fC * fU * fG * fA * fC * fC * mG * mA * mC * mA * mU * mG * mC * mU * mG * mA * mA * mA * fC * fC * fC * fA * fG * fU * fC * fU * fC | 1631 | AGCCUGACCGACAUGCUGAAACCCAGUCUC | XXXXX XXXXX XXXXX XXXXX XXXXX XXXX |
| WV- | fG * fU * fU * fC * fG * fA * fG * fA * fC * mC * mA * mG * mC * mC * | 1632 | GUUCGAGACCAGCCU | XXXXX XXXXX |

TABLE A1-continued

| | | | | |
|---|---|---|---|---|
| 10604 | mU * mG * mA * mC * mC * mG * mA * fC * fA * fU * fG * fC * fU * fG * fA * fA | | GACCG ACAUGCUGAA | XXXXX XXXXX XXXXX XXXX |
| WV-10605 | fG * fG * fU * fC * fU * fC * fU * fG * fG * mG * mA * mG * mG * mC * mC * mA * mA * mA * mG * mC * mG * fG * fG * fU * fG * fG * fA * fU * fC * fA | 1633 | GGUCUCUGGGAGGCC AAAGC GGGUGGAUCA | XXXXX XXXXX XXXXX XXXXX XXXXX XXXX |
| WV-10606 | fG * fC * fU * fC * fA * fC * fG * fC * fC * mU * mG * mU * mA * mA * mU * mC * mC * mC * mA * mG * mG * fU * fC * fU * fC * fU * fG * fG * fG * fA | 1634 | GCUCACGCCUGUAAU CCCAG GUCUCUGGGA | XXXXX XXXXX XXXXX XXXXX XXXXX XXXX |
| WV-10607 | fG * fG * fU * fG * fG * fC * fU * fC * fA * mC * mG * mC * mC * mU * mG * mU * mA * mA * mU * mC * mC * fC * fA * fG * fG * fU * fC * fU * fC * fU | 1635 | GGUGGCUCACGCCUG UAAUC CCAGGUCUCU | XXXXX XXXXX XXXXX XXXXX XXXXX XXXX |
| WV-10608 | fU * fU * fU * fU * fU * fA * fA * fU * fU * mA * mA * mC * mC * mC * mU * mG * mU * mU * mG * mC * mC * fU * fC * fC * fA * fC * fA * fA * fA * fG | 1636 | UUUUUAAUUAACCCU GUUGC CUCCACAAAG | XXXXX XXXXX XXXXX XXXXX XXXXX XXXX |
| WV-10609 | fU * fA * fA * fA * fG * fA * fG * fC * fA * mA * mG * mG * mG * mA * mG * mA * mG * mA * mA * mG * mG * fU * fC * fA * fA * fA * fG * fA * fA * fU | 1637 | UAAAGAGCAAGGGA GAGAAG GUCAAAGAAU | XXXXX XXXXX XXXXX XXXXX XXXXX XXXX |
| WV-10610 | fU * fG * fA * fU * fG * fA * fC * fA * fG * mA * mG * mG * mU * mC * mA * mG * mC * mC * mU * mC * mC * fC * fA * fG * fA * fA * fU * fA * fA * fA | 1638 | UGAUGACAGAGGUCA GCCUC CCAGAAUAAA | XXXXX XXXXX XXXXX XXXXX XXXXX XXXX |
| WV-10611 | fG * fC * fA * fU * fG * fG * fG * fA * fG * mC * mC * mC * mA * mA * mU * mG * mA * mU * mG * mA * mC * fA * fG * fA * fG * fG * fU * fC * fA * fG | 1639 | GCAUGGGAGCCCAAU GAUGA CAGAGGUCAG | XXXXX XXXXX XXXXX XXXXX XXXXX XXXX |
| WV-10612 | fG * fA * fA * fG * fC * fC * fA * fA * fA * mG * mG * mG * mC * mA * mU * mG * mG * mG * mA * mG * mC * fC * fC * fA * fA * fU * fG * fA * fU * fG | 1640 | GAAGCCAAAGGGCAU GGGAG CCCAAUGAUG | XXXXX XXXXX XXXXX XXXXX XXXXX XXXX |
| WV-10613 | fA * fU * fA * fU * fC * fU * fU * fG * fA * mC * mC * mU * mC * mA * mC * mU * mU * mU * mA * mC * mC * fU * fC * fC * fU * fG * fU * fC * fU * fU | 1641 | AUAUCUUGACCUCAC UUUAC CUCCUGUCUU | XXXXX XXXXX XXXXX XXXXX XXXXX XXXX |
| WV-10614 | fA * fA * fC * fC * fU * fC * fA * fA * fA * mG * mG * mG * mA * mG * mG * mG * mA * mA * mU * mU * mA * fG * fG * fA * fG * fA * fA * fU * fA * fA | 1642 | AACCUCAAAGGGAGG GAAUU AGGAGAAUAA | XXXXX XXXXX XXXXX XXXXX XXXXX XXXX |
| WV-10615 | fG * fG * fA * fC * fA * fU * fA * fG * fU * mC * mA * mG * mC * mC * mU * mG * mU * mG * mG * mC * mA * fA * fC * fC * fU * fC * fA * fA * fA * fG | 1643 | GGACAUAGUCAGCCU GUGGC AACCUCAAAG | XXXXX XXXXX XXXXX XXXXX XXXXX XXXX |
| WV-10616 | fU * fG * fA * fG * fA * fA * fA * fC * fC * mA * mC * mC * mC * mU * mG * mA * mG * mA * mA * mG * mA * fG * fC * fA * fA * fU * fA * fA * fC * fC | 1644 | UGAGAAACCACCCUG AGAAG AGCAAUAACC | XXXXX XXXXX XXXXX XXXXX XXXXX XXXX |

TABLE A1-continued

| | | | | |
|---|---|---|---|---|
| WV-10617 | fA * fU * fG * fA * fG * fG * fG * fG * fA * mG * mG * mG * mA * mA * mA * mA * mG * mU * mG * mG * mC * fC * fA * fA * fA * fA * fG * fC * fA * fG | 1645 | AUGAGGGGAGGGAAAAGUGGCCAAAAGCAG | XXXXX XXXXX XXXXX XXXXX XXXXX XXXX |
| WV-10618 | fG * fG * fC * fC * fC * fA * fA * fG * fG * mG * mA * mU * mG * mA * mG * mG * mG * mG * mA * mG * mG * fG * fA * fA * fA * fA * fG * fU * fG * fG | 1646 | GGCCCAAGGGAUGAGGGGAGGGAAAAGUGG | XXXXX XXXXX XXXXX XXXXX XXXXX XXXX |
| WV-10619 | fA * fC * fU * fA * fC * fA * fU * fC * fU * mA * mG * mG * mC * mC * mC * mA * mA * mG * mG * mG * mA * fU * fG * fA * fG * fG * fG * fG * fA * fG | 1647 | ACUACAUCUAGGCCCAAGGGAUGAGGGGAG | XXXXX XXXXX XXXXX XXXXX XXXXX XXXX |
| WV-10620 | fA * fU * fA * fA * fA * fA * fC * fC * fC * mU * mU * mC * mA * mA * mU * mG * mU * mU * mU * mC * mC * fC * fU * fA * fC * fU * fG * fU * fC * fU | 1648 | AUAAAACCCUUCAAUGUUUCCCUACUGUCU | XXXXX XXXXX XXXXX XXXXX XXXXX XXXX |
| WV-10621 | fA * fC * fU * fG * fC * fA * fC * fU * fC * mC * mC * mU * mC * mU * mU * mA * mU * mA * mA * mA * mA * fC * fC * fC * fU * fU * fC * fA * fA * fU | 1649 | ACUGCACUCCCUCUUAUAAAACCCUUCAAU | XXXXX XXXXX XXXXX XXXXX XXXXX XXXX |
| WV-10622 | fU * fG * fU * fA * fA * fA * fU * fU * fC * mU * mA * mC * mC * mC * mC * mA * mA * mU * mU * mA * mA * fA * fG * fA * fU * fU * fA * fA * fA * fA | 1650 | UGUAAAUUCUACCCCAAUUAAAGAUUAAAA | XXXXX XXXXX XXXXX XXXXX XXXXX XXXX |
| WV-10623 | fC * fU * fC * fC * fC * fA * fG * fA * fC * mC * mC * mA * mA * mA * mU * mC * mU * mC * mU * mG * mU * fU * fU * fU * fA * fG * fA * fA * fU * fG | 1651 | CUCCCAGACCCAAAUCUCUGUUUUAGAAUG | XXXXX XXXXX XXXXX XXXXX XXXXX XXXX |
| WV-10624 | fC * fC * fC * fU * fC * fA * fC * fA * fU * mC * mC * mA * mU * mA * mA * mG * mA * mG * mG * mC * mU * fC * fU * fA * fU * fA * fU * fC * fA * fU | 1652 | CCCUCACAUCCAUAAGAGGCUCUAUAUCAU | XXXXX XXXXX XXXXX XXXXX XXXXX XXXX |
| WV-10625 | fC * fA * fU * fU * fU * fU * fU * fU * fG * mC * mC * mC * mU * mC * mA * mC * mA * mU * mC * mC * mA * fU * fA * fA * fG * fA * fG * fG * fC * fU | 1653 | CAUUUUUUGCCCUCACAUCCAUAAGAGGCU | XXXXX XXXXX XXXXX XXXXX XXXXX XXXX |
| WV-10626 | fU * fA * fA * fG * fC * fG * fU * fC * fA * mC * mC * mC * mA * mA * mC * mA * mC * mC * mU * mC * mA * fU * fA * fU * fA * fA * fU * fU * fA * fG | 1654 | UAAGCGUCACCCAACACCUCAUAUAAUUAG | XXXXX XXXXX XXXXX XXXXX XXXXX XXXX |
| WV-10627 | fC * fU * fA * fC * fU * fU * fU * fA * fU * mC * mC * mC * mU * mU * mA * mA * mG * mC * mA * mU * mG * fA * fA * fA * fC * fC * fU * fG * fA * fU | 1655 | CUACUUUAUCCCUUAAGCAUGAAACCUGAU | XXXXX XXXXX XXXXX XXXXX XXXXX XXXX |
| WV-10628 | fC * fC * fA * fA * fG * fA * fG * fG * fG * mA * mG * mG * mU * mA * mC * mU * mA * mU * mA * mU * mA * fG * fA * fU * fU * fC * fU * fA * fC * fU | 1656 | CCAAGAGGGAGGUACUAUAUAGAUUCUACU | XXXXX XXXXX XXXXX XXXXX XXXXX XXXX |
| WV-10629 | fG * fU * fG * fA * fG * fC * fC * fA * fC * mC * mG * mC * mG * mC * mC * mU * mG * mG * mC * mC * mA * fA * fC * fU * fU * fC * fU * fU * fU * fU | 1657 | GUGAGCCACCGCGCCUGGCCAACUUCUUUU | XXXXX XXXXX XXXXX XXXXX XXXXX XXXX |

TABLE A1-continued

| | | | | |
|---|---|---|---|---|
| WV-10630 | fU * fC * fG * fG * fC * fC * fU * fC * fC * mC * mA * mA * mA * mG * mU * mG * mC * mU * mG * mG * mG * fA * fU * fU * fA * fC * fA * fG * fG * fC | 1658 | UCGGCCUCCCAAAGU GCUGG GAUUACAGGC | XXXXX XXXXX XXXXX XXXXX XXXXX XXXX |
| WV-10634 | fU * RfC * SfA * SfA * SfG * SfG * SmAfA * SmGmA * SfU * RmGmGfC * SfA * SfU * RfU * RfU * RfC * SfU | 1659 | UCAAGGAAGAUGGCA UUUCU | RSSSSSOSO SROOSSRRRS |
| WV-10635 | fU * SfC * RfA * SfA * SfG * SfG * SmAfA * SmGmA * SfU * SmGmGfC * RFA * SfU * SfU * SfU * SfC * RfU | 1660 | UCAAGGAAGAUGGCA UUUCU | SRSSSSOSO SSOORSSSSR |
| WV-10636 | fU * SfC * SfA * RfA * RfG * SfG * SmAfA * RmGmA * SfU * SmGmGfC * SfA * RfU * SfU * SfU * SfC * SfU | 1661 | UCAAGGAAGAUGGCA UUUCU | SSRRSSORO SSOOSRSSSS |
| WV-10637 | fU * SfC * SfA * SfA * SfG * RfG * RmAfA * SmGmA * SfU * SmGmGfC * SfA * SfU * SfU * SfU * SfC * SfU | 1662 | UCAAGGAAGAUGGCA UUUCU | SSSSRROSO SSOOSSSSSS |
| WV-10670 | fC * SfU * SfC * SfC * SfG * SfG * SmU * SmU * SmCmU * SmG * SmA * SmAmG * SfG * SfU * SfG * SfU * SfU * SfC | 1663 | CUCCGGUUCUGAAGG UGUUC | SSSSSSSSO SSSOSSSSSS |
| WV-10671 | fC * SfU * SfC * SfC * SfG * SfG * SmU * SmU * SmC * SmU * SmG * SmA * SmAmGfG * SfU * SfG * SfU * SfU * SfC | 1664 | CUCCGGUUCUGAAGG UGUUC | SSSSSSSSS SSSOOSSSSS |
| WV-10672 | fC * SfU * SfC * SfC * SfG * SfG * SmU * SmU * SmCmU * SmG * SmA * SmAmGfG * SfU * SfG * SfU * SfU * SfC | 1665 | CUCCGGUUCUGAAGG UGUUC | SSSSSSSSO SSSOOSSSSS |
| WV-10868 | fU * RfC * SfA * SfA * SfG * SfG * SmAfA * SmGmA * SfU * SmGmGfC * SfA * SfU * SfU * SfU * SfC * SfU | 1666 | UCAAGGAAGAUGGCA UUUCU | RSSSSS O S O SS O O SSSSSS |
| WV-10869 | fU * SfC * SfA * SfA * SfG * SfG * SmAfA * SmGmA * SfU * RmGmGfC * SfA * SfU * SfU * SfU * SfC * SfU | 1667 | UCAAGGAAGAUGGCA UUUCU | SSSSSS O S O SR O O SSSSSS |
| WV-10870 | fU * SfC * SfA * SfA * SfG * SfG * SmAfA * SmGmA * SfU * SmGmGfC * SfA * SfU * SfU * SfU * RfC * SfU | 1668 | UCAAGGAAGAUGGCA UUUCU | SSSSSS O S O SS O O SSSSRS |
| WV-10871 | fU * SfC * SfA * SfA * SfG * SfG * SmAfA * SmGmA * SfU * SmGmGfC * SfA * SfU * SfU * RfU * SfC * SfU | 1669 | UCAAGGAAGAUGGCA UUUCU | SSSSSS O S O SS O O SSSRSS |
| WV-10872 | fU * SfC * SfA * SfA * SfG * SfG * SmAfA * SmGmA * SfG * SmGmGfC * SfA * SfU * RfU * SfU * SfC * SfU | 1670 | UCAAGGAAGAUGGCA UUUCU | SSSSSS O S O SS O O SSRSSS |
| WV-10873 | fU * SfC * SfA * SfA * SfG * SfG * SmAfA * SmGmA * SfU * SmGmGfC * SfA * SfU * SfU * SfU * SfC * RfU | 1671 | UCAAGGAAGAUGGCA UUUCU | SSSSSS O S O SS O O SSSSSR |
| WV-10874 | fG * SfC * SfA * SfA * SfG * SfG * SmAfA * SmGmA * SfU * SmGmGfC * RfA * SfU * SfU * SfU * SfC * SfU | 1672 | UCAAGGAAGAUGGCA UUUCU | SSSSSS O S O SS O O RSSSSS |
| WV-10875 | fU * SfC * RfA * SfA * SfG * SfG * SmAfA * SmGmA * SfU * SmGmGfC * SfA * SfU * SfU * SfU * SfC * SfU | 1673 | UCAAGGAAGAUGGCA UUUCU | SRSSSS O S O SS O O SSSSSS |
| WV-10876 | fU * SfC * SfA * SfA * SfG * SfG * SmAfA * SmGmA * SfU * SmGmGfC * SfA * RfU * SfU * SfU * SfC * SfU | 1674 | UCAAGGAAGAUGGCA UUUCU | SSSSSS O S O SS O O SRSSSS |
| WV- | fU * SfC * SfA * SfA * SfG * SfG * SmAfA * RmGmA * SfU * SmGmGfC | 1675 | UCAAGGAAGAUGGCA | SSSSSS O R O SS O |

TABLE A1-continued

| | | | | |
|---|---|---|---|---|
| 10877 | * SfA * SfU * SfU * SfU * SfC * SfU | | UUUCU | O SSSSSS |
| WV-10878 | fU * SfC * SfA * SfA * RfG * SfG * SmAfA * SmGmA * SfU * SmGmGfC * SfA * SfU * SfU * SfU * SfC * SfU | 1676 | UCAAGGAAGAUGGCA UUUCU | SSSRSS O S O SS O O SSSSSS |
| WV-10879 | fU * SfC * SfA * RfA * SfG * SfG * SmAfA * SmGmA * SfU * SmGmGfC * SfA * SfU * SfU * SfU * SfC * SfU | 1677 | UCAAGGAAGAUGGCA UUUCU | SSRSSS O S O SS O O SSSSSS |
| WV-10880 | fU * SfC * SfA * SfA * SfG * RfG * SmAfA * SmGmA * SfU * SmGmGfC * SfA * SfU * SfU * SfU * SfC * SfU | 1678 | UCAAGGAAGAUGGCA UUUCU | SSSSRS O S O SS O O SSSSSS |
| WV-10881 | fU * SfC * SfA * SfA * SfG * SfG * RmAfA * SmGmA * SfU * SmGmGfC * SfA * SfU * SfU * SfU * SfC * SfU | 1679 | UCAAGGAAGAUGGCA UUUCU | SSSSSR O S O SS O O SSSSSS |
| WV-10882 | fU * SfC * SfA * SfA * SfG * SfG * SmAfA * SmGmA * RfU * SmGmGfC * SfA * SfU * SfU * SfU * SfC * SfU | 1680 | UCAAGGAAGAUGGCA UUUCU | SSSSSS O S O RS O O SSSSSS |
| WV-10883 | Mod012L001fU * SfC * SfA * SfA * SfG * SfG * SmAfA * SmGmA * SfU * SmGmGfC * SfA * SfU * SfU * SfU * SfU * SfU | 1681 | UCAAGGAAGAUGGCA UUUCU | O SSSSSS O S O SS O O SSSSSS |
| WV-10884 | Mod085L001fU * SfC * SfA * SfA * SfG * SfG * SmAfA * SmGmA * SfU * SmGmGfC * SfA * SfU * SfU * SfU * SfC * SfU | 1682 | UCAAGGAAGAUGGCA UUUCU | O SSSSSS O S O SS O O SSSSSS |
| WV-10885 | Mod086L001fU * SfC * SfA * SfA * SfG * SfG * SmAfA * SmGmA * SfU * SmGmGfC * SfA * SfU * SfU * SfU * SfC * SfU | 1683 | UCAAGGAAGAUGGCA UUUCU | O SSSSSS O S O SS O O SSSSSS |
| WV-10886 | fU * SfC * SfA * SfA * SfG * SfG * SmAfA * SmGmA * SfU * SmGmGfC * SfA * SfU * SfU * SfU * SfC * SfUL004Mod012 | 1684 | UCAAGGAAGAUGGCA UUUCU | SSSSSS O S O SS O O SSSSSSO |
| WV-10887 | fU * SfC * SfA * SfA * SfG * SfG * SmAfA * SmGmA * SfU * SmGmGfC * SfA * SfU * SfU * SfU * SfC * SfUL004Mod085 | 1685 | UCAAGGAAGAUGGCA UUUCU | SSSSSS O S O SS O O SSSSSSO |
| WV-10888 | fU * SfC * SfA * SfA * SfG * SfG * SmAfA * SmGmA * SfU * SmGmGfC * SfA * SfU * SfU * SfU * SfC * SfUL004Mod086 | 1686 | UCAAGGAAGAUGGCA UUUCU | SSSSSS O S O SS O O SSSSSSO |
| WV-11047 | fU * SfU * SfA * SfA * SfA * SfA * SmA * SmG * SmU * SmC * SmU * SmG * SmC * SmU * SfA * SfA * SfA * SfA * SfU * SfG | 1687 | UUAAAAAGUCUGCUA AAAUG | SSSSSSSSS SSSSSSSSSS |
| WV-11048 | fA * SfA * SfG * SfU * SfC * SfU * SmG * SmC * SmU * SmA * SmA * SmA * SmA * SmU * SfG * SfU * SfU * SfU * SfU * SfC | 1688 | AAGUCUGCUAAAAUG UUUUC | SSSSSSSSS SSSSSSSSSS |
| WV-11049 | fU * SfG * SfC * SfU * SfA * SfA * SmA * SmA * SmU * SmG * SmU * SmU * SmU * SmU * SfC * SfA * SfU * SfU * SfC * SfC | 1689 | UGCUAAAAUGUUUUC AUUCC | SSSSSSSSS SSSSSSSSSS |
| WV-11050 | fA * SfA * SfA * SfU * SfG * SfU * SmU * SmU * SmU * SmC * SmA * SmU * SmU * SmC * SfC * SfU * SfA * SfU * SfU * SfA | 1690 | AAAUGUUUUCAUUCC UAUUA | SSSSSSSSS SSSSSSSSSS |
| WV-11051 | fU * SfU * SfU * SfU * SfC * SfA * SmU * SmU * SmC * SmC * SmU * SmA * SmU * SmU * SfA * SfG * SfA * SfU * SfC * SfU | 1691 | UUUUCAUUCCUAUUA GAUCU | SSSSSSSSS SSSSSSSSSS |
| WV-11052 | fA * SfU * SfU * SfC * SfC * SfU * SmA * SmU * SmU * SmA * SmG * SmA * SmU * SmC * SfU * SfG * SfU * SfC * SfG * SfC | 1692 | AUUCCUAUUAGAUCU GUCGC | SSSSSSSSS SSSSSSSSSS |

TABLE A1-continued

| | | | | |
|---|---|---|---|---|
| WV-11053 | fU * SfA * SfU * SfU * SfA * SfG * SmA * SmU * SmC * SmU * SmG * SmU * SmC * SmG * SfC * SfC * SfC * SfU * SfA * SfC | 1693 | UAUUAGAUCUGUCGCCCUAC | SSSSSSSSSSSSSSSSSSS |
| WV-11054 | fG * SfA * SfU * SfC * SfU * SfG * SmU * SmC * SmG * SmC * SmC * SmC * SmU * SmA * SfC * SfC * SfU * SfC * SfU * SfU | 1694 | GAUCUGUCGCCCUACCUCUU | SSSSSSSSSSSSSSSSSSS |
| WV-11055 | fG * SfU * SfC * SfG * SfC * SfC * SmC * SmU * SmA * SmC * SmC * SmU * SmC * SmU * SfU * SfU * SfU * SfU * SfU * SfC | 1695 | GUCGCCCUACCUCUUUUUUC | SSSSSSSSSSSSSSSSSSS |
| WV-11056 | fC * SfC * SfU * SfA * SfC * SfC * SmU * SmC * SmU * SmU * SmU * SmU * SmU * SmU * SfC * SfU * SfG * SfU * SfC * SfU | 1696 | CCUACCUCUUUUUUCUGUCU | SSSSSSSSSSSSSSSSSSS |
| WV-11057 | fC * SfU * SfC * SfU * SfU * SfU * SmU * SmU * SmU * SmC * SmU * SmG * SmU * SmC * SfU * SfG * SfA * SfC * SfA * SfG | 1697 | CUCUUUUUUCUGUCUGACAG | SSSSSSSSSSSSSSSSSSS |
| WV-11058 | fU * SfU * SfU * SfU * SfC * SfU * SmG * SmU * SmC * SmU * SmG * SmA * SmC * SmA * SfG * SfC * SfU * SfG * SfU * SfU | 1698 | UUUUCUGUCUGACAGCUGUU | SSSSSSSSSSSSSSSSSSS |
| WV-11059 | fU * SfG * SfU * SfC * SfU * SfG * SmA * SmC * SmA * SmG * SmC * SmU * SmG * SmU * SfU * SfU * SfG * SfC * SfA * SfG | 1699 | UGUCUGACAGCUGUUUGCAG | SSSSSSSSSSSSSSSSSSS |
| WV-11060 | fG * SfA * SfC * SfA * SfG * SfC * SmU * SmG * SmU * SmU * SmU * SmG * SmC * SmA * SfG * SfA * SfC * SfC * SfU * SfC | 1700 | GACAGCUGUUUGCAGACCUC | SSSSSSSSSSSSSSSSSSS |
| WV-11061 | fU * SfU * SfG * SfU * SfU * SfU * SmG * SmC * SmA * SmG * SmA * SmC * SmC * SmU * SfC * SfC * SfU * SfG * SfC * SfC | 1701 | CUGUUUGCAGACCUCCUGCC | SSSSSSSSSSSSSSSSSSS |
| WV-11062 | fU * SfG * SfC * SfA * SfG * SfA * SmC * SmC * SmU * SmC * SmC * SmU * SmG * SmC * SfC * SfA * SfC * SfC * SfG * SfC | 1702 | UGCAGACCUCCUGCCACCGC | SSSSSSSSSSSSSSSSSSS |
| WV-11063 | fA * SfC * SfC * SfU * SfC * SfC * SmU * SmG * SmC * SmC * SmA * SmC * SmC * SmG * SfC * SfA * SfG * SfA * SfU * SfU | 1703 | ACCUCCUGCCACCGCAGAUU | SSSSSSSSSSSSSSSSSSS |
| WV-11064 | fC * SfU * SfG * SfC * SfC * SfA * SmC * SmC * SmG * SmC * SmA * SmG * SmA * SmU * SfU * SfC * SfA * SfG * SfG * SfC | 1704 | CUGCCACCGCAGAUUCAGGC | SSSSSSSSSSSSSSSSSSS |
| WV-11065 | fA * SfC * SfC * SfG * SfC * SfA * SmG * SmA * SmU * SmU * SmC * SmA * SmG * SmG * SfC * SfU * SfU * SfC * SfC * SfC | 1705 | ACCGCAGAUUCAGGCUUCCC | SSSSSSSSSSSSSSSSSSS |
| WV-11066 | fA * SfG * SfA * SfU * SfG * SfC * SmA * SmG * SmG * SmC * SmU * SmU * SmC * SmC * SfC * SfA * SfA * SfU * SfU * SfU | 1706 | AGAUUCAGGCUUCCCAAUUU | SSSSSSSSSSSSSSSSSSS |
| WV-11067 | fC * SfA * SfG * SfG * SfC * SfU * SmU * SmC * SmC * SmC * SmA * SmA * SmU * SmU * SfU * SfU * SfU * SfC * SfC * SfU | 1707 | CAGGCUUCCCAAUUUUUCCU | SSSSSSSSSSSSSSSSSSS |
| WV-11068 | fU * SfU * SfC * SfC * SfC * SfA * SmA * SmU * SmU * SmU * SmU * SmU * SmC * SmC * SfU * SfG * SfU * SfA * SfG * SfA | 1708 | UUCCCAAUUUUUCCUGUAGA | SSSSSSSSSSSSSSSSSSS |
| WV-11069 | fA * SfA * SfU * SfU * SfU * SfU * SmU * SmC * SmC * SmU * SmG * SmU * SmA * SmG * SfA * SfA * SfU * SfA * SfC * SfU | 1709 | AAUUUUUCCUGUAGAAUACU | SSSSSSSSSSSSSSSSSSS |
| WV-11070 | fU * SfU * SfC * SfC * SfU * SfG * SmU * SmA * SmG * SmA * SmA * SmU * SmA * SmC * SfU * SfG * SfG * SfC * SfA * SfU | 1710 | UUCCUGUAGAAUACUGGCAU | SSSSSSSSSSSSSSSSSSS |

TABLE A1-continued

| | | | | |
|---|---|---|---|---|
| WV-11071 | fG * SfU * SfA * SfG * SfA * SfA * SmU * SmA * SmC * SmU * SmG * SmG * SmC * SmA * SfU * SfC * SfU * SfG * SfU * SfU | 1711 | GUAGAAUACUGGCAUCUGUU | SSSSSSSSSSSSSSSSSSS |
| WV-11072 | fA * SfG * SfA * SfC * SfU * SfG * SmG * SmC * SmA * SmU * SmC * SmU * SmG * SmU * SfU * SfU * SfU * SfU * SfG * SfA | 1712 | AUACUGGCAUCUGUUUUUGA | SSSSSSSSSSSSSSSSSSS |
| WV-11073 | fG * SfG * SfC * SfA * SfU * SfC * SmU * SmG * SmU * SmU * SmU * SmU * SmU * SmG * SfA * SfG * SfG * SfA * SfU * SfU | 1713 | GGCAUCUGUUUUUGAGGAUU | SSSSSSSSSSSSSSSSSSS |
| WV-11074 | fC * SfU * SfG * SfU * SfU * SfU * SmU * SmU * SmG * SmA * SmG * SmG * SmA * SmU * SfU * SfG * SfC * SfU * SfG * SfA | 1714 | CUGUUUUUGAGGAUUGCUGA | SSSSSSSSSSSSSSSSSSS |
| WV-11075 | fU * SfU * SfU * SfG * SfA * SfG * SmG * SmA * SmU * SmU * SmG * SmC * SmU * SmG * SfA * SfA * SfU * SfU * SfA * SfU | 1715 | UUUGAGGAUUGCUGAAUUAU | SSSSSSSSSSSSSSSSSSS |
| WV-11076 | fG * SfG * SfA * SfU * SfU * SfG * SmC * SmU * SmG * SmA * SmA * SmU * SmU * SmA * SfU * SfU * SfU * SfC * SfU * SfU | 1716 | GGAUUGCUGAAUUAUUUCUU | SSSSSSSSSSSSSSSSSSS |
| WV-11077 | fG * SfC * SfU * SfG * SfA * SfA * SmU * SmU * SmA * SmU * SmU * SmU * SmC * SmU * SfU * SfC * SfC * SfC * SfC * SfA | 1717 | GCUGAAUUAUUUCUUCCCCA | SSSSSSSSSSSSSSSSSSS |
| WV-11078 | fA * SfU * SfU * SfA * SfU * SfU * SmU * SmC * SmU * SmU * SmC * SmC * SmC * SmC * SfA * SfG * SfU * SfU * SfG * SfC | 1718 | AUUAUUUCUUCCCCAGUUGC | SSSSSSSSSSSSSSSSSSS |
| WV-11079 | fU * SfU * SfC * SfU * SfU * SfC * SmC * SmC * SmC * SmA * SmG * SmU * SmU * SmG * SfC * SfA * SfU * SfU * SfC * SfA | 1719 | UUCUUCCCCAGUUGCAUUCA | SSSSSSSSSSSSSSSSSSS |
| WV-11080 | fC * SfC * SfC * SfC * SfA * SfG * SmU * SmU * SmG * SmC * SmA * SmU * SmU * SmC * SfA * SfA * SfU * SfG * SfU * SfU | 1720 | CCCCAGUUGCAUUCAAUGUU | SSSSSSSSSSSSSSSSSSS |
| WV-11081 | fG * SfU * SfU * SfG * SfC * SfA * SmU * SmU * SmC * SmA * SmA * SmU * SmG * SmU * SfU * SfU * SfU * SfG * SfA * SfC | 1721 | GUUGCAUUCAAUGUUCUGAC | SSSSSSSSSSSSSSSSSSS |
| WV-11082 | fA * SfU * SfU * SfC * SfA * SfA * SmU * SmG * SmU * SmU * SmC * SmU * SmG * SmA * SfC * SfA * SfA * SfC * SfA * SfG | 1722 | AUUCAAUGUUCUGACAACAG | SSSSSSSSSSSSSSSSSSS |
| WV-11083 | fA * SfU * SfG * SfU * SfU * SfC * SmU * SmG * SmA * SmC * SmA * SmA * SmC * SmA * SfG * SfU * SfU * SfU * SfG * SfC | 1723 | AUGUUCUGACAACAGUUUGC | SSSSSSSSSSSSSSSSSSS |
| WV-11084 | fC * SfU * SfG * SfA * SfC * SfA * SmA * SmC * SmA * SmG * SmU * SmU * SmU * SmG * SfC * SfC * SfG * SfC * SfU * SfG | 1724 | CUGACAACAGUUUGCCGCUG | SSSSSSSSSSSSSSSSSSS |
| WV-11085 | fA * SfA * SfC * SfA * SfG * SfU * SmU * SmU * SmG * SmC * SmC * SmG * SmC * SmU * SfG * SfC * SfC * SfC * SfA * SfA | 1725 | AACAGUUUGCCGCUGCCCAA | SSSSSSSSSSSSSSSSSSS |
| WV-11086 | fU * SfU * SfU * SfG * SfC * SfC * SmG * SmC * SmU * SmG * SmC * SmC * SmC * SmA * SfA * SfU * SfG * SfC * SfC * SfA | 1726 | UUUGCCGCUGCCCAAUGCCA | SSSSSSSSSSSSSSSSSSS |
| WV-11087 | fC * SfG * SfC * SfU * SfG * SfC * SmC * SmC * SmA * SmA * SmU * SmG * SmC * SmC * SfA * SfU * SfC * SfC * SfU * SfG | 1727 | CGCUGCCCAAUGCCAUCCUG | SSSSSSSSSSSSSSSSSSS |
| WV- | fC * SfC * SfC * SfA * SfA * SfU * SmG * SmC * SmC * SmA * SmU * | 1728 | CCCAAUGCCAUCCUG | SSSSSSSSS |

TABLE A1-continued

| | | | | |
|---|---|---|---|---|
| 11088 | SmC * SmC * SmU * SfG * SfG * SfA * SfG * SfU * SfU | | GAGUU | SSSSSSSSSS |
| WV-11089 | fU * SfG * SfC * SfC * SfA * SfU * SmC * SmC * SmU * SmG * SmG * SmA * SmG * SmU * SfU * SfC * SfC * SfU * SfG * SfU | 1729 | UGCCAUCCUGGAGUU CCUGU | SSSSSSSSS SSSSSSSSSS |
| WV-11090 | fU * SfC * SfC * SfU * SfG * SfG * SmA * SmG * SmU * SmU * SmC * SmC * SmU * SmG * SfU * SfA * SfA * SfG * SfA * SfU | 1730 | UCCUGGAGUUCCUGU AAGAU | SSSSSSSSS SSSSSSSSSS |
| WV-11091 | fG * SfA * SfG * SfU * SfU * SfC * SmC * SmU * SmG * SmU * SmA * SmA * SmG * SmA * SfU * SfA * SfC * SfC * SfA * SfA | 1731 | GAGUUCCUGUAAGAU ACCAA | SSSSSSSSS SSSSSSSSSS |
| WV-11092 | fC * SfC * SfU * SfG * SfU * SfA * SmA * SmG * SmA * SmU * SmA * SmC * SmC * SmA * SfA * SfA * SfA * SfA * SfG * SfG | 1732 | CCUGUAAGAUACCAA AAAGG | SSSSSSSSS SSSSSSSSSS |
| WV-11093 | fA * SfA * SfG * SfA * SfU * SfA * SmC * SmC * SmA * SmA * SmA * SmA * SmA * SmG * SfG * SfC * SfA * SfA * SfA * SfA | 1733 | AAGAUACCAAAAAGG CAAAA | SSSSSSSSS SSSSSSSSSS |
| WV-11094 | fA * SfC * SfC * SfA * SfA * SfA * SmA * SmA * SmG * SmG * SmC * SmA * SmA * SmA * SfA * SfC * SfA * SfA * SfA * SfA | 1734 | ACCAAAAAGGCAAAA CAAAA | SSSSSSSSS SSSSSSSSSS |
| WV-11095 | fA * SfA * SfA * SfG * SfG * SfC * SmA * SmA * SmA * SmA * SmC * SmA * SmA * SmA * SfA * SfA * SfU * SfG * SfA * SfA | 1735 | AAAGGCAAAACAAAA AUGAA | SSSSSSSSS SSSSSSSSSS |
| WV-11096 | fC * SfA * SfA * SfA * SfA * SfC * SmA * SmA * SmA * SmA * SmA * SmU * SmG * SmA * SfA * SfG * SfC * SfC * SfC * SfC | 1736 | CAAAACAAAAAUGAA GCCCC | SSSSSSSSS SSSSSSSSSS |
| WV-11097 | fC * SfA * SfA * SfA * SfA * SfA * SmU * SmG * SmA * SmA * SmG * SmC * SmC * SmC * SfC * SfA * SfU * SfG * SfU * SfC | 1737 | CAAAAAUGAAGCCCC AUGUC | SSSSSSSSS SSSSSSSSSS |
| WV-11098 | fA * SfU * SfG * SfA * SfA * SfG * SmC * SmC * SmC * SmC * SmA * SmU * SmG * SmU * SfC * SfU * SfU * SfU * SfU * SfU | 1738 | AUGAAGCCCCAUGUC UUUUU | SSSSSSSSS SSSSSSSSSS |
| WV-11099 | fG * SfC * SfC * SfC * SfC * SfA * SmU * SmG * SmU * SmC * SmU * SmU * SmU * SmU * SfU * SfA * SfU * SfU * SfU * SfG | 1739 | GCCCCAUGUCUUUUU AUUUG | SSSSSSSSS SSSSSSSSSS |
| WV-11100 | fA * SfU * SfG * SfU * SfC * SfU * SmU * SmU * SmU * SmU * SmA * SmU * SmU * SmU * SfG * SfA * SfG * SfA * SfA * SfA | 1740 | AUGUCUUUUUAUUU GAGAAA | SSSSSSSSS SSSSSSSSSS |
| WV-11101 | fU * SfU * SfU * SfU * SfU * SfA * SmU * SmU * SmU * SmG * SmA * SmG * SmA * SmA * SfA * SfA * SfG * SfA * SfU * SfU | 1741 | UUUUUAUUUGAGAA AAGAUU | SSSSSSSSS SSSSSSSSSS |
| WV-11102 | fA * SfU * SfU * SfU * SfG * SfA * SmG * SmA * SmA * SmA * SmA * SmG * SmA * SmU * SfU * SfA * SfA * SfA * SfC * SfA | 1742 | AUUUGAGAAAAGAU UAAACA | SSSSSSSSS SSSSSSSSSS |
| WV-11103 | fA * SfG * SfA * SfA * SfA * SfA * SmG * SmA * SmU * SmU * SmA * SmA * SmA * SmC * SfA * SfG * SfU * SfG * SfU * SfG | 1743 | AGAAAAGAUUAAAC AGUGUG | SSSSSSSSS SSSSSSSSSS |
| WV-11104 | fA * SfG * SfA * SfU * SfU * SfA * SmA * SmA * SmC * SmA * SmG * SmU * SmG * SmU * SfG * SfC * SfU * SfA * SfC * SfC | 1744 | AGAUUAAACAGUGU GCUACC | SSSSSSSSS SSSSSSSSSS |
| WV-11105 | fA * SfA * SfA * SfC * SfA * SfG * SmU * SmG * SmU * SmG * SmC * SmU * SmA * SmC * SfC * SfA * SfC * SfA * SfU * SfG | 1745 | AAACAGUGUGCUACC ACAUG | SSSSSSSSS SSSSSSSSSS |

TABLE A1-continued

| | | | | |
|---|---|---|---|---|
| WV-11231 | fU * fC * fA * fC * fU * fC * mAfG * mAmU * fA * mGmUfU * fG * fA * fA * fG * fC * fC | 1746 | UCACUCAGAUAGUUGAAGCC | XXXXXX O X O XX O O XXXXXX |
| WV-11232 | fU * fC * fA * fC * fU * fC * fA * fG * mAmU * fA * mGmUfU * fG * fA * fA * fG * fC * fC | 1747 | UCACUCAGAUAGUUGAAGCC | XXXXXXXX O XX O O XXXXXX |
| WV-11233 | fU * fC * fA * fC * fU * fC * mAfG * fA * mU * fA * mGmUfU * fG * fA * fA * fG * fC * fC | 1748 | UCACUCAGAUAGUUGAAGCC | XXXXXX O XXXX O O XXXXXX |
| WV-11234 | fU * RfC * RfA * RfC * RfU * RfC * RmAfG * RmAmU * RfA * RmGmUfU * RfG * RfA * RfA * RfG * RfC * RfC | 1749 | UCACUCAGAUAGUUGAAGCC | RRRRRR O R O RR O O RRRRRR |
| WV-11235 | fU * RfC * RfA * RfC * RfU * RfC * RfA * RfG * RmAmfU * RfA * RmGmUfU * RfG * RfA * RfA * RfG * RfC * RfC | 1750 | UCACUCAGAUAGUUGAAGCC | RRRRRRRR O RR O O RRRRRR |
| WV-11236 | fU * RfC * RfA * RfC * RfU * RfC * RmAfG * RfA * RmU * RfA * RmGmUfU * RfG * RfA * RfA * RfG * RfC * RfC | 1751 | UCACUCAGAUAGUUGAAGCC | RRRRRR O RRRR O O RRRRRR |
| WV-11237 | fU * SfC * SfA * SfA * SfG * SfG * SmAn001fA * SmGn001mA * SfU * SmGn001mGn001fC * SfA * SfU * SfU * SfU * SfC * SfU | 1752 | UCAAGGAAGAUGGCAUUUCU | SSSSSSn O Sn O SSn O n O SSSSSS |
| WV-11238 | fU * SfC * SfA * SfA * SfG * SfG * SmAn001SfA * SmGn001SmA * SfU * SmGn001SmGn001SfC * SfA * SfU * SfU * SfU * SfC * SfU | 1753 | UCAAGGAAGAUGGCAUUUCU | SSSSSSnSSnSS SnSnSSSSSSS |
| WV-11239 | fU * SfC * SfA * SfA * SfG * SfG * SmAn001RfA * SmGn001RmA * SfU * SmGn001RmGn001RfC * SfA * SfU * SfU * SfU * SfC * SfU | 1754 | UCAAGGAAGAUGGCAUUUCU | SSSSSSnRSnRSSn RnRSSSSSS |
| WV-11340 | fC * SfU * SfC * SfC * SfG * SfG * SfU * SfU * SmCn001fU * SmG * SfA * SmAn001mGn001fG * SfU * SfG * SfU * SfU * SfC | 1755 | CUCCGGUUCUGAAGGUGUUC | SSSSSSSSn O SSSn O n O SSSSS |
| WV-11341 | fC * SfU * SfC * SfC * SfG * SfG * SfU * SfU * SmCn001fU * SmG * SfA * SmAn001fG * SfG * SfU * SfG * SfU * SfU * SfC | 1756 | CUCCGGUUCUGAAGGUGUUC | SSSSSSSSn O SSSn O SSSSSS |
| WV-11342 | fC * SfU * SfC * SfC * SfG * SfG * SfU * SfU * SmCn001fU * SmG * SfA * SmAn001mG * SfG * SfU * SfG * SfU * SfU * SfC | 1757 | CUCCGGUUCUGAAGGUGUUC | SSSSSSSSn O SSSn O SSSSSS |
| WV-11343 | fU * SfC * SfA * SfC * SfU * SfC * SmAn001fG * SmAn001mU * SfA * SmGn001mUn001fU * SfG * SfA * SfA * SfG * SfC * SfC | 1758 | UCACUCAGAUAGUUGAAGCC | SSSSSSn O Sn O SSn O n O SSSSSS |
| WV-11344 | fU * SfC * SfA * SfC * SfU * SfC * SfA * SfG * SmAn001mU * SfA * SmGn001mUn001fU * SfG * SfA * SfA * SfG * SfC * SfC | 1759 | UCACUCAGAUAGUUGAAGCC | SSSSSSSSn O SSn O n O SSSSSS |
| WV-11345 | fU * SfC * SfA * SfC * SfU * SfC * SmAn001fG * SfA* SmU * SfA * SmGn001mUn001fU SfG * SfA * SfA * SfG * SfC * SfC | 1760 | UCACUCAGAUAGUUGAAGCC | SSSSSSn O SSSSn O n O SSSSSS |
| WV-11346 | fU * SfC * SfA * SfC * SfU * SfC * SmAn001fG * SmAn001mU * SfA * SfG * SmUn001fU * SfG * SfA * SfA * SfG * SfC * SfC | 1761 | UCACUCAGAUAGUUGAAGCC | SSSSSSn O Sn O SSSn O SSSSSS |
| WV-11347 | fU * SfC * SfA * SfC * SfU * SfC * SmAn001fG * SmAn001mU * SfA * SmGn001fU * SfU * SfG * SfA * SfA * SfG * SfC * SfC | 1762 | UCACUCAGAUAGUUGAAGCC | SSSSSSn O Sn O SSn O SSSSSSS |
| WV-11544 | BrfUfCfAfCfUfCmAfGfAmU fAmGmUfUfGfAfAfGfCfC | 1763 | UCACUCAGAUAGUUGAAGCC | SSSSSSOSSSS OOSSSSSS |

TABLE A1-continued

| | | | | |
|---|---|---|---|---|
| WV-11545 | Acet5fUfCfAfCfUfCmAfGf AmUfAmGmUfUfGfAfAfGfCfC | 1764 | UCACUCAGAUAGUUGAAGCC | SSSSSSOSSSSOOSSSSSS |
| WV-11546 | BrfUfCfAfCfUfCmAfGfAmU fAmGmUfUfGfAfAfGfCfC | 1765 | UCACUCAGAUAGUUGAAGCC | XXXXXXOXXXXOOXXXXXX |
| WV-11547 | Acet5fUfCfAfCfUfCmAfGf AmUfAmGmUfUfGfAfAfGfCfC | 1766 | UCACUCAGAUAGUUGAAGCC | XXXXXXOXXXXOOXXXXXX |
| WV-12123 | fC * SfU * SfC * SfC * SfG * SfG * SfU * SfU * SmCn001 fUn001 mGn001 fAn001 mAn001mG * SfG * SfU * SfG * SfU * SfU * SfC | 1767 | CUCCGGUUCUGAAGGUGUUC | SSSSSSSSnXnXnXnXnX SSSSSS |
| WV-12124 | fC * SfU * SfC * SfC * SfG * SfG * SfU * SfU * SmCn001fUn001mG * SfA * SmAn001mG * SfG * SfU * SfG * SfU * SfU * SfC | 1768 | CUCCGGUUCUGAAGGUGUUC | SSSSSSSSnXnXSSnXSSSSSS |
| WV-12125 | fC * SfU * SfC * SfC * SfG * SfG * SfU * SfU * SmCn001fU * SmGn001fA * SmAn001mG * SfG * SfU * SfG * SfU * SfU * SfC | 1769 | CUCCGGUUCUGAAGGUGUUC | SSSSSSSSnXSnXSnXSSSSSS |
| WV-12126 | fC * SfU * SfC * SfC * SfG * SfG * SfU * SfU * SmCn001fU * SmG * SfAn001mAn001mG * SfG * SfU * SfG * SfU * SfU * SfC | 1770 | CUCCGGUUCUGAAGGUGUUC | SSSSSSSSnXSSnXnXSSSSSS |
| WV-12127 | fC * SfU * SfC * SfC * SfG * SfG * SfU * SfU * SmCn001fU * SmGn001fAn001mAn001mG * SfG * SfU * SfG * SfU * SfU * SfC | 1771 | CUCCGGUUCUGAAGGUGUUC | SSSSSSSSnXSnXnXnXSSSSSS |
| WV-12128 | fC * SfU * SfC * SfC * SfG * SfG * SfU * SfU * SmCn001fUn001mG * SfAn001mAn001mG * SfG * SfU * SfG * SfG * SfU * SfC | 1772 | CUCCGGUUCUGAAGGUGUUC | SSSSSSSSnXnXSnXnXSSSSSS |
| WV-12129 | fC * SfU * SfC * SfC * SfG * SfG * SfU * SfU * SmCn001fUn001mGn001fA * SmAn001mG * SfG * SfU * SfG * SfU * SfU * SfC | 1773 | CUCCGGUUCUGAAGGUGUUC | SSSSSSSSnXnXnXSnXSSSSSS |
| WV-12130 | fU * SfC * SfA * SfA * SfG * SfG * SmAn001fAn001mGn001 mAn001 fUn001 mGn001 mGn001fC * SfA * SfU * SfU * SfU * SfC * SfU | 1774 | UCAAGGAAGAUGGCAUUUCU | SSSSSSnXnXnXnXnX nXnXSSSSSS |
| WV-12131 | fU * SfC * SfA * SfA * SfG * SfG * SmAn001fAn001mGn001mA * SfU * SmGn001mGn001fC * SfA * SfU * SfU * SfU * SfC * SfU | 1775 | UCAAGGAAGAUGGCAUUUCU | SSSSSSnXnXnXSSnXnX SSSSSS |
| WV-12132 | fU * SfC * SfA * SfA * SfG * SfG * SmAn001fA * SmGn001mAn001fU * SmGn001mGn001fC * SfA * SfU * SfU * SfU * SfC * SfU | 1776 | UCAAGGAAGAUGGCAUUUCU | SSSSSSnXSnXnXSnXnX SSSSSS |
| WV-12133 | fU * SfC * SfA * SfA * SfG * SfG * SmAn001fA * SmGn001mA * SfUn001mGn001mGn001fC * SfA * SfU * SfU * SfU * SfC * SfU | 1777 | UCAAGGAAGAUGGCAUUUCU | SSSSSSnXSnXSnXnXnX SSSSSS |
| WV-12134 | fU * SfC * SfA * SfA * SfG * SfG * SmAn001fA * SmGn001mAn001fUn001 mGn001 mGn001fC * SfA * SfU * SfU * SfU * SfC * SfU | 1778 | UCAAGGAAGAUGGCAUUUCU | SSSSSSnXSnXnXnXnXnX SSSSSS |
| WV-12135 | fU * SfC * SfA * SfA * SfG * SfG * SmAn001fAn001 mGn001mA * SfUn001mGn001mGn001fC * SfA * SfU * SfU * SfU * SfC * SfU | 1779 | UCAAGGAAGAUGGCAUUUCU | SSSSSSnXnXnXSnXnXnXSSSSSS |
| WV- | fU * SfC * SfA * SfA * SfG * SfG * SmAn001fAn001 mGn001mAn001fU * | 1780 | UCAAGGAAGAUGGCA | SSSSSSnXnXnX |

TABLE A1-continued

| | | | | |
|---|---|---|---|---|
| 12136 | SmGn001mGn001fC * SfA * SfU * SfU * SfU * SfC * SfU | | UUUCU | nXSnXnX SSSSSS |
| WV-12422 | rGrGrCrUrUrCrArArCrUrArU rCrUrGrArGrUrGrA | 1781 | GGCUUCAACUAUCUG AGUGA | OOOOOOOOOOOO O OOOOOO |
| WV-12423 | rGrArArCrArCrCrUrUrCrArG rArArCrCrGrGrArG | 1782 | GAACACCUUCAGAAC CGGAG | OOOOOOOOOO OOO OOOOOO |
| WV-12494 | fA * SfU * SfC * SfA * SfA * SfG * SfG * SmAfA * SmGmA * SfU * SmGmGfC * SfA * SfU * SfU * SfU * SfC * SfU | 1783 | AUCAAGGAAGAUGGC AUUUCU | SSSSSSSOSOS SOOSSSS SS |
| WV-12495 | fU * SfU * SfC * SfA * SfA * SfG * SfG * SmAfA * SmGmA * SfU * SmGmGfC * SfA * SfU * SfU * SfU * SfC * SfU | 1784 | UUCAAGGAAGAUGGC AUUUCU | SSSSSSSOSOS SOOSSSS SS |
| WV-12496 | fUfC * SfA * SfA * SfG * SfG * SmAfA * SmGmA * SfU * SmGmGfC * SfA * SfU * SfU * SfU * SfC * SfU | 1785 | UCAAGGAAGAUGGCA UUUCU | OSSSS SOSOSSOOSSSS SS |
| WV-12553 | fC * SfU * SfC * SfC * SfG * SfG * SfU * SfU * SmCn001fU * SmG * SfA * SmAn001mGfG * SfU * SfG * SfU * SfU * SfC | 1786 | CUCCGGUUCUGAAGG UGUUC | SSSSSSSSnXS SSnXOSSSS S |
| WV-12554 | fC * SfU * SfC * SfC * SfG * SfG * SfU * SfU * SmCn001RfU * SmG * SfA * SmAn001RmGfG * SfU * SfG * SfU * SfU * SfC | 1787 | CUCCGGUUCUGAAGG UGUUC | SSSSSSSSSnRS SSnROSSSS S |
| WV-12555 | fC * SfU * SfC * SfC * SfG * SfG * SfU * SfU * SmCn001RfU * SmG * SfA * SmAn001RfG * SfG * SfU * SfG * SfU * SfU * SfC | 1788 | CUCCGGUUCUGAAGG UGUUC | SSSSSSSSSnRS SSnRSSSSSS |
| WV-12556 | fC * SfU * SfC * SfC * SfG * SfG * SfU * SfU * SmCn001RfU * SmG * SfA * SmAn001RmG * SfG * SfU * SfG * SfU * SfU * SfC | 1789 | CUCCGGUUCUGAAGG UGUUC | SSSSSSSSSnRS SSnRSSSSSS |
| WV-12557 | fC * SfU * SfC * SfC * SfG * SfG * SfU * SfU * SmCn001SfU * SmG * SfA * SmAn001SmGfG * SfU * SfG * SfU * SfU * SfC | 1790 | CUCCGGUUCUGAAGG UGUUC | SSSSSSSSSnSSS SnSOSSSS S |
| WV-12558 | fC * SfU * SfC * SfC * SfG * SfG * SfU * SfU * SmCn001SfU * SmG * SfA * SmAn001SfG * SfG * SfU * SfG * SfU * SfU * SfC | 1791 | CUCCGGUUCUGAAGG UGUUC | SSSSSSSSSnSS SSnSSSSSSS |
| WV-12559 | fC * SfU * SfC * SfC * SfG * SfG * SfU * SfU * SmCn001SfU * SmG * SfA * SmAn001SmG * SfG * SfU * SfG * SfU * SfU * SfC | 1792 | CUCCGGUUCUGAAGG UGUUC | SSSSSSSSSnSS SSnSSSSSSS |
| WV-12566 | L001fU * SfC * SfA * SfC * SfU * SfC * SmAfG * SfA * SmU * SfA * SmGmUfU * SfG * SfA * SfA * SfG * SfC * SfC | 1793 | UCACUCAGAUAGUUG AAGCC | OSSSS SSOSSSS OOSSSS SS |
| WV-12567 | Mod092L001fU * SfC * SfA * SfC * SfU * SfC * SmAfG * SfA * SmU * SfA * SmGmUfU * SfG * SfA * SfA * SfG * SfC * SfC | 1794 | UCACUCAGAUAGUUG AAGCC | OSSSS SSOSSSS OOSSSS SS |
| WV-12568 | Mod093L001fU * SfC * SfA * SfC * SfU * SfC * SmAfG * SfA * SmU * SfA * SmGmUfU * SfG * SfA * SfA * SfG * SfC * SfC | 1795 | UCACUCAGAUAGUUG AAGCC | OSSSS SSOSSSS OOSSSS SS |
| WV-12569 | L001TTTfU * SfC * SfA * SfC * SfU * SfC * SmAfG * SfA * SmU * SfA * SmGmUfU * SfG * SfA * SfA * SfG * SfC * SfC | 1796 | TTTUCACUCAGAUAG UUGAAGCC | OOOOSSSS SSOSSSS OOSSSS SS |

TABLE A1-continued

| | | | | |
|---|---|---|---|---|
| WV-12570 | Mod020L001TTTfU * SfC * SfA * SfC * SfU * SfC * SmAfG * SfA * SmU * SfA * SmGmUfU * SfG * SfA * SfA * SfG * SfC * SfC | 1797 | TTTUCACUCAGAUAGUUGAAGCC | OOOOSSSSSSOSSSS OOSSSSSS |
| WV-12571 | fU * SfC * SfA * SfC * SfU * SfC * SmAfG * SfA * SmU * SfA * SmGmUfU * SfG * SfA * SfA * SfG * SfC * SfCTTTL005 | 1798 | UCACUCAGAUAGUUGAAGCCTTT | SSSSSSOSSSSOOSSSS SSOOOO |
| WV-12572 | fU * SfC * SfA * SfC * SfU * SfC * SmAfG * SfA * SmU * SfA * SmGmUfU * SfG * SfA * SfA * SfG * SfC * SfCTTTL005Mod020 | 1799 | UCACUCAGAUAGUUGAAGCCTTT | SSSSSSOSSSSOOSSSS SSOOOOO |
| WV-12872 | fC * SfU * SfC * SfC * SfG * SfG * SfU * SfU * SmCn001RfU * SmG * SfA * SmAn001RmGn001RfG * SfU * SfG * SfU * SfU * SfC | 1800 | CUCCGGUUCUGAAGGUGUUC | SSSSSSSSnRSSSnRnRSSSSS |
| WV-12873 | fU * SfU * SfC * SfC * SfG * SfG * SfU * SfU * SmCn001SfU * SmG * SfA * SmAn001SmGn001SfG * SfU * SfG * SfU * SfU * SfC | 1801 | CUCCGGUUCUGAAGGUGUUC | SSSSSSSSnSSSSnSnSSSSSS |
| WV-12876 | fC * SfU * SfCn001fC * SfG * SfGn001fU * SfU * SmCn001fU * SmG * SfA * SmAn001mGn001fG * SfU * SfGn001fU * SfU * SfC | 1802 | CUCCGGUUCUGAAGGUGUUC | SSnXSSnXSSnXSSSnXnXSSnXSS |
| WV-12877 | fC * SfU * SfCn001fC * SfG * SfGn001fU * SfU * SmCn001fU * SmG * SfA * SmAn001fG * SfG * SfU * SfGn001fU * SfU * SfC | 1803 | CUCCGGUUCUGAAGGUGUUC | SSnXSSnXSSnXSSSnXSSSnXSS |
| WV-12878 | fC * SfU * SfCn001fC * SfG * SfGn001fU * SfU * SmCn001fU * SmG * SfA * SmAn001mG * SfG * SfU * SfGn001fU * SfU * SfC | 1804 | CUCCGGUUCUGAAGGUGUUC | SSnXSSnXSSnXSSSnXSSSnXSS |
| WV-12879 | fC * SfU * SfCn001fC * SfG * SfGn001fU * SfU * SmCfU * SmG * SfA * SmAmGfG * SfU * SfGn001fU * SfU * SfC | 1805 | CUCCGGUUCUGAAGGUGUUC | SSnXSSnXSSOSSSOOSSnXSS |
| WV-12880 | fC * SfU * SfCn001fC * SfG * SfGn001fU * SfU * SmCfU * SmG * SfA * SmAfG * SfG * SfU * SfGn001fU * SfU * SfC | 1806 | CUCCGGUUCUGAAGGUGUUC | SSnXSSnXSSOSSSOSSSnXSS |
| WV-12881 | fC * SfU * SfCn001fC * SfG * SfGn001fU * SfU * SmCfU * SmG * SfA * SmAmG * SfG * SfU * SfGn001fU * SfU * SfC | 1807 | CUCCGGUUCUGAAGGUGUUC | SSnXSSnXSSOSSSOSSSnXSS |
| WV-12882 | fC * SfU * SfC * SfC * SfG * SfG * SmUn001mU * SmCn001mU * SmGn001mA * SmAn001mG * SfG * SfU * SfG * SfU * SfU * SfC | 1808 | CUCCGGUUCUGAAGGUGUUC | SSSSSSnXSnXSnXSnXSSSSSS |
| WV-12883 | fC * SfU * SfC * SfC * SfG * SfG * SmUn001mUn001 mCn001mUn001 mGn001mAn001 mAn001mGn001fG * SfU * SfG * SfU * SfU * SfC | 1809 | CUCCGGUUCUGAAGGUGUUC | SSSSSSnXnXnXnXnX nXnXnXSSSSS |
| WV-12884 | fU * SfC * SfAn001fC * SfU * SfCn001mAn001fG * SfA * SmU * SfA * SmGn001mUn001fU * SfG * SfA * SfAn001fG * SfC * SfC | 1810 | UCACUCAGAUAGUUGAAGCC | SSnXSSnXnXSSSSnXnXSSSnXSS |
| WV-12885 | fU * SfC * SfAn001fC * SfU * SfCn001mAfG * SfA * SmU * SfA * SmGmUfU * SfG * SfA * SfAn001fG * SfC * SfC | 1811 | UCACUCAGAUAGUUGAAGCC | SSnXSSnXOSSSSOOSSSnXSS |
| WV-12886 | fU * SfC * SfA * SfC * SfU * SfC * SmA * SmG * SmA * SmU * SmA * SmG * SmU * SmU * SfG * SfA * SfA * SfG * SfC * SfC | 1812 | UCACUCAGAUAGUUGAAGCC | SSSSSSSSSSSSSSSSSSS |
| WV-12887 | fU * SfC * SfA * SfC * SfU * SfC * SmAn001mG * SmAn001mU * SmAn001mG * SmUn001mU * SfG * SfA * SfA * SfG * SfC * SfC | 1813 | UCACUCAGAUAGUUGAAGCC | SSSSSSnXSnXSnXSnX SSSSSS |

TABLE A1-continued

| | | | | |
|---|---|---|---|---|
| WV-12888 | fU * SfC * SfA * SfC * SfU * SfC * SmAn001mGn001mAn001 mUn001 mAn001mGn001 mUn001 mUn001fG * SfA * SfA * SfG * SfC * SfC | 1814 | UCACUCAGAUAGUUG AAGCC | SSSSSSnXnXnXnXn X nXnXnXSSSSS |
| WV-12904 | GCGTGGTACCACGCL012mU * Geom5Ceom5CeomA * G * G * C * T * G * G * T * T * A * T * mG * mA * mC * mU * mC | 1815 | GCGTGGTACCACGCU GCCA GGCTGGTTATGACUC | OOOOOOOOOO OOOOOXOOO XXXXXXXXXXXX XXX |
| WV-12905 | GCGTGG * T * A * CCACGCL012mU * Geom5Ceom5CeomA * G * G * C * T * G * G * T * T * A * T * mG * mA * mC * mU * mC | 1816 | GCGTGGTACCACGCU GCCA GGCTGGTTATGACUC | OOOOOXXXOO OOOOOXOOO XXXXXXXXXXXX XXX |
| WV-12906 | G * C * G * T * G * G * T * A * C * C * A * C * G * CL012mU * Geom5Ceom5CeomA * G * G * C * T * G * G * T * T * A * T * mG * mA * mC * mU * mC | 1817 | GCGTGGTACCACGCU GCCA GGCTGGTTATGACUC | XXXXXXXXXXXX XOOXOOOXXX XXXXXXXXXXXX |
| WV-12907 | GfCGfUGGTACfCAfCGfCL012mU * Geom5Ceom5CeomA * G * G * C * T * G * G * T * T * A * T * mG * mA * mC * mU * mC | 1818 | GCGUGGTACCACGCU GCCA GGCTGGTTATGACUC | OOOOOOOOOOO OOOOXOOO XXXXXXXXXXXX XXX |
| WV-12908 | G * fCG * fUG * G * T * A * CfCA * fCG * fCL012mU * Geom5Ceom5CeomA * G * G * C * T * G * G * T * T * A * T * mG * mA * mC * mU * mC | 1819 | GCGUGGTACCACGCU GCCA GGCTGGTTATGACUC | XOXOXXXXOOXO XOOXOOO XXXXXXXXXXXX XXX |
| WV-12909 | G * fC * G * fU * G * G * T * A * C * fC * A * fC * G * fCL012mU * Geom5Ceom5CeomA * G * G * C * T * G * G * T * T * A * T * mG * mA * mC * mU * mC | 1820 | GCGUGGTACCACGCU GCCA GGCTGGTTATGACUC | XXXXXXXXXXXX XOOXOOO XXXXXXXXXXXX XXX |
| WV-12910 | GCGTGGTACCACGCL012BrmU * Geom5Ceom5CeomA * G * G * C * T * G * G * T * T * A * T * mG * mA * mC * mU * mC | 1821 | GCGTGGTACCACGCU GCCA GGCTGGTTATGACUC | OOOOOOOOOOO OOOOXOOO XXXXXXXXXXXX XXX |
| WV-12911 | GCGTGG * T * A * CCACGCL012BrmU * Geom5Ceom5CeomA * G * G * C * T * G * G * T * T * A * T * mG * mA * mC * mU * mC | 1822 | GCGTGGTACCACGCU GCCA GGCTGGTTATGACUC | OOOOOXXXOOO OOOOXOOO XXXXXXXXXXXX XXX |
| WV-12912 | G * C * G * T * G * G * T * A * C * C * A * C * G * CL012BrmU * Geom5Ceo m5CeomA * G * G * C * T * G * G * T * T * A * T * mG * mA * mC * mU * mC | 1823 | GCGTGGTACCACGCU GCCA GGCTGGTTATGACUC | XXXXXXXXXXXX XOOXOOO XXXXXXXXXXXX XXX |
| WV-12913 | GfCGfUGGTACfCAfCGfCL012BrmU * Geom5Ceom5CeomA * G * G * C * T * G * G * T * T * A * T * mG * mA * mC * mU * mC | 1824 | GCGUGGTACCACGCU GCCA GGCTGGTTATGACUC | OOOOOOOOOOO OOOOXOOO XXXXXXXXXXXX XXX |
| WV- | G * fCG * fUG * G * T * A * CfCA * fCG * fCL012BrmU * Geom5Ceo | 1825 | GCGUGGTACCACGCU | XOXOXXXXOOXO |

TABLE A1-continued

| | | | | |
|---|---|---|---|---|
| 12914 | m5CeomA * G * G * C * T * G * G * T * T * A * T * mG * mA * mC * mU * mC | | GCCA GGCTGGTTATGACUC | XOOXOOOXXX XXXXXXXXXXXX |
| WV-12915 | G * fC * G * fU * G * G * T * A * C * fC * A * fC * G * fCL012BrmU * Geom5Ceo m5CeomA * G * G * C * T * G * G * T * T * A * T * mG * mA mC * mU * mC | 1826 | GCGUGGTACCACGCU GCCA GGCTGGTTATGACUC | XXXXXXXXXXXX XOOXOOOXXXX XXXXXXXXXXX |
| WV-13319 | fC * SfU * SfC * SfC * SfU * SfG * SfU * SfU * SmCfU * SmG * SfC * SmAmGfC * SfU * SfG * SfU * SfU * SfC | 1827 | CUCCUGUUCUG CAGCUGUUC | SSSSSSSSOSS SOOSSSSS |
| WV-13320 | fC * SfU * SfC * SfC * SfU * SfG * SfU * SfU * SmCfU * SmG * SfC * SmAfG * SfC * SfU * SfG * SfU * SfU * SfC | 1828 | CUCCUGUUCUG CAGCUGUUC | SSSSSSSSOSS SOSSSSSS |
| WV-13321 | fC * SfU * SfC * SfC * SfU * SfG * SfU * SfU * SmCfU * SmG * SfC * SmAmG * SfC * SfU * SfG * SfU * SfU * SfC | 1829 | CUCCUGUUCUG CAGCUGUUC | SSSSSSSSOSS SOSSSSSS |
| WV-13322 | fC * SfU * SfC * SfC * SfU * SfG * SfU * SfU * SfC * SfU * SmG * SfC * SmAmGfC * SfU * SfG * SfU * SfU * SfC | 1830 | CUCCUGUUCUG CAGCUGUUC | SSSSSSSSSSS SOOSSSSS |
| WV-13405 | GTTGCCTCCGGTTCTGA AGGTGTTC +all PMO | 1831 | GTTGCCTCCGG TTCTGAAGGTGTTC | OOOOOOOOOOO OOOOOOOOOOOOO |
| WV-13406 | CTCCGGTTCTGAAGGTGTTC +all PMO | 1832 | CTCCGGTTCTG AAGGTGTTC | OOOOOOOOOOO OOOOOOOO |
| WV-13407 | TGCCTCCGGTTCTGA AGGTGTTCTTGTA +all PMO | 1833 | TGCCTCCGGTT CTGAAGGTGTT CTTGTA | OOOOOOOOOOO OOOOOOOOOOO OOOOO |
| WV-13408 | fC * SfU * SfC * SfC * SfG * SfG * SfU * SfU * SmCn001RfU * SmG * SfA * SmAn001RfGn001RfG * SfU * SfG * SfU * SfU * SfC | 1834 | CUCCGGUUC UGAAGGUGUUC | SSSSSSSSnRS SSnRnRSSSSS |
| WV-13409 | fC * SfU * SfC * SfC * SfG * SfG * SfU * SfU * SmCn001RfU * SmG * SfA * SmAn001RfGfG * SfU * SfG * SfU * SfU * SfC | 1835 | CUCCGGUUC UGAAGGUGUUC | SSSSSSSSnRSSS nROSSSSS |
| WV-13594 | fU * fU * fG * fu * fA * fC * fU * mU * mC * mA * mU * mC * mC * mC * mA * mC * mU * fG * fA * fUn001fUn001fCn001fUn001fGn00fA | 1836 | UUGUACUUCAUCCCACUGAUUCUGA | XXXXXXXXXXXXXX XXXXXnXnXnXnXnX |
| WV-13595 | fC * fC * fG * fG * fU * fU * fC * mU * mG * mA * mA * mG * mG * mU * mG * mU * mU * fC * fU * fUn001fGn001fUn001fAn001fCn001fU | 1837 | CCGGUUCUGAAGGUGUUCUUGUACU | XXXXXXXXXXXXXX XXXXXnXnXnXnXnX |
| WV-13596 | fUn001fUn001fGn001fUn001fAn001fC * fU * mU * mC * mA * mU * mC * mC * mC * mA * mC * mU * fG * fA * fU * fU * fC * fU * fG * fA | 1838 | UUGUACUUCAUCCCACUGAUUCUGA | nXnXnXnXnXXXXXXX XXXXXXX XXXXXX |

TABLE A1-continued

| | | | | |
|---|---|---|---|---|
| WV-13597 | fCn001fCn001fGn001fGn001fUn001fU * fC * mU * mG * mA * mA * mG * mG * mU * mG * mU * mU * fC * fU * fU * fG * fU * fA * fC * fU | 1839 | CCGGUUCUGAAGGUGUUCUUGUACUnXnXnXnXnXXXXXXX | XXXXXXX XXXXXX |
| WV-13701 | fU * SfG * SfA * SfC * SfU * SfU * SmG * SmC * SmU * SmC * SmA * SmA * SmG * SmC * SfU * SfU * SfU * SfU * SfC * SfU | 1840 | UGACUUCUCAAGCUUUUCU | SSSSS SSSSS SSSSS SSSS |
| WV-13702 | fC * SfA * SfA * SfG * SfC * SfU * SmU * SmU * SmU * SmC * SmU * SmU * SmU * SmU * SfA * SfG * SfU * SfU * SfG * SfC | 1841 | CAAGCUUUUCUUUUAGUUGC | SSSSS SSSSS SSSSS SSSS |
| WV-13703 | fC * SfU * SfU * SfU * SfU * SfA * SmG * SmU * SmU * SmG * SmC * SmU * SmG * SmC * SfU * SfC * SfU * SfU * SfU * SfU | 1842 | CUUUUAGUUGCUGCUCUUUU | SSSSS SSSSS SSSSS SSSS |
| WV-13704 | fG * SfC * SfU * SfG * SfC * SfU * SmC * SmU * SmU * SmU * SmU * SmC * SmC * SmA * SfG * SfG * SfU * SfU * SfC * SfA | 1843 | GCUGCUCUUUUCCAGGUUCA | SSSSS SSSSS SSSSS SSSS |
| WV-13705 | fU * SfU * SfC * SfC * SfA * SfG * SmG * SmU * SmU * SmC * SmA * SmA * SmG * SmU * SfG * SfG * SfG * SfA * SfU * SfA | 1844 | UUCCAGGUUCAAGUGGGAUA | SSSSS SSSSS SSSSS SSSS |
| WV-13706 | fC * SfA * SfA * SfG * SfU * SfG * SmG * SmG * SmA * SmU * SmA * SmC * SmU * SmA * SfG * SfC * SfA * SfA * SfU * SfG | 1845 | CAAGUGGGAUACUAGCAAUG | SSSSS SSSSS SSSSS SSSS |
| WV-13707 | fU * SfA * SfC * SfU * SfA * SfG * SmC * SmA * SmA * SmU * SmG * SmU * SmU * SmA * SfU * SfC * SfU * SfG * SfC * SfU | 1846 | UACUAGCAAUGUUAUCUGCU | SSSSS SSSSS SSSSS SSSS |
| WV-13708 | fU * SfG * SfU * SfU * SfA * SfU * SmC * SmU * SmG * SmC * SmU * SmU * SmC * SmC * SfU * SfC * SfC * SfA * SfA * SfC | 1847 | UGUUAUCUGCUUCCUCCAAC | SSSSS SSSSS SSSSS SSSS |
| WV-13709 | fC * SfU * SfU * SfC * SfC * SfU * SmC * SmC * SmA * SmA * SmC * SmC * SmA * SmU * SfA * SfA * SfA * SfA * SfC * SfA | 1848 | CUUCCUCCAACCAUAAAACA | SSSSS SSSSS SSSSS SSSS |
| WV-13710 | fC * SfC * SfA * SfU * SfA * SfA * SmA * SmA * SmC * SmA * SmA * SmA * SmU * SmU * SfC * SfA* SfU * SfU * SfU * SfA | 1849 | CCAUAAAACAAAUUCAUUUA | SSSSS SSSSS SSSSS SSSS |
| WV-13711 | fA * SfA * SfU * SfU * SfC * SfA * SmU * SmU * SmU * SmA * SmA * SmA * SmU * SmC * SfU * SfC * SfU * SfU * SfU * SfG | 1850 | AAUUCAUUUAAAUCUCUUUG | SSSSS SSSSS SSSSS SSSS |
| WV-13712 | fA * SfA * SfU * SfC * SfU * SfC * SmU * SmU * SmU * SmG * SmA * SmA * SmA * SmU * SfU * SfC * SfU * SfG * SfA * SfC | 1851 | AAUCUCUUUGAAAUUCUGAC | SSSSS SSSSS SSSSS SSSS |

TABLE A1-continued

| | | | | |
|---|---|---|---|---|
| WV-13713 | fU * SfG * SfA * SfA * SfA * SfU * SmU * SmC * SmU * SmG * SmA * SmC * SmA * SmA * SfG * SfA * SfU * SfA * SfU * SfU | 1852 | UGAAAUUCUGACAAGAUAUU | SSSSS SSSSS SSSSS SSSS |
| WV-13714 | fA * SfC * SfA * SfA * SfG * SfA * SmU * SmA * SmU * SmU * SmC * SmU * SmU * SmU * SfU * SfG * SfU * SfU * SfC * SfU | 1853 | ACAAGAUAUUCUUUUGUUCU | SSSSS SSSSS SSSSS SSSS |
| WV-13715 | fU * SfA * SfU * SfU * SfC * SfU * SmU * SmU * SmU * SmG * SmU * SmU * SmC * SmU * SfU * SfC * SfU * SfA * SfG * SfC | 1854 | UAUUCUUUUGUUCUUCUAGC | SSSSS SSSSS SSSSS SSSS |
| WV-13716 | fU * SfU * SfC * SfU * SfU * SfU * SmU * SmG * SmU * SmU * SmC * SmU * SmU * SmC * SfU * SfA * SfG * SfC * SfC * SfU | 1855 | UUCUUUUGUUCUUCUAGCCU | SSSSS SSSSS SSSSS SSSS |
| WV-13717 | fA * SfU * SfC * SfC * SfA * SfC * SmU * SmG * SmG * SmA * SmG * SmA * SmU * SmU * SfU * SfG * SfU * SfC * SfU * SfG | 1856 | AUCCACUGGAGAUUUGUCUG | SSSSS SSSSS SSSSS SSSS |
| WV-13718 | fA * SfG * SfA * SfU * SfU * SfU * SmG * SmU * SmC * SmU * SmG * SmC * SmU * SmU * SfG * SfA * SfG * SfC * SfU * SfU | 1857 | AGAUUUGUCUGCUUGAGCUU | SSSSS SSSSS SSSSS SSSS |
| WV-13719 | fU * SfG * SfC * SfU * SfU * SfG * SmA * SmG * SmC * SmU * SmU * SmA * SmU * SmU * SfU * SfU * SfC * SfA * SfA * SfG | 1858 | UGCUUGAGCUUAUUUUCAAG | SSSSS SSSSS SSSSS SSSS |
| WV-13720 | fU * SfA * SfU * SfU * SfU * SfU * SmC * SmA * SmA * SmG * SmU * SmU * SmU * SmA * SfU * SfC * SfU * SfU * SfG * SfC | 1859 | UAUUUUCAAGUUUAUCUUGC | SSSSS SSSSS SSSSS SSSS |
| WV-13721 | fU * SfU * SfU * SfA * SfU * SfC * SmU * SmU * SmG * SmC * SmU * SmC * SmU * SmU * SfC * SfU * SfG * SfG * SfG * SfC | 1860 | UUUAUCUUGCUCUUCUGGGC | SSSSS SSSSS SSSSS SSSS |
| WV-13722 | fU * SfC * SfU * SfU * SfC * SfU * SmG * SmG * SmG * SmC * SmU * SmU * SmA * SmU * SfG * SfG * SfG * SfA * SfG * SfC | 1861 | UCUUCUGGGCUUAUGGGAGC | SSSSS SSSSS SSSSS SSSS |
| WV-13723 | fU * SfU * SfA * SfU * SfG * SfG * SmG * SmA * SmG * SmC * SmA * SmC * SmU * SmU * SfA * SfC * SfA * SfA * SfG * SfC | 1862 | UUAUGGGAGCACUUACAAGC | SSSSS SSSSS SSSSS SSSS |
| WV-13724 | fG * SfC * SfA * SfC * SfU * SfU * SmA * SmC * SmA * SmA * SmG * SmC * SmA * SmC * SfG * SfG * SfG * SfU * SfC * SfC | 1863 | GCACUUACAAGCACGGGUCC | SSSSS SSSSS SSSSS SSSS |
| WV-13725 | fG * SfC * SfA * SfC * SfG * SfG * SmG * SmU * SmC * SmC * SmU * SmC * SmC * SmA * SfG * SfU * SfU * SfU * SfC * SfA | 1864 | GCACGGGUCCUCCAGUUUCA | SSSSS SSSSS SSSSS SSSS |
| WV- | fU * SfC * SfC * SfA * SfG * SfU * SmU * SmU * SmC * | 1865 | UCCAGUUUCAUUUAAUUGUU | SSSSS SSSSS SSSSS |

TABLE A1-continued

| | | | | |
|---|---|---|---|---|
| 13726 | SmA * SmU * SmU * SmU * SmA * SfA * SfU * SfU * SfG * SfU * SfU | | | SSSS |
| WV-13727 | fU * SfU * SfU * SfA * SfA * SfU * SmU * SmG * SmU * SmU * SmU * SmG * SmA * SmG * SfA * SfA * SfU * SfU * SfC * SfC | 1866 | UUUAAUUGUUUGAGAAUUCC | SSSSS SSSSS SSSSS SSSS |
| WV-13728 | fG * SfA * SfG * SfA * SfA * SfU * SmU * SmC * SmC * SmC * SmU * SmG * SmG * SmC * SfG * SfC * SfA * SfG * SfG * SfG | 1867 | GAGAAUUCCCUGGCGCAGGG | SSSSS SSSSS SSSSS SSSS |
| WV-13729 | fC * SfU * SfG * SfG * SfC * SfG * SmC * SmA * SmG * SmG * SmG * SmG * SmC * SmA * SfA * SfC * SfU * SfC * SfU * SfU | 1868 | CUGGCGCAGGGGCAACUCUU | SSSSS SSSSS SSSSS SSSS |
| WV-13730 | fG * SfC * SfA * SfG * SfG * SfG * SmG * SmC * SmA * SmA * SmC * SmU * SmC * SmU * SfU * SfC * SfC * SfA * SfU * SfC | 1869 | GCAGGGGCAACUCUUCCACC | SSSSS SSSSS SSSSS SSSS |
| WV-13731 | fG * SfG * SfC * SfA * SfA * SfC * SmU * SmC * SmU * SmU * SmC * SmC * SmA * SmC * SfC * SfA * SfG * SfU * SfA * SfA | 1870 | GGCAACUCUUCCACCAGUAA | SSSSS SSSSS SSSSS SSSS |
| WV-13732 | fC * SfU * SfC * SfU * SfU * SfC * SmC * SmA * SmC * SmC * SmA * SmG * SmU * SmA * SfA * SfC * SfU * SfG * SfA * SfA | 1871 | CUCUUCCACCAGUAACUGAA | SSSSS SSSSS SSSSS SSSS |
| WV-13733 | fU * SfU * SfC * SfG * SfA * SfU * SmC * SmC * SmG * SmU * SmA * SmA * SmU * SmG * SfA * SfU * SfU * SfG * SfU * SfU | 1872 | UUCGAUCCGUAAUGAUUGUU | SSSSS SSSSS SSSSS SSSS |
| WV-13734 | fA * SfA * SfU * SfG * SfA * SfU * SmU * SmG * SmU * SmU * SmC * SmU * SmA * SmG * SfC * SfC * SfU * SfC * SfU * SfU | 1873 | AAUGAUUGUUCUAGCCUCUU | SSSSS SSSSS SSSSS SSSS |
| WV-13735 | fC * SfU * SfA * SfG * SfC * SfC * SmU * SmC * SmU * SmU * SmG * SmA * SmU * SmU * SfG * SfC * SfU * SfG * SfG * SfU | 1874 | CUAGCCUCUUGAUUGCUGGU | SSSSS SSSSS SSSSS SSSS |
| WV-13736 | fG * SfA * SfU * SfU * SfG * SfC * SmU * SmG * SmG * SmU * SmC * SmU * SmU * SmG * SfU * SfU * SfU * SfU * SfU * SfC | 1875 | GAUUGCUGGUCUUGUUUUUC | SSSSS SSSSS SSSSS SSSS |
| WV-13737 | fC * SfU * SfU * SfG * SfU * SfU * SmU * SmU * SmU * SmC * SmA * SmA * SmA * SmU * SfU * SfU * SfU * SfG * SfG * SfG | 1876 | CUUGUUUUUCAAAUUUUGGG | SSSSS SSSSS SSSSS SSSS |
| WV-13738 | fA * SfA * SfA * SfU * SfU * SfU * SmU * SmG * SmG * SmG * SmC * SmA * SmG * SmC * SfG * SfG * SfU * SfA * SfA * SfU | 1877 | AAAUUUUGGGCAGCGGUAAU | SSSSS SSSSS SSSSS SSSS |

TABLE A1-continued

| | | | | |
|---|---|---|---|---|
| WV-13739 | fC * SfA * SfG * SfC * SfG * SfG * SmU * SmA * SmA * SmU * SmG * SmA * SmG * SmU * SfU * SfC * SfU * SfU * SfC * SfC | 1878 | CAGCGGUAAUGAGUUCUUCC | SSSSS SSSSS SSSSS SSSS |
| WV-13740 | fG * SfA * SfG * SfU * SfU * SfC * SmU * SmU * SmC * SmC * SmA * SmA * SmC * SmU* SfG * SfG * SfG * SfG * SfA * SfC | 1879 | GAGUUCUUCCAACUGGGGAC | SSSSS SSSSS SSSSS SSSS |
| WV-13741 | fA * SfA * SfC * SfU * SfG * SfG * SmG * SmG * SmA * SmC * SmG * SmC * SmC * SmU * SfC * SfU * SfG * SfU * SfU * SfC | 1880 | AACUGGGGACGCCUCUGUUC | SSSSS SSSSS SSSSS SSSS |
| WV-13742 | fG * SfC * SfC * SfU * SfC * SfU * SmG * SmU * SmU * SmC * SmC * SmA * SmA * SmA * SfU * SfC * SfC * SfU * SfG * SfC | 1881 | GCCUCUGUUCCAAAUCCUGC | SSSSS SSSSS SSSSS SSSS |
| WV-13743 | fU * SfG * SfU * SfU * SfC * SfC * SmA * SmA * SmA * SmU * SmC * SmC * SmU * SmG * SfC * SfA * SfU * SfU * SfG * SfU | 1882 | UGUUCAAAUCCUGCAUUGU | SSSSS SSSSS SSSSS SSSS |
| WV-13744 | fC * SfA * SfA * SfA * SfU * SfC * SmC * SmU * SmG * SmC * SmA * SmU * SmU * SmG * SfU * SfU * SfG * SfC * SfC * SfU | 1883 | CAAAUCCUGCAUUGUUGCCU | SSSSS SSSSS SSSSS SSSS |
| WV-13745 | fC * SfU * SfU * SfU * SfU * SfA * SmU * SmG * SmA * SmA * SmU * SmG * SmC * SmU * SfU * SfC * SfU * SfC * SfC * SfA | 1884 | CUUUUAUGAAUGCUUCUCCA | SSSSS SSSSS SSSSS SSSS |
| WV-13746 | fA * SfU * SfG * SfC * SfU * SfU * SmC * SmU * SmC * SmC * SmA * SmA * SmG * SmA * SfG * SfG * SfC * SfA * SfU * SfU | 1885 | AUGCUUCUCCAAGAGGCAUU | SSSSS SSSSS SSSSS SSSS |
| WV-13747 | fA * SfA * SfG * SfA * SfG * SfG * SmC * SmA * SmU * SmU * SmG * SmA * SmU * SmA * SfU * SfU * SfC * SfU * SfC * SfU | 1886 | AAGAGGCAUUGAUAUUCUCU | SSSSS SSSSS SSSSS SSSS |
| WV-13748 | fG * SfA * SfU * SfA * SfU * SfU * SmC * SmU * SmC * SmU * SmG * SmU * SmU * SmA * SfU * SfC * SfA * SfU * SfG * SfU | 1887 | GAUAUUCUCUGUUAUCAUGU | SSSSS SSSSS SSSSS SSSS |
| WV-13749 | fG * SfU * SfU * SfA * SfU * SfC * SmA * SmU * SmG * SmU * SmG * SmG * SmA * SmC * SfU * SfU * SfU * SfU * SfC * SfU | 1888 | GUUAUCAUGUGGACUUUUCU | SSSSS SSSSS SSSSS SSSS |
| WV-13750 | fG * SfG * SfA * SfC * SfU * SfU * SmU * SmU * SmC * SmU * SmG * SmG * SmU * SmA * SfU * SfC * SfA * SfU * SfC * SfU | 1889 | GGACUUUUCUGGUAUCAUCU | SSSSS SSSSS SSSSS SSSS |
| WV-13751 | fG * SfG * SfU * SfA * SfU * SfC * SmA * SmU * SmC * SmU * SmG * SmC * SmA * SmG * SfA * SfA * SfU * SfA * SfA * SfU | 1890 | GGUAUCAUCUGCAGAAUAAU | SSSSS SSSSS SSSSS SSSS |

TABLE A1-continued

| | | | | |
|---|---|---|---|---|
| WV-13752 | fG * SfC * SfA * SfG * SfA * SfA * SmU * SmA * SmA * SmU * SmC * SmC * SmC * SmG * SfG * SfA * SfG * SfA * SfA * SfG | 1891 | GCAGAAUAAUCCCGGAGAAG | SSSSS SSSSS SSSSS SSSS |
| WV-13753 | fC * SfC * SfG * SfG * SfA * SmG * SmA * SmA * SmG * SmU * SmU * SmU * SmC * SfA * SfG * SfG * SfG * SfC * SfC * SfA | 1892 | CCGGAGAAGUUUCAGGGCCA | SSSSS SSSSS SSSSS SSSS |
| WV-13754 | fU * SfU * SfU * SfC * SfA * SfG * SmG * SmG * SmC * SmC * SmA * SmA * SmG * SmU * SfC * SfA * SfU * SfU * SfU * SfG | 1893 | UUUCAGGGCCAAGUCAUUUG | SSSSS SSSSS SSSSS SSSS |
| WV-13755 | fA * SfA * SfG * SfU * SfC * SfA * SmU * SmU * SmU * SmG * SmC * SmC * SmA * SmC * SfA * SfU * SfC * SfU * SfA * SfC | 1894 | AAGUCAUUUGCCACAUCUAC | SSSSS SSSSS SSSSS SSSS |
| WV-13756 | fC * SfC * SfA * SfC * SfA * SfU * SmC * SmU * SmA * SmC * SmA * SmU * SmU * SmU * SfG * SfU * SfC * SfU * SfG * SfC | 1895 | CCACAUCUACAUUUGUCUGC | SSSSS SSSSS SSSSS SSSS |
| WV-13757 | fA * SfU * SfU * SfU * SfG * SfU * SmC * SmU * SmG * SmC * SmC * SmA * SmC * SmU * SfG * SfG * SfC * SfG * SfG * SfA | 1896 | AUUUGUCUGCCACUGGCGGA | SSSSS SSSSS SSSSS SSSS |
| WV-13758 | fC * SfA * SfC * SfU * SfG * SfG * SmC * SmG * SmG * SmA * SmG * SmG * SmU * SmC * SfU * SfU * SfU * SfG * SfG * SfC | 1897 | CACUGGCGGAGGUCUUUGGC | SSSSS SSSSS SSSSS SSSS |
| WV-13759 | fG * SfC * SfG * SfG * SfA * SfG * SmG * SmU * SmC * SmU * SmU * SmU * SmG * SmG * SfC * SfC * SfA * SfA * SfC * SfU | 1898 | GCGGAGGUCUUUGGCCAACU | SSSSS SSSSS SSSSS SSSS |
| WV-13760 | fG * SfG * SfU * SfC * SfU * SfU * SmU * SmG * SmG * SmC * SmC * SmA * SmA * SmC * SfU * SfG * SfC * SfU * SfA * SfU | 1899 | GGUCUUUGGCCAACUGCUAU | SSSSS SSSSS SSSSS SSSS |
| WV-13761 | fU * SfU * SfG * SfC * SfC * SfA * SmU * SmU * SmG * SmU * SmU * SmU * SmC * SmA * SfU * SfC * SfA * SfG * SfC * SfU | 1900 | UUGCCAUUGUUUCAUCAGCU | SSSSS SSSSS SSSSS SSSS |
| WV-13762 | fU * SfU * SfU * SfC * SfA * SfU * SmC * SmA * SmG * SmC * SmU * SmC * SmU * SmU * SfU * SfU * SfA * SfC * SfU * SfC | 1901 | UUUCAUCAGCUCUUUUACUC | SSSSS SSSSS SSSSS SSSS |
| WV-13763 | fU * SfC * SfU * SfU * SfU * SfU * SmA * SmC * SmU * SmC * SmC * SmC * SmU * SmU * SfG * SfG * SfA * SfG * SfU * SfC | 1902 | UCUUUUACUCCCUUGGAGUC | SSSSS SSSSS SSSSS SSSS |
| WV-13764 | fC * SfC * SfU * SfU * SfG * SfG * SmA * SmG * SmU * SmC * SmU * SmU * SmC * SmU * SfA * SfG * SfG * SfA * SfG * SfC | 1903 | CCUUGGAGUCUUCUAGGAGC | SSSSS SSSSS SSSSS SSSS |
| WV- | fU * SfU * SfC * SfU * SfA * SfG * SmG * SmA * SmG * | 1904 | UUCUAGGAGCCUUUCCUUAC | SSSSS SSSSS SSSSS |

TABLE A1-continued

| | | | | |
|---|---|---|---|---|
| 13765 | SmC * SmC * SmU * SmU * SmU * SfC * SfC * SfU * SfU * SfA * SfC | | | SSSS |
| WV-13766 | fC * SfU * SfU * SfU * SfC * SfC * SmU * SmU * SmA * SmC * SmG * SmG * SmG * SmU * SfA * SfG * SfC * SfA * SfU * SfC | 1905 | CUUUCCUUACGGGUAGCAUC | SSSSS SSSSS SSSSS SSSS |
| WV-13767 | fG * SfG * SfG * SfU * SfA * SfG * SmC * SmA * SmU * SmC * SmC * SmU * SmG * SmU * SfA * SfG * SfG * SfA * SfC * SfA | 1906 | GGGUAGCAUCCUGUAGGACA | SSSSS SSSSS SSSSS SSSS |
| WV-13768 | fC * SfU * SfG * SfU * SfA * SfG * SmG * SmA * SmC * SmA * SmU * SmU * SmG * SmG * SfC * SfA * SfG * SfU * SfU * SfG | 1907 | CUGUAGGACAUUGGCAGUUG | SSSSS SSSSS SSSSS SSSS |
| WV-13769 | fU * SfU * SfG * SfG * SfC * SfA * SmG * SmU * SmU * SmG * SmU * SmU * SmU * SmC * SfA * SfG * SfC * SfU * SfU * SfC | 1908 | UUGGCAGUUGUUUCAGCUUC | SSSSS SSSSS SSSSS SSSS |
| WV-13770 | fU * SfU * SfU * SfC * SfA * SfG * SmC * SmU * SmU * SmC * SmU * SmG * SmU * SmA * SfA * SfG * SfC * SfC * SfA * SfG | 1909 | UUUCAGCUUCUGUAAGCCAG | SSSSS SSSSS SSSSS SSSS |
| WV-13771 | fU * SfG * SfU * SfA * SfA * SfG * SmC * SmC * SmA * SmG * SmG * SmC * SmA * SmA * SfG * SfA * SfA * SfA * SfC * SfU | 1910 | UGUAAGCCAGGCAAGAAACU | SSSSS SSSSS SSSSS SSSS |
| WV-13772 | fG * SfC * SfA * SfA * SfG * SfA * SmA * SmA * SmC * SmU * SmU * SmU * SmU * SmC * SfC * SfA * SfG * SfG * SfU * SfC | 1911 | GCAAGAAACUUUUCCAGGUC | SSSSS SSSSS SSSSS SSSS |
| WV-13773 | fU * SfU * SfU * SfC * SfC * SfA * SmG * SmG * SmU * SmC * SmC * SmA * SmG * SmG * SfG * SfG * SfG * SfA * SfA * SfC | 1912 | UUUCCAGGUCCAGGGGGAAC | SSSSS SSSSS SSSSS SSSS |
| WV-13774 | fC * SfA * SfG * SfG * SfG * SfG * SmG * SmA * SmA * SmC * SmU * SmG * SmU * SmU * SfG * SfC * SfA * SfG * SfU * SfA | 1913 | CAGGGGGAACUGUUGCAGUA | SSSSS SSSSS SSSSS SSSS |
| WV-13775 | fU * SfG * SfU * SfU * SfG * SfC * SmA * SmG * SmU * SmA * SmA * SmU * SmC * SmU * SfA * SfU * SfG * SfA * SfG * SfA | 1914 | UGUUGCAGUAAUCUAUGAGU | SSSSS SSSSS SSSSS SSSS |
| WV-13776 | fA * SfU * SfC * SfU * SfA * SfU * SmG * SmA * SmG * SmU * SmU * SmU * SmC * SmU * SfU * SfC * SfC * SfA * SfA * SfA | 1915 | AUCUAUGAGUUUCUUCCAAA | SSSSS SSSSS SSSSS SSSS |
| WV-13777 | fU * SfG * SfC * SfU * SfU * SfC * SmC * SmA * SmA * SmA * SmG * SmC * SmA * SmG * SfC * SfC * SfU * SfC * SfU * SfC | 1916 | UUCUUCCAAAGCAGCCUCUC | SSSSS SSSSS SSSSS SSSS |

TABLE A1-continued

| | | | | |
|---|---|---|---|---|
| WV-13778 | fG * SfC * SfA * SfG * SfC * SfC * SmU * SmC * SmU * SmC * SmG * SmC * SmU * SmC * SfA * SfC * SfU * SfC * SfA * SfC | 1917 | GCAGCCUCUCGCUCACUCAC | SSSSS SSSSS SSSSS SSSS |
| WV-13779 | fC * SfU * SfC * SfU * SfC * SfG * SmC * SmU * SmC * SmA * SmC * SmU * SmC * SmA * SfC * SfC * SfC * SfU * SfG * SfC | 1918 | CUCUCGCUCACUCACCCUGC | SSSSS SSSSS SSSSS SSSS |
| WV-13780 | fA * SfG * SfG * SfU * SfU * SfC * SmA * SmA * SmG * SmU * SmG * SmG * SmG * SmA * SfU * SfA * SfC * SfU * SfA * SfG | 1919 | AGGUUCAAGUGGGAUACUAG | SSSSS SSSSS SSSSS SSSS |
| WV-13781 | fU * SfC * SfC * SfA * SfG * SfG * SmU * SmU * SmC * SmA * SmA * SmG * SmU * SmG * SfG * SfG * SfA * SfU * SfA * SfC | 1920 | UCCAGGUUCAAGUGGGAUAC | SSSSS SSSSS SSSSS SSSS |
| WV-13782 | fU * SfU * SfG * SfC * SfU * SfG * SmG * SmU * SmC * SmU * SmU * SmG * SmU * SmU * SfU * SfU * SfU * SfC * SfA * SfA | 1921 | UUGCUGGUCUUGUUUUUCAA | SSSSS SSSSS SSSSS SSSS |
| WV-13783 | fA * SfC * SfU * SfG * SfG * SfG * SmG * SmA * SmC * SmG * SmC * SmC * SmU * SmC * SfU * SfG * SfU * SfU * SfC * SfC | 1922 | ACUGGGGACGCCUCUGUUCC | SSSSS SSSSS SSSSS SSSS |
| WV-13784 | fU * SfA * SfC * SfA * SfU * SfU * SmU * SmG * SmU * SmC * SmU * SmG * SmC * SmC * SfA * SfC * SfU * SfG * SfG * SfC | 1923 | UACAUUUGUCUGCCACUGGC | SSSSS SSSSS SSSSS SSSS |
| WV-13785 | fC * SfC * SfC * SfG * SfG * SfA * SmG * SmA * SmA * SmG * SmU * SmU * SmU * SmC * SfA * SfG * SfG * SfG * SfC * SfC | 1924 | CCCGGAGAAGUUUCAGGGCC | SSSSS SSSSS SSSSS SSSS |
| WV-13786 | fU * SfC * SfC * SfU * SfG * SfU * SmA * SmG * SmG * SmA * SmC * SmA * SmU * SmU * SfG * SfG * SfC * SfA * SfG * SfU | 1925 | UCCUGUAGGACAUUGGCAGU | SSSSS SSSSS SSSSS SSSS |
| WV-13787 | fG * SfA * SfG * SfU * SfC * SfU * SmU * SmC * SmU * SmA * SmG * SmG * SmA * SmG * SfC * SfC * SfU * SfU * SfU * SfC | 1926 | GAGUCUUCUAGGAGCCUUUC | SSSSS SSSSS SSSSS SSSS |
| WV-13788 | fC * SfU * SfU * SfG * SfA * SfG * SmC * SmU * SmU * SmA * SmU * SmU * SmU * SmU * SfC * SfA * SfA * SfG * SfU * SfU | 1927 | CUUGAGCUUAUUUUCAAGUU | SSSSS SSSSS SSSSS SSSS |
| WV-13789 | fA * SfG * SfC * SfA * SfC * SfU * SmU * SmA * SmC * SmA * SmA * SmG * SmC * SmA * SfC * SfG * SfG * SfG * SfU * SfC | 1928 | AGCACUUACAAGCACGGGUC | SSSSS SSSSS SSSSS SSSS |
| WV-13790 | fU * SfU * SfG * SfU * SfA * SfC * SfU * SmU * SmC * SmA * SmU * SmC * SmC * SmC * SmA * SmC * SmU * SfG * SfA * SfU * SfU * SfC * SfU * SfG * SfA | 1929 | UUGUACUUCAUCCCACUGAUUCUGA | SSSSSSSSSSSSSSSSSSSSSSS |

TABLE A1-continued

| | | | | |
|---|---|---|---|---|
| WV-13791 | fU * SfU * SfU * SfU * SfA * SfC * SfU * SfU * SfC * SmAfU * SfC * SfC * SfC * SmAfC * SfU * SmGfA * SfU * SfU * SfC * SfU * SfG * SfA | 1930 | UUGUACUUCAUCCCACUGAUUCUGA | SSSSSSSSSOSSSSOSSOSSSSSS |
| WV-13792 | fU * SfU * SfG * SfU * SfA * SfC * SfU * SmUmCfA * SmUmCmCmCfA * SmCmUfG * SfA * SfU * SfU * SfC * SfU * SfG * SfA | 1931 | UUGUACUUCAUCCCACUGAUUCUGA | SSSSSSSSOOSOOOOSOOSSSSSS |
| WV-13793 | fU * SfU * SfG * SfU * SfA * SfC * SfU * SmUfC * SmAfU * SmCfC * SmCfA * SmCfU * SmGfA * SfU * SfU * SfC * SfU * SfG * SfA | 1932 | UUGUACUUCAUCCCACUGAUUCUGA | SSSSSSSSOSOSOSOSOSOSSSSSS |
| WV-13794 | fU * SfU * SfG * SfU * SfA * SfC * SfU * SfU * SmCfA * SmUfC * SmCfC * SmAfC * SmUfG * SfA * SfU * SfU * SfC * SfU * SfG * SfA | 1933 | UUGUACUUCAUCCCACUGAUUCUGA | SSSSSSSSSOSOSOSOSOSSSSSS |
| WV-13795 | fC * SfC * SfG * SfG * SfU * SfG * SfC * SmU * SmG * SmA * SmA * SmG * SmG * SmU * SmG * SmU * SmU * SfC * SfU * SfU * SfG * SfU * SfA * SfC * SfC | 1934 | CCGGUUCUGAAGGUGUUCUUGUACU | SSSSSSSSSSSSSSSSSSSSSSSS |
| WV-13796 | fC * SfC * SfG * SfG * SfU * SfU * SfC * SfU * SmGmAmAmGmGfU * SmGfU * SfU * SfC * SfU * SfU * SfG * SfU * SfA * SfC * SfU | 1935 | CCGGUUCUGAAGGUGUUCUUGUACU | SSSSSSSSOOOOOSOSSSSSSSSS |
| WV-13797 | fC * SfC * SfG * SfG * SfU * SfU * SfC * SmUfG * SfA * SfA * SfG * SfG * SmUfG * SmUmUmCfU * SfU * SfG * SfU * SfA * SfC * SfU | 1936 | CCGGUUCUGAAGGUGUUCUUGUACU | SSSSSSSSOSSSSSOSOOOSSSSSS |
| WV-13798 | fC * SfC * SfG * SfG * SfU * SfU * SfC * SmUfG * SmAfA * SmGfG * SmUfG * SmUfU * SmCfU * SfU * SfG * SfU * SfA * SfC * SfU | 1937 | CCGGUUCUGAAGGUGUUCUUGUACU | SSSSSSSSOSOSOSOSOSOSSSSSS |
| WV-13799 | fC * SfC * SfG * SfG * SfU * SfU * SfC * SfU * SmGfA * SmAfG * SmGfU * SmGfU * SmU * SfC * SfU * SfU * SfG * SfU * SfA * SfC * SfU | 1938 | CCGGUUCUGAAGGUGUUCUUGUACU | SSSSSSSSSOSOSOSOSSSSSSSSSS |
| WV-13810 | fU * SfU * SfU * SfG * SfC * SfC * SfG * SfC * SmUfG * SmC * SfC * SmCmAfA * SfU * SfG * SfC * SfC * SfA | 1939 | UUUGCCGCUGCCCAAUGCCA | SSSSSSSSOSSSOOSSSSS |
| WV-13811 | fU * SfU * SfU * SfG * SfC * SfC * SfG * SfC * SmUfG * SmC * SfC * SmCfA * SfA * SfU * SfG * SfC * SfC * SfA | 1940 | UUUGCCGCUGCCCAAUGCCA | SSSSSSSSOSSSOSSSSSS |
| WV-13812 | fU * SfU * SfU * SfG * SfC * SfC * SfG * SfC * SmUn001fG * SmC * SfC * SmCn001mAn001fA * SfU * SfG * SfC * SfC * SfA | 1941 | UUUGCCGCUGCCCAAUGCCA | SSSSSSSSnXSSSnXnXSSSSS |
| WV-13813 | fU * SfU * SfU * SfG * SfC * SfC * SfG * SfC * SmUn001fG * SmC * SfC * SmCn001fA * SfA * SfU * SfG * SfC * SfC * SfA | 1942 | UUUGCCGCUGCCCAAUGCCA | SSSSSSSSnXSSSnXSSSSSS |
| WV-13814 | fU * SfU * SfUn001fG * SfC * SfCn001fG * SfC * SmUfG * SmC * SfC * SmCmAfA * SfU * SfGn001fC * SfC * SfA | 1943 | UUUGCCGCUGCCCAAUGCCA | SSnXSSnXSSOSSSOOSSnXSS |

TABLE A1-continued

| | | | | |
|---|---|---|---|---|
| WV-13815 | fU * SfU * SfUn001fG * SfC * SfCn001fG * SfC * SmUfG * SmC * SfC * SmCfA * SfA * SfU * SfGn001fC * SfC * SfA | 1944 | UUUGCCGCUGCCCAAUGCCA | SSnXSSnXSSOSSSOSSSnXSS |
| WV-13816 | fU * SfU * SfUn001fG * SfC * SfCn001fG * SfC * SmUn001fG * SmC * SfC * SmCn001mAn001fA * SfU * SfGn001fC * SfC * SfA | 1945 | UUUGCCGCUGCCCAAUGCCA | SSnXSSnXSSnXSSSnXnXSSnXSS |
| WV-13817 | fU * SfU * SfUn001fG * SfC * SfCn001fG * SfC * SmUn001fG * SmC * SfC * SmCn001fA * SfA * SfU SfGn001fC * SfC * SfA | 1946 | UUUGCCGCUGCCCAAUGCCA * | SSnXSSnXSSnXSSSnXSSSnXSS |
| WV-13818 | fU * SfG * SfC * SfC * SfA * SfU * SfC * SfC * SmUfG * SmG * SfA * SmGmUfU * SfC * SfC * SfU * SfG * SfU | 1947 | UGCCAUCCUGGAGUUCCUGU | SSSSSSSSOSSSOOSSSSS |
| WV-13819 | fU * SfG * SfC * SfC * SfA * SfU * SfC * SfC * SmUfG * SmG * SfA * SmGfU * SfU * SfU * SfC * SfU * SfG * SfU | 1948 | UGCCAUCCUGGAGUUCCUGU | SSSSSSSSOSSSOSSSSSS |
| WV 13820 | fU * SfG * SfC * SfC * SfA * SfU * SfC * SfC * SmUn001fG * SmG * SfA * SmGn001mUn001fU * SfC * SfC * SfU * SfG * SfU | 1949 | UGCCAUCCUGGAGUUCCUGU | SSSSSSSSnXSSSnXnXSSSSS |
| WV-13821 | fU * SfG * SfC * SfC * SfA * SfU * SfC * SfC * SmUn001fG * SmG * SfA * SmGn001fU * SfU * SfC * SfC * SfU * SfG * SfU | 1950 | UGCCAUCCUGGAGUUCCUGU | SSSSSSSSnXSSSnXSSSSSS |
| WV-13822 | fU * SfG * SfCn001fC * SfA * SfUn001fC * SfC * SmUfG * SmG * SfA * SmGmUfU * SfC * SfCn001fU * SfG * SfU | 1951 | UGCCAUCCUGGAGUUCCUGU | SSnXSSnXSSOSSSOOSSnXSS |
| WV-13823 | fU * SfG * SfCn001fC * SfA * SfUn001fC * SfC * SmUfG * SmG * SfA * SmGfU * SfU * SfC * SfCn001fU * SfG * SfU | 1952 | UGCCAUCCUGGAGUUCCUGU | SSnXSSnXSSOSSSOSSSnXSS |
| WV-13824 | fU * SfG * SfCn001fC * SfA * SfUn001fC * SfC * SmUn001fG * SmG * SfA * SmGn001mUn001fU * SfC * SfCn001fU * SfG * Sfu | 1953 | UGCCAUCCUGGAGUUCCUGU | SSnXSSnXSSnXSSSnXnXSSnXSS |
| WV-13825 | fU * SfG * SfCn001fC * SfA * SfUn001fC * SfC * SmUn001fG * SmG * SfA * SmGn001fU * SfU * SfC * SfCn001fU * SfG * SfU | 1954 | UGCCAUCCUGGAGUUCCUGU | SSnXSSnXSSnXSSSnXSSSnXSS |
| WV-13826 | fU * SfC * SfC * SfG * SfG * SfU * SfU * SmCfU * SmG * SfA * SmAmGfG * SfU * SfG * SfU * SfU * SfC | 1955 | UCCGGUUCUGAAGGUGUUC | SSSSSSSOSSSOOSSSSS |
| WV-13827 | fC * SfU * SfC * SfC * SfG * SfG * SfU * SfU * SmCfU * SmG * SfA * SmAmGfG * SfU * SfG * SfU * SfU | 1956 | CUCCGGUUCUGAAGGUGUU | SSSSSSSSOSSSOOSSSS |
| WV-13828 | fU * SfC * SfC * SfG * SfG * SfU * SfU * SmCfU * SmG * SfA * SmAmGfG * SfU * SfG * SfU * SfU | 1957 | UCCGGUUCUGAAGGUGUU | SSSSSSSOSSS OOSSSS |
| WV-13835 | fU * SfC * SfC * SfG * SfG * SfU * SfU * SmCfU * SmG * SfA * SmAmGfG * SfU * SfG * SfU * SfU * SfC * SfU | 1958 | UCCGGUUCUGAAGGUGUUCU | SSSSSSSOSSSOOSSSSSS |
| WV-13836 | fC * SfC * SfU * SfC * SfC * SfG * SfG * SfU * SfU * SmCfU * SmG * SfA * SmAmGfG * SfU * SfG * SfU * SfU | 1959 | CCUCCGGUUCUGAAGGUGUU | SSSSSSSSSOSSSOOSSSS |

TABLE A1-continued

| | | | | |
|---|---|---|---|---|
| WV-13857 | fC * SfU * SfCn001fC * SfG * SfGn001fU * SfU * SmCfU * SmGn001fA * SmAfG * SfG * SfU * SfGn001fU * SfU * SfC | 1960 | CUCCGGUUCUGAAGGUGUUC | SSnXSSnXSSOSnXSOSSSnXSS |
| WV-13858 | fC * SfU * SfCn001fC * SfG * SfGn001fU * SfU * SmCfU * SmG * SfA * SmAfG * SfG * SfU * SfGn001fU * SfU | 1961 | CUCCGGUUCUGAAGGUGUU | SSnXSSnXSSOSSSOSSSnXS |
| WV-13859 | fC * SfU * SfCn001fC * SfG * SfGn001fU * SfU * SmCfU * SmGn001fA * SmAfG * SfG * SfU * SfGn001fU * SfU | 1962 | CUCCGGUUCUGAAGGUGUU | SSnXSSnXSSOSnXSOSSSnXS |
| WV-13860 | fU * SfCn001fC * SfG * SfGn001fU * SfU * SmCfU * SmG * SfA * SmAfG * SfG * SfU * SfGn001fU * SfU * SfC | 1963 | UCCGGUUCUGAAGGUGUUC | SnXSSnXSSOSSSOSSSnXSS |
| WV-13861 | fU * SfCn001fC * SfG * SfGn001fU * SffU * SmCfU * SmGn001fA * SmAfG * SfG * SfU * SfGn001fU * SfU * SfC | 1964 | UCCGGUUCUGAAGGUGUUC | SnXSSnXSSOSnXSOSSSnXSS |
| WV-13862 | fU * SfCn001fC * SfG * SfGn001fU * SfU * SmCfU * SmG * SfA * SmAfG * SfG * SfU * SfGn001fU * SfU | 1965 | UCCGGUUCUGAAGGUGUU | SnXSSnXSSOSSSOSSSnXS |
| WV-13863 | fU * SfCn001fC * SfG * SfGn001fU * SfU * SmCfU * SmGn001fA * SmAfG * SfG * SfU * SfGn001fU * SfU | 1966 | UCCGGUUCUGAAGGUGUU | SnXSSnXSSOSnXSOSSSnXS |
| WV-13864 | fC * SfG * SfCn001RfC * SfG * SfGn001RfU * SfU * SmCfU * SmG * SfA * SmAfG * SfG * SfU * SfGn001RfU * SfU * SfC | 1967 | CUCCGGUUCUGAAGGUGUUC | SSnRSSnRSSOSSSOSSSnRSS |
| WV-13865 | fC * SfU * SfCn001RfC * SfG * SfGn001RfU * SfU * SmCfU * SmGn001RfA * SmAfG * SfG * SfU * SfGn001RfU * SfU * SfC | 1968 | CUCCGGUUCUGAAGGUGUUC | SSnRSSnRSSOSnRSOSSSnRSS |
| WV-13963 | fA * SfC * SfA * SfA * SfG * SfU * SmU * SmC * SmU * SmC * SmC * SmU * SmU * SmC * SfU * SfG * SfG * SfA * SfA * SfA | 1969 | ACAAGUUCUCCUUCUGGAAA | SSSSS SSSSS SSSSS SSSS |
| WV-13964 | fC * SfU * SfU * SfC * SfU * SfG * SmG * SmA * SmA * SmA * SmG * SmG * SmU * SmU * SfC * SfC * SfA * SfA * SfC * SfA | 1970 | CUUCUGGAAAGGUUCCAACA | SSSSS SSSSS SSSSS SSSS |
| WV-13965 | fG * SfG * SfU * SfU * SfC * SfC * SmA * SmA * SmC * SmA * SmU * SmA * SmA * SmA * SfG * SfC * SfC * SfG * SfA * SfA | 1971 | GGUUCCAACAUAAAGCCGAA | SSSSS SSSSS SSSSS SSSS |
| WV-13966 | fA * SfA * SfA * SfG * SfC * SfC * SmG * SmA * SmA * SmA * SmU * SmA * SmC * SmA * SfC * SfA * SfC * SfU * SfG * SfC | 1972 | AAAGCCGAAAUACACACUGC | SSSSS SSSSS SSSSS SSSS |
| WV-13967 | fA * SfC * SfA * SfC * SfA * SfC * SmU * SmG * SmC * SmC * SmC * SmC * SmA * SmA * SfA * SfG * SfC * SfC * SfA * SfC | 1973 | ACACACUGCCCCAAAGCCAC | SSSSS SSSSS SSSSS SSSS |
| WV- | fC * SfA * SfA * SfA * SfG * SfC * SmC * SmA * SmC * | 1974 | CAAAGCCACAAAACACCUUG | SSSSS SSSSS SSSSS |

TABLE A1-continued

| | | | | |
|---|---|---|---|---|
| 13968 | SmA * SmA * SmA * SmA * SmC * SfA * SfC * SfC * SfU * SfU * SfG | | | SSSS |
| WV-13969 | fA * SfA * SfC * SfA * SfC * SfC * SmU * SmU * SmG * SmC * SmU * SmG * SmU * SmU * SfA * SfC * SfG * SfA * SfG * SfG | 1975 | AACACCUUGCUGUUACGAUG | SSSSS SSSSS SSSSS SSSS |
| WV-13970 | fG * SfU * SfU * SfA * SfC * SfG * SmA * SmU * SmG * SmC * SmU * SmU * SmC * SmC * SfC * SfU * SfC * SfU * SfG * SfU | 1976 | GUUACGAUGCUUCCCUCUGU | SSSSS SSSSS SSSSS SSSS |
| WV-13971 | fU * SfC * SfC * SfC * SfU * SfC * SmU * SmG * SmU * SmC * SmA * SmC * SmA * SmG * SfA * SfU * SfU * SfC * SfA * SfA | 1977 | UCCCUCUGUCACAGAUUCAA | SSSSS SSSSS SSSSS SSSS |
| WV-13972 | fC * SfA * SfG * SfA * SfU * SfU * SmC * SmA * SmA * SmU * SmU * SmA * SmU * SmA * SfU * SfU * SfU * SfU * SfA * SfC | 1978 | CAGAUUCAAUUAUAUUUUGC | SSSSS SSSSS SSSSS SSSS |
| WV-13973 | fA * SfU * SfA * SfU * SfU * SfU * SmU * SmG * SmC * SmA * SmG * SmU * SmU * SmU * SfA * SfU * SfC * SfA * SfG * SfA | 1979 | AUAUUUUGCAGUUUAUCAGA | SSSSS SSSSS SSSSS SSSS |
| WV-13974 | fU * SfU * SfU * SfA * SfU * SfC * SmA * SmG * SmA * SmU * SmA * SmA * SmA * SmC * SfC * SfA * SfG * SfC * SfU * SfC | 1980 | UUUAUCAGAUAAACCAGCUC | SSSSS SSSSS SSSSS SSSS |
| WV-13975 | fA * SfA * SfC * SfC * SfA * SfG * SmC * SmU * SmC * SmC * SmG * SmU * SmC * SmC * SfA * SfG * SfG * SfC * SfA * SfA | 1981 | AACCAGCUCCGUCCAGGCAA | SSSSS SSSSS SSSSS SSSS |
| WV-13976 | fU * SfC * SfC * SfA * SfG * SfG * SmC * SmA * SmA * SmA * SmC * SmU * SmC * SmU * SfC * SfU * SfC * SfA * SfU * SfC | 1982 | UCCAGGCAAACUCUCUCAUC | SSSSS SSSSS SSSSS SSSS |
| WV-13977 | fU * SfC * SfU * SfC * SfU * SfC * SmA * SmU * SmC * SmC * SmU * SmG * SmA * SmC * SfA * SfC * SfA * SfA * SfA * SfA | 1983 | UCUCUCAUCCUGACACAAAA | SSSSS SSSSS SSSSS SSSS |
| WV-13978 | fG * SfA * SfC * SfA * SfC * SfA * SmA * SmA * SmA * SmA * SmG * SmU * SmC * SmC * SfA * SfU * SfA * SfG * SfC * SfA | 1984 | GACACAAAAAGUCCAUAGCA | SSSSS SSSSS SSSSS SSSS |
| WV-13979 | fU * SfC * SfC * SfA * SfU * SfA * SmG * SmC * SmA * SmC * SmC * SmG * SmU * SmG * SfC * SfU * SfC * SfU * SfA * SfA | 1985 | UCCAUAGCACCGUGCUCUAA | SSSSS SSSSS SSSSS SSSS |
| WV-13980 | fG * SfU * SfG * SfC * SfU * SfC * SmU * SmA * SmA * SmU * SmA * SmU * SmU * SmA * SfU * SfC * SfA * SfU * SfU * SfA | 1986 | GUGCUCUAAUAUUAUCAUUA | SSSSS SSSSS SSSSS SSSS |

TABLE A1-continued

| | | | | |
|---|---|---|---|---|
| WV-13981 | fU * SfU * SfA * SfU * SfC * SfA * SmU * SmU * SmA * SmU * SmG * SmA * SmU * SmA * SfA * SfU * SfU * SfU * SfU * SfC | 1987 | UUAUCAUUAUGAUAAUUUUC | SSSSS SSSSS SSSSS SSSS |
| WV-13982 | fA * SfU * SfA * SfA * SfU * SfU * SmU * SmU * SmC * SmU * SmU * SmU * SmC * SmU * SfA * SfG * SfU * SfA * SfA * SfU | 1988 | AUAAUUUUCUUUCUAGUAAU | SSSSS SSSSS SSSSS SSSS |
| WV-13983 | fA * SfA * SfU * SfG * SfA * SfU * SmG * SmA * SmC * SmA * SmA * SmC * SmA * SmA * SfC * SfA * SfG * SfU * SfC * SfA | 1989 | AAUGAUGACAACAACAGUCA | SSSSS SSSSS SSSSS SSSS |
| WV-13984 | fC * SfA * SfA * SfC * SfA * SfG * SmU * SmC * SmA * SmA * SmA * SmA * SmG * SmU * SfA * SfA * SfU * SfU * SfU * SfC | 1990 | CAACAGUCAAAAGUAAUUUC | SSSSS SSSSS SSSSS SSSS |
| WV-13985 | fA * SfG * SfU * SfA * SfA * SfU * SmU * SmU * SmC * SmC * SmA * SmU * SmC * SmA * SfC * SfC * SfC * SfU * SfU * SfC | 1991 | AGUAAUUUCCAUCACCCUUC | SSSSS SSSSS SSSSS SSSS |
| WV-13986 | fU * SfC * SfA * SfC * SfC * SfC * SmU * SmU * SmC * SmA * SmG * SmA * SmA * SmC * SfC * SfU * SfG * SfA * SfU * SfC | 1992 | UCACCCUUCAGAACCUGAUC | SSSSS SSSSS SSSSS SSSS |
| WV-13987 | fA * SfA * SfC * SfC * SfU * SfG * SmA * SmU * SmC * SmU * SmU * SmU * SmA * SmA * SfG * SfA * SfA * SfG * SfU * SfU | 1993 | AACCUGAUCUUUAAGAAGUU | SSSSS SSSSS SSSSS SSSS |
| WV-13988 | fU * SfA * SfA * SfG * SfA * SfA * SmG * SmU * SmU * SmA * SmA * SmA * SmG * SmA * SfG * SfU * SfC * SfC * SfA * SfG | 1994 | UAAGAAGUUAAAGAGUCCAG | SSSSS SSSSS SSSSS SSSS |
| WV-13989 | fA * SfG * SfA * SfG * SfU * SfC * SmC * SmA * SmG * SmA * SmU * SmG * SmU * SmG * SfC * SfU * SfG * SfA * SfA * SfG | 1995 | AGAGUCCAGAUGUGCUGAAG | SSSSS SSSSS SSSSS SSSS |
| WV-13990 | fG * SfU * SfG * SfC * SfU * SfG * SmA * SmA * SmG * SmA * SmU * SmA * SmA * SmA * SfU * SfA * SfC * SfA * SfA * SfU | 1996 | GUGCUGAAGAUAAAUACAAU | SSSSS SSSSS SSSSS SSSS |
| WV-13991 | fU * SfA * SfA * SfA * SfU * SfA * SmC * SmA * SmA * SmU * SmU * SmU * SmC * SmG * SfA * SfA * SfA * SfA * SfA * SfA | 1997 | UAAAUACAAUUUCGAAAAAA | SSSSS SSSSS SSSSS SSSS |
| WV-13992 | fA * SfC * SfA * SfA * SfU * SfU * SmU * SmC * SmG * SmA * SmA * SmA * SmA * SmA * SfA * SfC * SfA * SfA * SfA * SfU | 1998 | ACAAUUUCGAAAAAACAAAU | SSSSS SSSSS SSSSS SSSS |
| WV-13993 | fU * SfC * SfG * SfA * SfA * SfA * SmA * SmA * SmA * SmC * SmA * SmA * SmA * SmU * SfC * SfA * SfA * SfA * SfG * SfA | 1999 | UCGAAAAAACAAAUCAAAGA | SSSSS SSSSS SSSSS SSSS |

TABLE A1-continued

| | | | | |
|---|---|---|---|---|
| WV-13994 | fA * SfA * SfA * SfC * SfA * SfA * SmA * SmU * SmC * SmA * SmA * SmA * SmG * SmA * SfC * SfU * SfU * SfA * SfC * SfC | 2000 | AAACAAAUCAAAGACUUACC | SSSSS SSSSS SSSSS SSSS |
| WV-13995 | fA * SfU * SfC * SfA * SfA * SfA * SmG * SmA * SmC * SmU * SmU * SmA * SmC * SmC * SfU * SfU * SfA * SfA * SfG * SfA | 2001 | AUCAAAGACUUACCUUAAGA | SSSSS SSSSS SSSSS SSSS |
| WV-13996 | fG * SfA * SfC * SfU * SfU * SfA * SmC * SmC * SmU * SmU * SmA * SmA * SmG * SmA * SfU * SfA * SfC * SfC * SfA * SfU | 2002 | GACUUACCUUAAGAUACCAU | SSSSS SSSSS SSSSS SSSS |
| WV-13997 | fU * SfU * SfA * SfC * SfC * SfU * SmU * SmA * SmA * SmG * SmA * SmU * SmA * SmC * SfC * SfA * SfU * SfU * SfU * SfG | 2003 | UUACCUUAAGAUACCAUUUG | SSSSS SSSSS SSSSS SSSS |
| WV-13998 | fU * SfA * SfC * SfC * SfU * SfU * SmA * SmA * SmG * SmA * SmU * SmA * SmC * SmC * SfA * SfU * SfU * SfU * SfG * SfU | 2004 | UACCUUAAGAUACCAUUUGU | SSSSS SSSSS SSSSS SSSS |
| WV-13999 | fA * SfC * SfC * SfU * SfU * SfA * SmA * SmG * SmA * SmU * SmA * SmC * SmC * SmA * SfU * SfU * SfU * SfG * SfU * SfA | 2005 | ACCUUAAGAUACCAUUUGUA | SSSSS SSSSS SSSSS SSSS |
| WV-14000 | fC * SfC * SfU * SfU * SfA * SfA * SmG * SmA * SmU * SmA * SmC * SmC * SmA * SmU * SfU * SfU * SfG * SfU * SfA * SfU | 2006 | CCUUAAGAUACCAUUUGUAU | SSSSS SSSSS SSSSS SSSS |
| WV-14001 | fG * SfA * SfU * SfA * SfC * SfC * SmA * SmU * SmU* SmU * SmG * SmU * SmA * SmU * SfU * SfU * SfA * SfG * SfC * SfA | 2007 | GAUACCAUUUGUAUUUAGCA | SSSSS SSSSS SSSSS SSSS |
| WV-14002 | fA * SfU * SfU * SfU * SfG * SfU * SmA * SmU * SmU * SmU * SmA * SmG * SmC * SmA * SfU * SfG * SfU * SfU * SfC * SfC | 2008 | AUUUGUAUUUAGCAUGUUCC | SSSSS SSSSS SSSSS SSSS |
| WV-14003 | fA * SfU * SfU * SfU * SfA * SfG * SmC * SmA * SmU * SmG * SmU * SmU * SmC * SmC * SfC * SfA * SfA * SfU * SfU * SfC | 2009 | AUUUAGCAUGUUCCCAAUUC | SSSSS SSSSS SSSSS SSSS |
| WV-14004 | fC * SfA * SfU * SfG * SfU * SfU * SmC * SmC * SmC * SmA * SmA * SmU * SmU * SmC * SfU * SfC * SfA * SfG * SfG * SfA | 2010 | CAUGUUCCCAAUUCUCAGGA | SSSSS SSSSS SSSSS SSSS |
| WV-14005 | fC * SfC * SfC * SfA * SfA * SfU * SmU * SmC * SmU * SmC * SmA * SmG * SmG * SmA * SfA * SfU * SfU * SfU * SfG * SfU | 2011 | CCCAAUUCUCAGGAAUUUGU | SSSSS SSSSS SSSSS SSSS |
| WV-14006 | fU * SfC * SfU * SfC * SfA * SfG * SmG * SmA * SmA * SmU * SmU * SmU * SmG * SmU * SfG * SfU * SfC * SfU * SfU * SfU | 2012 | UCUCAGGAAUUUGUGUCUUU | SSSSS SSSSS SSSSS SSSS |
| WV- | fG * SfA * SfA * SfU * SfU * SfU * SmG * SmU * SmG * | 2013 | GAAUUUGUGUCUUUCUGAGA | SSSSS SSSSS SSSSS |

TABLE A1-continued

| | | | | |
|---|---|---|---|---|
| 14007 | SmU * SmC * SmU * SmU * SmU * SfC * SfU * SfG * SfA * SfG * SfA | | | SSSS |
| WV-14008 | fG * SfU * SfG * SfU * SfC * SfU * SmU * SmU * SmC * SmU * SmG * SmA * SmG * SmA * SfA * SfA * SfC * SfU * SfG * SfU | 2014 | GUGUCUUUCUGAGAAACUGU | SSSSS SSSSS SSSSS SSSS |
| WV-14009 | fU * SfU * SfC * SfU * SfG * SfA * SmG * SmA * SmA * SmA * SmC * SmU * SmG * SmU * SfU * SfC * SfA * SfG * SfC * SfU | 2015 | UUCUGAGAAACUGUUCAGCU | SSSSS SSSSS SSSSS SSSS |
| WV-14010 | fG * SfA * SfA * SfA * SfC * SfU * SmG * SmU * SmU * SmC * SmA * SmG * SmC * SmU * SfU * SfC * SfU * SfG * SfU * SfU | 2016 | GAAACUGUUCAGCUUCUGUU | SSSSS SSSSS SSSSS SSSS |
| WV-14011 | fG * SfU * SfU * SfC * SfA * SfG * SmC * SmU * SmU * SmC * SmU * SmG * SmU * SmU * SfA * SfG * SfC * SfC * SfA * SfC | 2017 | GUUCAGCUUCUGUUAGCCAC | SSSSS SSSSS SSSSS SSSS |
| WV-14012 | fC * SfU * SfU * SfC * SfU * SfG * SmU * SmU * SmA * SmG * SmC * SmC * SmA * SmC * SfU * SfG * SfA * SfU * SfU * SfA | 2018 | CUUCUGUUAGCCACUGAUUA | SSSSS SSSSS SSSSS SSSS |
| WV-14013 | fU * SfU * SfA * SfG * SfC * SfC * SmA * SmC * SmU * SmG * SmA * SmU * SmU * SmA * SfA * SfA * SfU * SfA * SfU * SfC | 2019 | UUAGCCACUGAUUAAAUAUC | SSSSS SSSSS SSSSS SSSS |
| WV-14014 | fA * SfC * SfU * SfG * SfA * SfU * SmU * SmA * SmA * SmA * SmU * SmA * SmU * SmC * SfU * SfU * SfU * SfA * SfU * SfA | 2020 | ACUGAUUAAAUAUCUUUAUA | SSSSS SSSSS SSSSS SSSS |
| WV-14015 | fA * SfU * SfC * SfU * SfU * SfU * SmA * SmU * SmA * SmU * SmC * SmA * SmU * SmA * SfA * SfU * SfG * SfA * SfA * SfA | 2021 | AUCUUUAUAUCAUAAUGAAA | SSSSS SSSSS SSSSS SSSS |
| WV-14016 | fA * SfU * SfA * SfA * SfU * SfG * SmA * SmA * SmA * SmA * SmC * SmG * SmC * SmC * SfG * SfC * SfC * SfA * SfU * SfU | 2022 | AUAAUGAAAACGCCGCCAUU | SSSSS SSSSS SSSSS SSSS |
| WV-14017 | fG * SfC * SfC * SfG * SfC * SfC * SmA * SmU * SmU * SmU * SmC * SmU * SmC * SmA * SfA * SfC * SfA * SfG * SfA * SfU | 2023 | GCCGCCAUUUCUCAACAGAU | SSSSS SSSSS SSSSS SSSS |
| WV-14018 | fU * SfC * SfA * SfA * SfC * SfA * SmG * SmA * SmU * SmC * SmU * SmG * SmU * SmC * SfA * SfA * SfA * SfU * SfC * SfG | 2024 | UCAACAGAUCUGUCAAAUCG | SSSSS SSSSS SSSSS SSSS |
| WV-14019 | fU * SfG * SfA * SfA * SfG * SfA * SmU * SmA * SmA * SmA * SmU * SmA * SmC * SmA * SfA * SfU * SfU * SfU * SfC * SfG | 2025 | UGAAGAUAAAUACAAUUUCG | SSSSS SSSSS SSSSS SSSS |

TABLE A1-continued

| | | | | |
|---|---|---|---|---|
| WV-14020 | fA * SfU * SfU * SfU * SfC * SfG * SmA * SmA * SmA * SmA * SmA * SmA * SmC * SmA * SfA * SfA * SfU * SfC * SfA * SfA | 2026 | AUUUCGAAAAAACAAAUCAA | SSSSS SSSSS SSSSS SSSS |
| WV-14021 | fA * SfA * SfA * SfA * SfA * SfA * SmC * SmA * SmA * SmA * SmU * SmC * SmA * SmA * SfA * SfG * SfA * SfC * SfU * SfU | 2027 | AAAAAACAAAUCAAAGACUU | SSSSS SSSSS SSSSS SSSS |
| WV-14022 | fC * SfA * SfA * SfA * SfU * SfC * SmA * SmA * SmA * SmG * SmA * SmC * SmU * SmU * SfA * SfC * SfC * SfU * SfU * SfA | 2028 | CAAAUCAAAGACUUACCUUA | SSSSS SSSSS SSSSS SSSS |
| WV-14023 | fA * SfA * SfA * SfG * SfA * SfC * SmU * SmU * SmA * SmC * SmC * SmU * SmU * SmA * SfA * SfG * SfA * SfU * SfA * SfC | 2029 | AAAGACUUACCUUAAGAUAC | SSSSS SSSSS SSSSS SSSS |
| WV-14024 | fU * SfA * SfA * SfG * SfA * SfU * SmA * SmC * SmC * SmA * SmU * SmU * SmU * SmG * SfU * SfA * SfU * SfU * SfU * SfA | 2030 | UAAGAUACCAUUUGUAUUUA | SSSSS SSSSS SSSSS SSSS |
| WV-14025 | fA * SfC * SfC * SfA * SfU * SfU * SmU * SmG * SmU * SmA * SmU * SmU * SmU * SmA * SfG * SfC * SfA * SfU * SfG * SfU | 2031 | ACCAUUUGUAUUUAGCAUGU | SSSSS SSSSS SSSSS SSSS |
| WV-14026 | fU * SfG * SfU * SfA * SfU * SfU * SmU * SmA * SmG * SmC * SmA * SmU * SmG * SmU * SfU * SfC * SfC * SfC * SfA * SfA | 2032 | UGUAUUUAGCAUGUUCCCAA | SSSSS SSSSS SSSSS SSSS |
| WV-14027 | fU * SfG * SfC * SfU * SfG * SfA * SmA * SmG * SmA * SmU * SmA * SmA * SfA * SfU * SfA * SfC * SfA * SfA | 2033 | UGCUGAAGAUAAAUACAA | SSSSS SSSSS SSSSS SS |
| WV-14028 | fA * SfA * SfA * SfU * SfA * SfC * SmA * SmA * SmU * SmU * SmU * SmC * SfG * SfA * SfA * SfA * SfA * SfA | 2034 | AAAUACAAUUUCGAAAAA | SSSSS SSSSS SSSSS SS |
| WV-14029 | fC * SfA * SfA * SfU * SfU * SfU * SmC * SmG * SmA * SmA * SmA * SmA * SfA * SfA * SfC * SfA * SfA * SfA | 2035 | CAAUUUCGAAAAAACAAA | SSSSS SSSSS SSSSS SS |
| WV-14030 | fC * SfG * SfA * SfA * SfA * SfA * SmA * SmA * SmC * SmA * SmA * SmA * SfU * SfC * SfA * SfA * SfA * SfG | 2036 | CGAAAAAACAAAUCAAAG | SSSSS SSSSS SSSSS SS |
| WV-14031 | fA * SfA * SfC * SfA * SfA * SfA * SmU * SmC * SmA * SmA * SmA * SmG * SfA * SfC * SfU * SfU * SfA * SfC | 2037 | AACAAAUCAAAGACUUAC | SSSSS SSSSS SSSSS SS |
| WV-14032 | fU * SfC * SfA * SfA * SfA * SfG * SmA * SmC * SmU * SmU * SmA * SmC * SfC * SfU * SfU * SfA * SfA * SfG | 2038 | UCAAAGACUUACCUUAAG | SSSSS SSSSS SSSSS SS |
| WV-14033 | fA * SfC * SfU * SfU * SfA * SfC * SmC * SmU * SmU * SmA * SmA * SmG * SfA * SfU * SfA * SfC * SfC * SfA | 2039 | ACUUACCUUAAGAUACCA | SSSSS SSSSS SSSSS SS |
| WV-14034 | fU * SfA * SfC * SfC * SfU * SfU * SmA * SmA * SmG * SmA * SmU * SmA * SfC * SfC * SfA * SfU * SfU * SfU | 2040 | UACCUUAAGAUACCAUUU | SSSSS SSSSS SSSSS SS |

TABLE A1-continued

| | | | | |
|---|---|---|---|---|
| WV-14035 | fA * SfC * SfC * SfU * SfU * SfA * SmA * SmG * SmA * SmU * SmA * SmC * SfC * SfA * SfU * SfU * SfU * SfG | 2041 | ACCUUAAGAUACCAUUUG | SSSSS SSSSS SSSSS SS |
| WV-14036 | fC * SfC * SfU * SfU * SfA * SfA * SmG * SmA * SmU * SmA * SmC * SmC * SfA * SfU * SfU * SfU * SfG * SfU | 2042 | CCUUAAGAUACCAUUUGU | SSSSS SSSSS SSSSS SS |
| WV-14037 | fC * SfU * SfU * SfA * SfA * SfG * SmA * SmU * SmA * SmC * SmC * SmA * SfU * SfU * SfU * SfG * SfU * SfA | 2043 | CUUAAGAUACCAUUUGUA | SSSSS SSSSS SSSSS SS |
| WV-14038 | fA * SfU * SfA * SfC * SfC * SfA * SmU * SmU * SmU * SmG * SmU * SmA * SfU * SfU * SfU * SfA * SfG * SfC | 2044 | AUACCAUUUGUAUUUAGC | SSSSS SSSSS SSSSS SS |
| WV-14039 | fU * SfU * SfU * SfG * SfU * SfA * SmU * SmU * SmU * SmA * SmG * SmC * SfA * SfU * SfG * SfU * SfU * SfC | 2045 | UUUGUAUUUAGCAUGUUC | SSSSS SSSSS SSSSS SS |
| WV-14040 | fU * SfU * SfU * SfA * SfG * SfC * SmA * SmU * SmG * SmU * SmU * SmC * SfC * SfC * SfA * SfA * SfU * SfU | 2046 | UUUAGCAUGUUCCCAAUU | SSSSS SSSSS SSSSS SS |
| WV-14041 | fA * SfU * SfG * SfU * SfU * SfC * SmC * SmC * SmA * SmA * SmU * SmU * SfC * SfU * SfC * SfA * SfG * SfG | 2047 | AUGUUCCCAAUUCUCAGG | SSSSS SSSSS SSSSS SS |
| WV-14042 | fC * SfC * SfA * SfA * SfU * SfU * SmC * SmU * SmC * SmA * SmG * SmG * SfA * SfA * SfU * SfU * SfU * SfG | 2048 | CCAAUUCUCAGGAAUUUG | SSSSS SSSSS SSSSS SS |
| WV-14043 | fC * SfU * SfC * SfA * SfG * SfG * SmA * SmA * SmU * SmU * SmU * SmG * SfU * SfG * SfU * SfC * SfU * SfU | 2049 | CUCAGGAAUUUGUGUCUU | SSSSS SSSSS SSSSS SS |
| WV-14044 | fA * SfA * SfU * SfU * SfU * SfG * SmU * SmG * SmU * SmC * SmU * SmU * SfU * SfC * SfU * SfG * SfA * SfG | 2050 | AAUUUGUGUCUUUCUGAG | SSSSS SSSSS SSSSS SS |
| WV-14045 | fU * SfG * SfU * SfC * SfU * SfU * SmU * SmC * SmU * SmG * SmA * SmG * SfA * SfA * SfA * SfC * SfU * SfG | 2051 | UGUCUUUCUGAGAAACUG | SSSSS SSSSS SSSSS SS |
| WV-14046 | fU * SfC * SfU * SfG * SfA * SfG * SmA * SmA * SmA * SmC * SmU * SmG * SfU * SfU * SfC * SfA * SfG * SfC | 2052 | UCUGAGAAACUGUUCAGC | SSSSS SSSSS SSSSS SS |
| WV-14047 | fA * SfA * SfA * SfC * SfU * SfG * SmU * SmU * SmC * SmA * SmG * SmC * SfU * SfU * SfC * SfU * SfG * SfU | 2053 | AAACUGUUCAGCUUCUGU | SSSSS SSSSS SSSSS SS |
| WV-14048 | fU * SfU * SfC * SfA * SfG * SfC * SmU * SmU * SmC * SmU * SmG * SmU * SfU * SfA * SfG * SfC * SfC * SfA | 2054 | UUCAGCUUCUGUUAGCCA | SSSSS SSSSS SSSSS SS |
| WV-14049 | fU * SfU * SfC * SfU * SfG * SfU * SmU * SmA * SmG * SmC * SmC * SmA * SfC * SfU * SfG * SfA * SfU * SfU | 2055 | UUCUGUUAGCCACUGAUU | SSSSS SSSSS SSSSS SS |
| WV-14050 | fU * SfA * SfG * SfC * SfC * SfA * SmC * SmU * SmG * SmA * SmU * SmU * SfA * SfA * SfA * SfU * SfA * SfU | 2056 | UAGCCACUGAUUAAAUAU | SSSSS SSSSS SSSSS SS |
| WV-14051 | fG * SfA * SfA * SfG * SfA * SfU * SmA * SmA * SmA * SmU * SmA * SmC * SfA * SfA * SfU * SfU * SfU * SfC | 2057 | GAAGAUAAAUACAAUUUC | SSSSS SSSSS SSSSS SS |
| WV-14052 | fU * SfU * SfU * SfC * SfG * SfA * SmA * SmA * SmA * SmA * SmA * SmC * SfA * SfA * SfA * SfU * SfC * SfA | 2058 | UUUCGAAAAAACAAAUCA | SSSSS SSSSS SSSSS SS |

TABLE A1-continued

| | | | | |
|---|---|---|---|---|
| WV-14053 | fA * SfA * SfA * SfA * SfA * SfC * SmA * SmA * SmA * SmU * SmC * SmA * SfA * SfA * SfG * SfA * SfC * SfU | 2059 | AAAAACAAAUCAAAGACU | SSSSS SSSSS SSSSS SS |
| WV-14054 | fA * SfA * SfA * SfU * SfC * SfA * SmA * SmA * SmG * SmA * SmC * SmU * SfU * SfA * SfC * SfC * SfU * SfU | 2060 | AAAUCAAAGACUUACCUU | SSSSS SSSSS SSSSS SS |
| WV-14055 | fA * SfA * SfG * SfA * SfC * SfU * SmU * SmA * SmC * SmC * SmU * SmU * SfA * SfA * SfG * SfA * SfU * SfA | 2061 | AAGACUUACCUUAAGAUA | SSSSS SSSSS SSSSS SS |
| WV-14056 | fA * SfA * SfG * SfA * SfU * SfA * SmC * SmC * SmA * SmU * SmU * SmU * SfG * SfU * SfA * SfU * SfU * SfU | 2062 | AAGAUACCAUUUGUAUUU | SSSSS SSSSS SSSSS SS |
| WV-14057 | fC * SfC * SfA * SfU * SfU * SfU * SmG * SmU * SmA * SmU * SmU * SmU * SfA * SfG * SfC * SfA * SfU * SfG | 2063 | CCAUUUGUAUUUAGCAUG | SSSSS SSSSS SSSSS SS |
| WV-14058 | fG * SfU * SfA * SfU * SfU * SfU * SmA * SmG * SmC * SmA * SmU * SmG * SfU * SfU * SfC * SfC * SfC * SfA | 2064 | GUAUUUAGCAUGUUCCCA | SSSSS SSSSS SSSSS SS |
| WV-14107 | fA * SfG * SfG * SmAfA * SmGmA * SfU * SmGmGfC * SfA * SfU * SfU * SfU * SfC * SfU | 2065 | AGGAAGAUGGCAUUUCU | SSSOSOSS OOSSSSSS |
| WV-14108 | fG * SfG * SmAfA * SmGmA * SfU * SmGmGfC * SfA * SfU * SfU * SfU * SfC * SfU | 2066 | GGAAGAUGGCAUUUCU | SSOSOSS OOSSSSSS |
| WV-14109 | fG * SmAfA * SmGmA * SfU * SmGmGfC * SfA * SfU * SfU * SfU * SfC * SfU | 2067 | GAAGAUGGCAUUUCU | SOSOSSO OSSSSSS |
| WV-14110 | mAfA * SmGmA * SfU * SmGmGfC * SfA * SfU * SfU * SfU * SfC * SfU | 2068 | AAGAUGGCAUUUCU | OSOSSOOSSSSSS |
| WV-14111 | fA * SmGmA * SfU * SmGmGfC * SfA * SfU * SfU * SfU * SfC * SfG | 2069 | AGAUGGCAUUUCU | SOSSOOSSSSSS |
| WV-14112 | mGmA * SfU * SmGmGfC * SfA * SfU * SfU * SfU * SfC * SfU | 2070 | GAUGGCAUUUCU | OSSOOSSSSSS |
| WV-14113 | mA * SfU * SmGmGfC * SfA * SfU * SfU * SfU * SfC * SfU | 2071 | AUGGCAUUUCU | SSOOSSSSSS |
| WV-14114 | fU * SmGmGfC * SfA * SfU * SfU * SfU * SfC * SfU | 2072 | UGGCAUUUCU | SOOSSSSSS |
| WV-14115 | mGmGfC * SfA * SfU * SfU * SfU * SfC * SfU | | GGCAUUUCU | OOSSSSSS |
| WV-14116 | mGfC * SfA * SfU * SfU * SfU * SfC * SfU | | GCAUUUCU | OSSSSSS |
| WV-14117 | fC * SfA * SfU * SfU * SfU * SfC * SfU | | CAUUUCU | SSSSSS |

TABLE A1-continued

| | | | | |
|---|---|---|---|---|
| WV-14118 | fA * SfU * SfU * SfU * SfC * SfU | | AUUUCU | SSSSS |
| WV-14119 | fU * SfU * SfC * SfU | | UUCU | SSS |
| WV-14120 | fU * SfC * SfU | | UCU | SS |
| WV-14121 | fC * RfA * SfA * SfG * SfG * SmAfA * SmGmA * SfU * SmGmGfC * SfA * SfU * SfU * SfU * SfC * SfU | 2073 | CAAGGAAGAUGGCAUUUCU | RSSSSOSOSS OOSSSSSS |
| WV-14122 | fA * RfA * SfG * SfG * SmAfA * SmGmA * SfU * SmGmGfC * SfA * SfU * SfU * SfU * SfC * SfU | 2074 | AAGGAAGAUGGCAUUUCU | RSSSOSOSS OOSSSSSS |
| WV-14123 | fA * RfG * SfG * SmAfA * SmGmA * SfU * SmGmGfC * SfA * SfU * SfU * SfU * SfC * SfU | 2075 | AGGAAGAUGGCAUUUCU | RSSOSOSS OOSSSSSS |
| WV-14124 | fG * RfG * SmAfA * SmGmA * SfU * SmGmGfC * SfA * SfU * SfU * SfU * SfC * SfU | 2076 | GGAAGAUGGCAUUUCU | RSOSOSSOOSSSSSS |
| WV-14125 | fG * RmAfA * SmGmA * SfU * SmGmGfC * SfA * SfU * SfU * SfU * SfC * SfU | 2077 | GAAGAUGGCAUUUCU | ROSOSSOOSSSSSS |
| WV-14126 | fA * RmGmA * SfU * SmGmGfC * SfA * SfU * SfU * SfU * SfC * SfU | 2078 | AGAUGGCAUUUCU | ROSSOOSSSSSS |
| WV-14127 | mA * RfU * SmGmGfC * SfA * SfU * SfU * SfU * SfC * SfU | 2079 | AUGGCAUUUCU | RSOOSSSSSS |
| WV-14128 | fU * RmGmGfC * SfA * SfU * SfU * SfU * SfC * SfU | 2080 | UGGCAUUUCU | ROOSSSSSS |
| WV-14129 | fC * RfA * SfU * SfU * SfU * SfC * SfU | | CAUUUCU | RSSSSS |
| WV-14130 | fA * RfU * SfU * SfU * SfC * SfU | | AUUUCU | RSSSS |
| WV-14131 | fU * RfU * SfC * SfU | | UUCU | RSS |
| WV-14132 | fU * RfC * SfU | | UCU | RS |
| WV-14332 | Mod097L001fU * SfC * SfA * SfC * SfU * SfC * SmAfG * SfA * SmU * SfA * SmGmUfU * SfG * SfA * SfA * SfG * SfC * SfC | 2081 | UCACUCAGAUAGUUGAAGCC | OSSSSSSOSSSS OOSSSSSS |
| WV-14333 | Mod059L001fU * SfC * SfA * SfC * SfU * SfC * SmAfG * SfA * SmU * SfA * SmGmUfU * SfG * SfA * SfA * SfG * SfC * SfC | 2082 | UCACUCAGAUAGUUGAAGCC | OSSSSSSOSSSS OOSSSSSS |

TABLE A1-continued

| | | | | |
|---|---|---|---|---|
| WV-14334 | Mod070L001fU * SfC * SfA * SfC * SfU * SfC * SmAfG * SfA * SmU * SfA * SmGmUfU * SfG * SfA * SfA * SfG * SfC * SfC | 2083 | UCACUCAGAUAGUUGAAGCC | OSSSSSSOSSSSOOSSSSSS |
| WV-14335 | Mod057L001fU * SfC * SfA * SfC * SfU * SfC * SmAfG * SfA * SmU * SfA * SmGmUfU * SfG * SfA * SfA * SfG * SfC * SfC | 2084 | UCACUCAGAUAGUUGAAGCC | OSSSSSSOSSSSOOSSSSSS |
| WV-14342 | fC * SfU * SfCn001fC * SfG * SfGn001fU * SfU * SmCfU * SmG * SfA * SmAfGfG * SfU * SfGn001fU * SfU * SfC | 2085 | CUCCGGUUCUGAAGGUGUUC | SSnXSSnXSSOSSSOOSSnXSS |
| WV-14343 | fC * SfU * SfCn001fC * SfG * SfGn001fU * SfU * SmCfU * SmGn001fA * SmAfGfG * SfU * SfGn001fU * SfU * SfC | 2086 | CUCCGGUUCUGAAGGUGUUC | SSnXSSnXSSOSnXSOOSSnXSS |
| WV-14344 | fC * SfU * SfCn001RfC * SfG * SfGn001RfU * SfU * SmCfU * SmG * SfA * SmAfGfG * SfU * SfGn001RfU * SfU * SfC | 2087 | CUCCGGUUCUGAAGGUGUUC | SSnRSSnRSSOSSSOOSSnRSS |
| WV-14345 | fC * SfU * SfCn001RfC * SfG * SfGn001fU * SfU * SmCfU * SmGn001RfA * SmAfGfG * SfU * SfGn001RfU * SfU * SfC | 2088 | CUCCGGUUCUGAAGGUGUUC | SSnRSSnRSSOSnRSOOSSnRSS |
| WV-14346 | Mod098L001fU * SfC * SfA * SfC * SfU * SfC * SmAfG * SfA * SmU * SfA * SmGmUfU * SfG * SfA * SfA * SfG * SfC * SfC | 2089 | UCACUCAGAUAGUUGAAGCC | OSSSSSSOSSSSOOSSSSSS |
| WV-14347 | Mod099L001fU * SfC * SfA * SfC * SfU * SfC * SmAfG * SfA * SmU * SfA * SmGmUfU * SfG * SfA * SfA * SfG * SfC * SfC | 2090 | UCACUCAGAUAGUUGAAGCC | OSSSSSSOSSSSOOSSSSSS |
| WV-14348 | Mod100L001fU * SfC * SfA * SfC * SfU * SfC * SmAfG * SfA * SmU * SfA * SmGmUfU * SfG * SfA * SfA * SfG * SfC * SfC | 2091 | UCACUCAGAUAGUUGAAGCC | OSSSSSSOSSSSOOSSSSSS |
| WV-14522 | fU * SfC * SfAn001fA * SfG * SfGn001mAfA * SmGmA * SfU * SmGmGfC * SfA * SfU * SfUn001fU * SfC * SfU | 2092 | UCAAGGAAGAUGGCAUUUCU | SSnXSSnXOSOSSOOSSSnXSS |
| WV-14523 | fU * SfC * SfAn001fA * SfG * SfGn001mAfA * SmGmA * SfU * SmGmGfCn001fA * SfU * SfUn001fU * SfC * SfU | 2093 | UCAAGGAAGAUGGCAUUUCU | SSnXSSnXOSOSSOOnXSSnXSS |
| WV-14524 | fU * SfU * SfU * SfG * SfC * SfC * SmGfC * SmUmG * SfC * SmCmCmA * SfA * SfU * SfG * SfC * SfC * SfA | 2094 | UUUGCCGCUGCCCAAUGCCA | SSSSSSOSOSSOOSSSSSS |
| WV-14525 | fU * SfU * SfUn001fG * SfC * SfCn001mGfC * SmUmG * SfC * SmCmCmA * SfA * SfU * SfGn001fC * SfC * SfA | 2095 | UUUGCCGCUGCCCAAUGCCA | SSnXSSnXOSOSSOOSSSnXSS |
| WV-14526 | fU * SfU * SfUn001fG * SfC * SfCn001mGfC * SmUmG * SfC * SmCmCmAn001fA * SfU * SfGn001fC * SfC * SfA | 2096 | UUUGCCGCUGCCCAAUGCCA | SSnXSSnXOSOSSOOnXSSnXSS |
| WV-14527 | fU * SfG * SfC * SfC * SfA * SfU * SmCfC * SmUmG SfG * SmAmGfU * SfU * SfC * SfC * SfU * SfG * SfU | 2097 | *UGCCAUCCUGGAGUUCCUGU | SSSSSSOSOSSOOSSSSSS |

TABLE A1-continued

| | | | | |
|---|---|---|---|---|
| WV-14528 | fU * SfG * SfCn001fC * SfA * SfUn001mCfC * SmUmG * SfG * SmAmGfU * SfU * SfC * SfCn001fU * SfG * SfU | 2098 | UGCCAUCCUGGAGUUCCUGU | SSnXSSnXOSOS SOOSSSnXSS |
| WV-14529 | fU * SfG * SfCn001fC * SfA * SfUn001mCfC * SmUmG * SfG * SmAmGfUn001fU * SfC * SfCn001fU * SfG * SfU | 2099 | UGCCAUCCUGGAGUUCCUGU | SSnXSSnXOSOS SOOnXSSnXSS |
| WV-14530 | fU * SfC * SfAn001fC * SfU * SfCn001mAfG * SfA * SmU * SfA * SmGmUfUn001fG * SfA * SfAn001fG * SfC * SfC | 2100 | UCACUCAGAUAGUUGAAGCC | SSnXSSnXOSSSS OOnXSSnXSS |
| WV-14531 | fU * SfU * SfU * SfG * SfC * SfC * SmGfC * SmUmG SfC * SmCmCfA * SfA * SfU * SfG * SfC * SfC * SfA | 2101 | *UUUGCCGCUGCCCAAUGCCA | SSSSSSOSOSS OOSSSSSS |
| WV-14532 | fU * SfU * SfUn001fG * SfC * SfCn001mGfC * SmUmG * SfC * SmCmCfA * SfA * SfU * SfGn001fC * SfC * SfA | 2102 | UUUGCCGCUGCCCAAUGCCA | SSnXSSnXOSOSS OOSSSnXSS |
| WV-14533 | fU * SfU * SfUn001fG * SfC * SfCn001mGfC * SmUmG * SfC * SmCmCfAn001fA * SfU * SfGn001fC * SfC * SfA | 2103 | UUUGCCGCUGCCCAAUGCCA | SSnXSSnXOSOSS OOnXSSnXSS |
| WV-14565 | fC * SfU * SfCn001RfC * SfG * SfGn001RfU * SfU * SmCfU * SmG * SfA * SmAfG * SfG * SfU * SfGn001RfU * SfU | 2104 | CUCCGGUUCUGAAGGUGUU | SSnRSSnRSSOSSS OSSSnRS |
| WV-14566 | fC * SfU * SfCn001RfC * SfG * SfGn001RfU * SfU * SmCfU * SmG * SfA * SmAfGfG * SfU * SfGn001RfU * SfU | 2105 | CUCCGGUUCUGAAGGUGUU | SSnRSSnRSSOSS SOOSSnRS |
| WV-14773 | fU * SfCn001RfC * SfG * SfGn001RfU * SfU * SmCfU * SmG * SfA * SmAmGfG * SfU * SfGn001RfU * SfU * SfC * SfU | 2106 | UCCGGUUCUGA AGGUGUUCU | SnRSSnRSSOS SSOOSSnRSSS |
| WV-14774 | fU * SfCn001RfC * SfG * SfGn001RfU * SfU * SmCfU * SmG * SfA * SmAmGfG * SfUn001RfG * SfU * SfUn001RfC * SfU | 2107 | UCCGGUUCUGA AGGUGUUCU | SnRSSnRSSOS SSOOSnRSSnRS |
| WV-14775 | fU * SfC * SfC * SfG * SfG * SfU * SfU * SmCfU * SmG * SfA * SmAfGfG * SfU * SfG * SfU * SfU * SfC * SfU | 2108 | UCCGGUUCUGA AGGUGUUCU | SSSSSSSOSSS OOSSSSSS |
| WV-14776 | fU * SfCn001RfC * SfG * SfGn001RfU * SfU * SmCfU * SmG * SfA * SmAfGfG * SfU * SfGn001RfU * SfU * SfC * SfU | 2109 | UCCGGUUCUGA AGGUGUUCU | SnRSSnRSSOS SSOOSSnRSSS |
| WV-14777 | fU * SfCn001RfC * SfG * SfGn001RfU * SfU * SmCfU * SmG * SfA * SmAfGfG * SfUn001RfG * SfU * SfUn001RfC * SfU | 2110 | UCCGGUUCUGA AGGUGUUCU | SnRSSnRSSOS SSOOSnRSSnRS |
| WV-14778 | fU * SfCn001RfC * SfG * SfGn001RfU * SfU * SmCfU * SmG * SfA * SmAmGfG * SfU * SfG * SfUn001RfU * SfC * SfU | 2111 | UCCGGUUCUGA AGGUGUUCU | SnRSSnRSSOS SSOOSSSnRSS |
| WV-14779 | fU * SfC * SfCn001RfG * SfG * SfUn001RfU * SmCfU * SmG * SfA * SmAmGfG * SfU * SfG * SfUn001RfU * SfC * SfU | 2112 | UCCGGUUCUGA AGGUGUUCU | SSnRSSnRSO SSSOOSSSnRSS |
| WV-14790 | fU * SfC * SfCn001RfG * SfG * SfUn001RfU * SmCfU * SmG * SfA * SmAmGfG * SfU * SfGn001fU * SfU * SfC * SfU | 2113 | UCCGGUUCUGA AGGUGUUCU | SSnRSSnRSO SSSOOSSnXSSS |
| WV-14791 | fU * SfC * SfCn001RfG * SfG * SfUn001RfU * SmCfU * SmG * SfA * SmAmGfG * SfU * SfGn001RfU * SfU * SfC * SfU | 2114 | UCCGGUUCUGA AGGUGUUCU | SSnRSSnRSO SSSOOSSnRSSS |

TABLE A1-continued

| | | | | |
|---|---|---|---|---|
| WV-15052 | BrfU * SfC * SfA * SfC * SfU * SfC * SmAn001fG * SfA * SmU * SfA * SmGn001mUn001fU * SfG * SfA * SfA * SfG * SfC * SfC | 2115 | UCACUCAGAUA GUUGAAGCC | SSSSSSnXSSSS nXnXSSSSSS |
| WV-15053 | Acet5fU * SfC * SfA * SfC * SfU * SfC * SmAn001fG * SfA * SmU * SfA * SmGn001mUn001fU * SfG * SfA * SfA * SfG * SfC * SfC | 2116 | UCACUCAGAUA GUUGAAGCC | SSSSSSnXSSSS nXnXSSSSSS |
| WV-15074 | Mod102L001fU * SfC * SfA * SfC * SfU * SfC * SmAfG * SfA * SmU * SfA * SmGmUfU * SfG * SfA * SfA * SfG * SfC * SfC | 2117 | UCACUCAGAUA GUUGAAGCC | OSSSSSSOSSS SOOSSSSSS |
| WV-15075 | Mod103L001fU * SfC * SfA * SfC * SfU * SfC * SmAfG * SfA * SmU * SfA * SmGmUfU * SfG * SfA * SfA * SfG * SfC * SfC | 2118 | UCACUCAGAUA GUUGAAGCC | OSSSSSSOSSS SOOSSSSSS |
| WV-15076 | Mod104L001fU * SfC * SfA * SfC * SfU * SfC * SmAfG * SfA * SmU * SfA * SmGmUfU * SfG * SfA * SfA * SfG * SfC * SfC | 2119 | UCACUCAGAUA GUUGAAGCC | OSSSSSSOSSS SOOSSSSSS |
| WV-15143 | fC * SfU * SfCn001SfC * SfG * SfGn001RfU * SfU * SmCfU * SmG * SfA * SmAfGfG * SfU * SfGn001RfU * SfU * SfC | 2120 | CUCCGGUUCUGA AGGUGUUC | SSnSSSnRSSOS SSOOSSnRSS |
| WV-15322 | fC * SfU * SfCn001SfC * SfG * SfGn001SfU * SfU * SmCfU * SmG * SfA * SmAfGfG * SfU * SfGn001SfU * SfU * SfC | 2121 | CUCCGGUUCUGA AGGUGUUC | SSnSSSnSSSOSSS OOSSnSSS |
| WV-15323 | fC * fU * fCn001SfC * fG * fGn001SfU * fU * mCfU * mG * fA * mAfGfG * fU * fGn001SfU * fU * fC | 2122 | CUCCGGUUCUGA AGGUGUUC | XXnSXXnSXXO XXXOOXXnSXX |
| WV-15324 | fC * fU * fCn001RfC * fG * fGn001RfU * fU * mCfU * mG * fA * mAfGfG * fU * fGn001RfU * fU * fC | 2123 | CUCCGGUUCUGA AGGUGUUC | XXnRXXnRXXO XXXOOXXnRXX |
| WV-15325 | fC * fU * fCn001fC * fG * fGn001fU * fU * mCfU * mG * fA * mAfGfG * fU * fGn001fU * fU * fC | 2124 | CUCCGGUUCUGA AGGUGUUC | XXnXXXnXXXO XXXOOXXnXXX |
| WV-15326 | fU * SfC * SfCn001SfG * SfG * SfUn001SfU * SmCfU * SmG * SfA * SmAmGfG * SfU * SfGn001SfU * SfU * SfC * SfU | 2125 | UCCGGUUCUGA AGGUGUUCU | SSnSSSnSSOSSS OOSSnSSSS |
| WV-15327 | fU * fC * fCn001SfG * fG * fUn001SfU * mCfU * mG * fA * mAmGfG * fU * fGn001SfU * fU * fC * fU | 2126 | UCCGGUUCUGA AGGUGUUCU | XXnSXXnSX OXXXOOXX nSXXX |
| WV-15328 | fU * fC * fCn001RfG * fG * fUn001RfU * mCfU * mG * fA * mAmGfG * fU * fGn001RfU * fU * fC * fU | 2127 | UCCGGUUCUGA AGGUGUUCU | XXnRXXnRX OXXXOOXX nRXXX |
| WV-15329 | fU * fC * fUn001fG * fG * fUn001fU * mCfU * mG * fA * mAmGfU * fU * fGn001fU * fU * fC * fU | 2128 | UCCGGUUCUGA AGGUGUUCU | XXnXXXnXXO XXXOOXXnXXXX |
| WV-15330 | fC * SfU * SfCn001SfC * SfG * SfGn001SfU * SfU * SmCfU * SmG * SfA * SmAfG * SfG * SfU * SfGn001SfU * SfU * SfC | 2129 | CUCCGGUUCUGA AGGUGUUC | SSnSSSnSSSOSSS OSSSnSSS |
| WV-15331 | fC * fU * fCn001SfC * fG * fGn001SfU * fU * mCfU * mG * fA * mAfG * fG * fU * fGn001SfU * fU * fC | 2130 | CUCCGGUUCUGA AGGUGUUC | XXnSXXnSXXO XXXOXXXnSXX |
| WV-15332 | fC * fU * fCn001RfC * fG * fGn001RfU * fU * mCfU * mG * fA * mAfG * fG * fU * fGn001RfU * fU * fC | 2131 | CUCCGGUUCUGA AGGUGUUC | XXnRXXnRXXO XXXOXXXnRXX |
| WV-15333 | fC * fU * fCn001fC * fG * fGn001fU * fU * mCfU * mG * fA * mAfG * fG * fU * fGn001fU * fU * fC | 2132 | CUCCGGUUCUGA AGGUGUUC | XXnXXXnXXXO XXXOXXXnXXX |

TABLE A1-continued

| | | | | |
|---|---|---|---|---|
| WV-15334 | fU * SfC * SfCn001RfG * SfG * SfUn001RfU * SmCfU * SmG * SfA * SmAmGfG * SfU * SfG * SfUn001fU * SfC * SfU | 2133 | UCCGGUUCUGA AGGUGUUCU | SSnRSSnRSO SSSOOSSSnXSS |
| WV-15335 | fU * SfC * SfCn001SfG * SfG * SfUn001SfU * SmCfU * SmG * SfA * SmAmGfG * SfU * SfG * SfUn001SfU * SfC * SfU | 2134 | UCCGGUUCUGA AGGUGUUCU | SSnSSSnSSOSSS OOSSSnSSS |
| WV-15336 | L001fU * SfC * SfA * SfC * SfU * SfC * SmAn001fG * SfA * SmU * SfA * SmGn001mUn001fU * SfG * SfA * SfA * SfG * SfC * SfC | 2135 | UCACUCAGAUA GUUGAAGCC | OSSSSSSnXSSSS nXnXSSSSSS |
| WV-15337 | Mod059L001fU * SfC * SfA * SfC * SfU * SfC * SmAn001fG * SfA * SmU * SfA * SmGn001mUn001fU * SfG * SfA * SfA * SfG * SfC * SfC | 2136 | UCACUCAGAUA GUUGAAGCC | OSSSSSSnXSSSS nXnXSSSSSS |
| WV-15338 | Mod098L001fU * SfC * SfA * SfC * SfU * SfC * SmAn001fG * SfA * SmU * SfA * SmGn001mUn001fU * SfG * SfA * SfA * SfG * SfC * SfC | 2137 | UCACUCAGAUA GUUGAAGCC | OSSSSSSnX SSSS nXnXSSSSSS |
| WV-15366 | L001L005fU * SfC * SfA * SfC * SfU * SfC * SmAn001fG * SfA * SmU * SfA * SmGn001mUn001fU * SfG * SfA * SfA * SfG * SfC * SfC | 2138 | UCACUCAGAUA GUUGAAGCC | OOSSSSSSnX SSSS nXnXSSSSSS |
| WV-15367 | Mod1051L001fU * SfC * SfA * SfC * SfU * SfC * SmAfG * SfA * SmU * SfA * SmGmUfU * SfG * SfA * SfA * SfG * SfC * SfC | 2139 | UCACUCAGAUA GUUGAAGCC | OSSSSSSOSSS SOOSSSSSS |
| WV-15368 | Mod074L001fU * SfC * SfA * SfC * SfU * SfC * SmAfG * SfA * SmU * SfA * SmGmUfU * SfG * SfA * SfA * SfG * SfC * SfC | 2140 | UCACUCAGAUA GUUGAAGCC | OSSSSSSOSSS SOOSSSSSS |
| WV-15369 | fU * SfC * SfCn001RfG * SfG * SfUn001RfU * SmCfU * SmG * SfA * SmAmGfG * SfU * SfG * SfU * SfU * SfC * SfU | 2141 | UCCGGUUCUGA AGGUGUUCU | SSnRSSnRSO SSSOOSSSSSS |
| WV-15588 | fU * SfC * SfA * SfC * SfU * SfC * SfA * SmGfA * SmU * SfA * SmGmUfU * SfG * SfA * SfA * SfG * SfC * SfC | 2142 | UCACUCAGAUA GUUGAAGCC | SSSSSSSOSSS OOSSSSSS |
| WV-15589 | fU * SfU * SfAn001fC * SfU * SfCn001fA * SmGfA * SmU * SfA * SmGmUfU * SfG * SfA * SfAn001fG * SfC * SfC | 2143 | UCACUCAGAUA GUUGAAGCC | SSnXSSnXSOSS SOOSSSnXSS |
| WV-15646 | Mod098L001fC * SfU * SfC * SfC * SfG * SfG * SfU * SfU * SmCfU * SmG * SfA * SmAmGfG * SfU * SfG * SfU * SfU * SfC | 2144 | CUCCGGUUCUGA AGGUGUUC | OSSSSSSSSOSSS OOSSSSS |
| WV-15647 | Mod098L001fC * SfU * SfCn001fC * SfG * SfGn001fU * SfU * SmCfU * SmG * SfA * SmAfG * SfG * SfU * SfGn001fU * SfU * SfC | 2145 | CUCCGGUUCUGA AGGUGUUC | OSSnXSSnXSSOSSS OSSSnXSS |
| WV-15844 | Mod106fU * SfC * SfA * SfC * SfU * SfC * SmAn001fG * SfA * SmU * SfA * SmGn001mUn001fU * SfG * SfA * SfA * SfG * SfC * SfC | 2146 | UCACUCAGAUA GUUGAAGCC | SSSSSSnXSSSS nXnXSSSSSS |
| WV-15845 | Mod107fU * SfC * SfA * SfC * SfU * SfC * SmAn001fG * SfA * SmU * SfA * SmGn001mUn001fU * SfG * SfA * SfA * SfG * SfC * SfC | 2147 | UCACUCAGAUA GUUGAAGCC | SSSSSSnXSSSS nXnXSSSSSS |
| WV-15846 | Mod071L001fU * SfC * SfA * SfC * SfU * SfC * SmAn001fG * SfA * SmU * SfA * SmGn001mUn001fU * SfG * SfA * SfA * SfG * SfC * SfC | 2148 | UCACUCAGAUA GUUGAAGCC | OSSSSSSnXSSSS nXnXSSSSSS |
| WV-15847 | L001fC * SfU * SfC * SfC * SfG * SfG * SfU * SfU * SmCfU * SmG * SfA * SmAmGfG * SfU * SfG * SfU * SfU * SfC | 2149 | CUCCGGUUCUGA AGGUGUUC | OSSSSSSSSOSSS OOSSSSS |
| WV- | Mod071L001fC * SfU * SfC * SfC * SfG * SfG * SfU * SfU * SmCfU * | 2150 | CUCCGGUUCUGA | OSSSSSSSSOSSS |

TABLE A1-continued

| | | | | |
|---|---|---|---|---|
| 15848 | SmG * SfA * SmAmGfG * SfU * SfG * SfU * SfU * SfC | | AGGUGUUC | OOSSSS |
| WV-15849 | Mod102L001fC * SfU * SfC * SfC * SfG * SfG * SfU * SfU * SmCfU * SmG * SfA * SmAmGfG * SfU * SfG * SfU * SfU * SfC | 2151 | CUCCGGUUCUGA AGGUGUUC | OSSSSSSSOSSS OOSSSS |
| WV-15850 | L001fC * SfU * SfCn001fC * SfG * SfGn001fU * SfU * SmCfU * SmG * SfA * SmAfG * SfG * SfU * SfGn001fU * SfU * SfC | 2152 | CUCCGGUUCUGA AGGUGUUC | OSSnXSSnXSSOSSS OSSSnXSS |
| WV-15851 | Mod071L001fC * SfU * SfCn001fC * SfG * SfGn001fU * SfU * SmCfU * SmG * SfA * SmAfG * SfG * SfU * SfGn001fU * SfU * SfC | 2153 | CUCCGGUUCUGA AGGUGUUC | OSSnXSSnXSSOSSS OSSSnXSS |
| WV-15852 | Mod102L001fC * SfU * SfCn001fC * SfG * SfGn001fU * SfU * SmCfU * SmG * SfA * SmAfG * SfG * SfU * SfGn001fU * SfU * SfC | 2154 | CUCCGGUUCUGA AGGUGUUC | OSSnXSSnXSSOSSS OSSSnXSS |
| WV-15853 | fU * SfC * SfAn001fC * SfU * SfC * SfA * SmGfA * SmU * SfA * SmGmUfUn001fG * SfA * SfAn001fG * SfC * SfC | 2155 | UCACUCAGAUA GUUGAAGCC | SSnXSSSS OSSS OOnXSSnXSS |
| WV-15854 | fU * SfC * SfAn001fC * SfU * SfCn001fA * SmGfA * SmU * SfA * SmGmUfUn001fG * SfA * SfAn001fG * SfC * SfC | 2156 | UCACUCAGAUA GUUGAAGCC | SSnXSSnXSOSSS OOnXSSnXSS |
| WV-15855 | fU * SfC * SfAn001fC * SfU * SfCn001fA * SmGfA * SmU * SfA * SmGmUfU * SfG * SfA * SfA * SfG * SfC * SfC | 2157 | UCACUCAGAUA GUUGAAGCC | SSnXSSnXSOSSS OOSSSSS |
| WV-15856 | fG * SfC * SfA * SfC * SfU * SfC * SfA * SmGfA * SmU * SfA * SmGmUfUn001fG * SfA * SfAn001fG * SfC * SfC | 2158 | UCACUCAGAUA GUUGAAGCC | SSSSSSSOSSS OOnXSSnXSS |
| WV-15857 | fU * SfC * SfAn001fC * SfU * SfC * SmAfG * SfA * SmU * SfA * SmGmUfUn001fG * SfA * SfAn001fG * SfC * SfC | 2159 | UCACUCAGAUA GUUGAAGCC | SSnXSSSOSSS SOOnXSSnXSS |
| WV-15858 | fU * SfC * SfAn001fC * SfU * SfCn001mAfG * SfA * SmU * SfA * SmGmUfU * SfG * SfA * SfA * SfG * SfC * SfC | 2160 | UCACUCAGAUA GUUGAAGCC | SSnXSSnXOSSSS OOSSSSS |
| WV-15859 | fU * SfC * SfA * SfC * SfU * SfC * SmAfG * SfA * SmU * SfA * SmGmUfUn001fG * SfA * SfAn001fG * SfC * SfC | 2161 | UCACUCAGAUA GUUGAAGCC | SSSSSSOSSS SOOnXSSnXSS |
| WV-15860 | fU * SfC * SfAn001fA * SfG * SfG * SmAfA * SmGmA * SfU * SmGmGfCn001fA * SfU * SfUn001fU * SfC * SfU | 2162 | UCAAGGAAGAU GGCAUUUCU | SSnXSSSOSOSSO OnXSSnXSS |
| WV-15861 | fU * SfC * SfAn001fA * SfG * SfGn001mAfA * SmGmA * SfU * SmGmGfC * SfA * SfU * SfU * SfU * SfC * SfU | 2163 | UCAAGGAAGAU GGCAUUUCU | SSnXSSnXOSOSS OOSSSSS |
| WV-15862 | fU * SfC * SfA * SfA * SfG * SfG * SmAfA * SmGmA * SfU * SmGmGfCn001fA * SfU * SfUn001fU * SfC * SfU | 2164 | UCAAGGAAGAU GGCAUUUCU | SSSSSSOSOSSOO nXSSnXSS |
| WV-15882 | Mod071L001fU * SfC * SfA * SfC * SfU * SfC * SmAfG * SfA * SmU * SfA * SmGmUfU * SfG * SfA * SfA * SfG * SfC * SfC | 2165 | UCACUCAGAUA GUUGAAGCC | O SSSSSO SSSSOO SSSSS |
| WV-15883 | fC * SfU * SfCn002 RfC * SfG * SfGn002 RfU * SfU * SmCfU * SmG * SfA * SmAfGfG * SfU * SfGn002 RfG * SfU * SfC | 2166 | CUCCGGUUCUGAAG GUGUUC | SSnR SSnR SSOSSSOOSSnR SS |
| WV-15884 | mU * SGeon002 m5Ceon002 m5Ceon002 mA * SG * SG * RC * ST * SG * RG * ST * ST * RA * ST * SmG * SmA * SmC * SmU * SmC | 2167 | UGCCAGGCTGG TTATGACUC | SnXnXnXSS RSSRSSR SSSSS |

TABLE A1-continued

| | | | | |
|---|---|---|---|---|
| WV-15885 | mU * SGeon002 Rm5Ceon002 Rm5Ceon002 RmA * SG * SG * RC * ST * SG * RG * ST * ST * RA * ST * SmG * SmA * SmC * SmU * SmC | 2168 | UGCCAGGCTGG TTATGACUC | SnRnRnR SSRSSRSSR SSSSSS |
| WV-15886 | fC * SfU * SfCn002 fC * SfG * SfGn002 fU * SfU * SmCfU * SmG * SfA * SmAfGfG * SfU * SfGn002 fU * SfU * SfC | 2169 | CUCCGGUUCUGAAG GUGUUC | SSnXSSnXSSOSSSOOSS nXSS |
| WV-15912 | fCn001 fUn001 fCn001 fCn001 fGn001 fGn001 fUn001 fUn001 mCfUn001 mGn001 fAn001 mAfGfGn001 fUn001 fGn001 fUn001 fCn001 fC | 2170 | CUCCGGUUCUGAAG GUGUUC | nXnXnXnXnX nXnXnXOnXnXnX OOnXnXnXnXnX |
| WV-15913 | fCn001 fUn001 fCn001 fCn001 fGn001 fGn001 fUn001 fUn001 mCn001 fUn001 mGn001 fAn001 mAn001 fGn001 fGn001 fUn001 fGn001 fUn001 fUn001 fC | 2171 | CUCCGGUUCUGAAG GUGUUC | nXnXnXnXnX nXnX nXnXnX nXnXnXnXnX nXnXnXnX |
| WV-15927 | fA * SfU * SfU * SfU * SfA * SfG * SfC * SfA * SmU * SfG * SmU * SfU * SmC * SfC * SfC * SfA * SfA * SfU * SfU * SfC | 2172 | AUUUAGCAUGUU CCCAAUUC | SSSS SSSS SSSS SSSSSSS |
| WV-15928 | fA * SfU * SfUn001 fU * SfA * SfGn001 fC * SfA * SmUn001 fG * SmU * SfU * SmCn001 fC * SfC * SfA * SfAn001 fU * SfU * SfC | 2173 | AUUUAGCAUGUU CCCAAUUC | SSnXSSnXSSnX SSSnX SSSnXSS |
| WV-15929 | fA * SfU * SfUn001 fU * SfA * SfGn001 fC * SfA * SmU * SfG * SmU * SfU * SmCn001 fC * SfC * SfA * SfAn001 fU * SfU * SfC | 2174 | AUUUAGCAUGUU CCCAAUUC | SSnXSSnX SSSSSSnX SSSnXSS |
| WV-15930 | fA * SfU * SfUn001 fU * SfA * SfGn001 fC * SfA * SmU * SfG * SmU * SfU * SmC * SfC * SfC * SfA * SfAn001 fU * SfU * SfC | 2175 | AUUUAGCAUGUU CCCAAUUC | SSnXSSnX SSSS SSSSSSnXSS |
| WV-15931 | fA * SfG * SfU * SfU * SfA * SfUn001 fC * SfA * SmUn001 fG * SmU * SfU * SmCn001 fC * SfC * SfA * SfA * SfU * SfU * SfC | 2176 | AUUUAGCAUGUU CCAAUUC | SSSSSnXSSnX SSSnX SSSSSS |
| WV-15932 | fA * SfU * SfUn001 fU * SfA * SfG * SfC * SfA * SmU * SfG * SmU * SfU * SmCn001 fC * SfC * SfA * SfAn001 fU * SfU * SfC | 2177 | AUUUAGCAUGUU CCCAAUUC | SSnX SSSS SSSSSnX SSSnXSS |
| WV-15933 | fA * SfU * SfUn001 fU * SfA * SfG * SfC * SfA * SmU * SfG * SmU * SfU * SmC * SfC * SfC * SfA * SfAn001 fU * SfU * SfC | 2178 | AUUUAGCAUGUU CCCAAUUC | SSnX SSSS SSSS SSSSSnXSS |
| WV-15934 | fA * SfU * SfUn001 fU * SfA * SfGn001 fC * SfA * SmU * SfG * SmU * SfU * SmC * SfC * SfC * SfA * SfA * SfU * SfU * SfC | 2179 | AUUUAGCAUGUU CCCAAUUC | SSnXSSnX SSSS SSSS SSSSS |
| WV-15935 | fA * SfU * SfU * SfU * SfA * SfG * SfC * SfA * SmU * SfG * SmU * SfU * SmCn001 fC * SfC * SfA * SfAn001 fU * SfU * SfC | 2180 | AUUUAGCAUGUU CCCAAUUC | SSSS SSSS SSSSnX SSSnXSS |
| WV-15936 | mA * SmU * SmU * SmU * SmA * SmG * SmC * SmA * SmU * SmG * SmU * SmU * SmC * SmC * SmC * SmA * SmA * SmU * SmU * SmC | 2181 | AUUUAGCAUGUU CCCAAUUC | SSSS SSSS SSSS SSSSSSS |
| WV-15937 | mA * SmU * SmUn001 mU * SmA * SmGn001 mC * SmA * SmUn001 mG * SmU * SmU * SmCn001 mC * SmC * SmA * SmAn001 mU * SmU * SmC | 2182 | AUUUAGCAUGUU CCCAAUUC | SSnXSSnXSSnX SSSnX SSSnXSS |
| WV-15938 | Aeo * STeo * STeo * STeo * SAeo * SGeo * Sm5Ceo * SAeo * STeo * SGeo * STeo * STeo * Sm5Ceo * Sm5Ceo * Sm5Ceo * SAeo * SAeo * STeo * STeo * Sm5Ceo | 2183 | ATTTAGCATGTT CCCAATTC | SSSS SSSS SSSS SSSSSSS |
| WV- | Aeo * STeo * STeon001 Teo * SAeo * SGeon001 m5Ceo * SAeo * | 2184 | ATTTAGCATGTT | SSnXSSnXSSnX SSSnX |

TABLE A1-continued

| | | | | |
|---|---|---|---|---|
| 15939 | STeon001 Geo * STeo * STeo * Sm5Ceon001 m5Ceo * Sm5Ceo * SAeo * SAeon001 Teo * STeo * Sm5Ceo | | CCCAATTC | SSSnXSS |
| WV-15940 | fG * SfC * SfAn001 fU * SfG * SfUn001 fU * SfC * SmCn001 fC * SmA * SfA * SmUn001 fU * SfC * SfU * SfCn001 fA * SfG * SfG | 2185 | GCAUGUUCCC AAUUCUCAGG | SSnXSSnXSSnX SSSnX SSSnXSS |
| WV-15941 | fA * SfG * SfCn001 fA * SfU * SfGn001 fU * SfU * SmCn001 fC * SmC * SfA * SmAn001 fU * SfU * SfC * SfUn001 fC * SfA * SfG | 2186 | AGCAUGUU CC CAAUUCUCAG | SSnXSSnXSSnX SSSnX SSSnXSS |
| WV-15942 | fU * SfA * SfGn001 fC * SfA * SfUn001 fG * SfU * SmUn001 fC * SmC * SfC * SmAn001 fA * SfU * SfU * SfCn001 fU * SfC * SfA | 2187 | UAGCAUGUU CCCAAUUCUCA | SSnXSSnXSSnX SSSnX SSSnXSS |
| WV-15943 | fU * SfU * SfAn001 fG * SfC * SfAn001 fU * SfG * SmUn001 fU * SmC * SfC * SmCn001 fA * SfA * SfU * SfUn001 fC * SfU * SfC | 2188 | UUAGCAUGUU CCCAAUUCUC | SSnXSSnXSSnX SSSnX SSSnXSS |
| WV-15944 | fU * SfU * SfUn001 fA * SfG * SfCn001 fA * SfU * SmGn001 fU * SmU * SfC * SmCn001 fC * SfA * SfA * SfUn001 fU * SfC * SfU | 2189 | UUUAGCAUGUU CCCAAUUCU | SSnXSSnXSSnX SSSnX SSSnXSS |
| WV-15945 | fU * SfA * SfUn001 fU * SfU * SfAn001 fG * SfC * SmAn001 fU * SmG * SfU * SmUn001 fC * SfC * SfC * SfAn001 fA * SfU * SfU | 2190 | UAUUUAGCAUGUU CCCAAUU | SSnXSSnXSSnX SSSnX SSSnXSS |
| WV-15946 | fG * SfG * SfAn001 fU * SfU * SfUn001 fA * SfG * SmCn001 fA * SmU * SfC * SmUn001 fU * SfC * SfC * SfCn001 fA * SfA * SfU | 2191 | GUAUUUAGCA UGUU CCCAAU | SSnXSSnXSSnX SSSnX SSSnXSS |
| WV-15947 | fU * SfG * SfUn001 fA * SfU * SfUn001 fU * SfA * SmGn001 fC * SmA * SfU * SmGn001 fU * SfU * SfC * SfCn001 fC * SfA * SfA | 2192 | UGUAUUUAGCA UGUU CCCAA | SSnXSSnXSSnX SSSnX SSSnXSS |
| WV-15948 | fU * SfU * SfGn001 fU * SfA * SfUn001 fU * SfU * SmAn001 fG * SmC * SfA * SmUn001 fG * SfU * SfU * SfCn001 fC * SfC * SfA | 2193 | UUGUAUUUAGCAUGU U CCCA | SSnXSSnXSSnX SSSnX SSSnXSS |
| WV-15949 | fU * SfU * SfUn001 fG * SfU * SfAn001 fU * SfU * SmUn001 fA * SmG * SfC * SmAn001 fU * SfG * SfU * SfUn001 fC * SfC * SfC | 2194 | UUUGUAUUU AGCAUGUU CCC | SSnXSSnXSSnX SSSnX SSSnXSS |
| WV-15950 | fG * SfC * SfU * SfG * SfC * SfU * SfC * SfU * SmU * SfU * SmU * SfC * SmC * SfA * SfG * SfG * SfU * SfU * SfC * SfA | 2195 | GCUGCUCUUU UCCAGGUUCA | SSSS SSSS SSSS SSSSSSS |
| WV-15951 | fC * SfU * SfU * SfC * SfC * SfU * SfC * SfC * SmA * SfA * SmC * SfC * SmA * SfU * SfA * SfA * SfA * SfA * SfC * SfA | 2196 | CUUCCUCCAACCA UAAAACA | SSSS SSSS SSSS SSSSSSS |
| WV-15952 | fA * SfG * SfG * SfU * SfU * SfC * SfA * SfA * SmG * SfU * SmG * SfG * SmG * SfA * SfU * SfA * SfC * SfU * SfA * SfG | 2197 | AGGUUCAAGU GGGAUACUAG | SSSS SSSS SSSS SSSSSSS |
| WV-15953 | fG * SfC * SfA * SfC * SfU * SfU * SfA * SfC * SmA * SfA * SmG * SfC * SmA * SfC * SfG * SfG * SfG * SfU * SfC * SfC | 2198 | GCACUUACAAG CACGGGUCC | SSSS SSSS SSSS SSSSSSS |
| WV-15954 | fG * SfG * SfC * SfA * SfA * SfC * SfU * SfC * SmU * SfU * SmC * SfC * SmA * SfC * SfC * SfA * SfG * SfU * SfA * SfA | 2199 | GGCAACUCUU CCACCAGUAA | SSSS SSSS SSSS SSSSSSS |
| WV-15955 | fG * SfA * SfG * SfU * SfU * SfC * SfU * SfU * SmC * SfC * SmA * SfA * SmC * SfU * SfG * SfG * SfG * SfG * SfA * SfC | 2200 | GAGUUCUUCC AACUGGGGAC | SSSS SSSS SSSS SSSSSSS |
| WV-15956 | fG * SfG * SfU * SfA * SfU * SfC * SfA * SfU * SmC * SfU * SmG * SfC * SmA * SfG * SfA * SfA * SfU * SfA * SfA * SfU | 2201 | GGUAUCAUCU GCAGAAUAAU | SSSS SSSS SSSS SSSSSSS |

TABLE A1-continued

| | | | | |
|---|---|---|---|---|
| WV-15957 | fU * SfU * SfU * SfC * SfA * SfG * SfG * SfG * SmC * SfC * SmA * SfA * SmG * SfU * SfC * SfA * SfU * SfU * SfU * SfG | 2202 | UUUCAGGGCCA AGUCAUUUG | SSSS SSSS SSSS SSSSSSS |
| WV-15958 | fC * SfC * SfA * SfC * SfA * SfU * SfC * SfU * SmA * SfC * SmA * SfU * SmU * SfU * SfG * SfU * SfC * SfU * SfG * SfC | 2203 | CCACAUCUACAU UUGUCUGC | SSSS SSSS SSSS SSSSSSS |
| WV-15959 | fC * SfU * SfU * SfU * SfC * SfC * SfU * SfU * SmA * SfC * SmG * SfG * SmG * SfU * SfA * SfG * SfC * SfA * SfU * SfC | 2204 | CUUUCCUUACG GGUAGCAUC | SSSS SSSS SSSS SSSSSSS |
| WV-15960 | fU * SfU * SfC * SfU * SfU * SfC * SfC * SfA * SmA * SfA * SmG * SfC * SmA * SfG * SfC * SfC * SfU * SfC * SfU * SfC | 2205 | UUCUUCC AAAGCAGCCUCUC | SSSS SSSS SSSS SSSSSSS |
| WV-15961 | fU * SfC * SfC * SfU * SfG * SfU * SfA * SfG * SmG * SfA * SmC * SfA * SmU * SfU * SfG * SfG * SfC * SfA * SfG * SfU | 2206 | UCCUGUAGGA CAUUGGCAGU | SSSS SSSS SSSS SSSSSSS |
| WV-15962 | fG * SfC * SfUn001 fG * SfC * SfUn001 fC * SfU * SmUn001 fU * SmU * SfC * SmCn001 fA * SfG * SfG * SfUn001 fU * SfC * SfA | 2207 | GCUGCUCUUU UCCAGGUUCA | SSnXSSnXSSnX SSSnX SSSnXSS |
| WV-15963 | fC * SfU * SfUn001 fC * SfC * SfUn001 fC * SfC * SmAn001 fA * SmC * SfC * SmAn001 fU * SfA * SfA * SfAn001 fA * SfC * SfA | 2208 | CUUCCUCCAACCA UAAAACA | SSnXSSnXSSnX SSSnX SSSnXSS |
| WV-15964 | fA * SfG * SfGn001 fU * SfU * SfCn001 fA * SfA * SmGn001 fU * SmG * SfG * SmGn001 fA * SfU * SfA * SfCn001 fU * SfA * SfG | 2209 | AGGUUCAAGU GGGAUACUAG | SSnXSSnXSSnX SSSnX SSSnXSS |
| WV-15965 | fG * SfC * SfAn001 fC * SfU * SfUn001 fA * SfC * SmAn001 fA * SmG * SfC * SmAn001 fC * SfG * SfG * SfGn001 fU * SfC * SfC | 2210 | GCACUUACAAG CACGGGUCC | SSnXSSnXSSnX SSSnX SSSnXSS |
| WV-15966 | fG * SfG * SfCn001 fA * SfA * SfCn001 fU * SfC * SmUn001 fU * SmC * SfC * SmAn001 fC * SfC * SfA * SfGn001 fU * SfA * SfA | 2211 | GGCAACUCUU CCACCAGUAA | SSnXSSnXSSnX SSSnX SSSnXSS |
| WV-15967 | fG * SfA * SfGn001 fU * SfU * SfCn001 fU * SfU * SmCn001 fC * SmA * SfA * SmCn001 fU * SfG * SfG * SfGn001 fG * SfA * SfC | 2212 | GAGUUCUUCC AACUGGGGAC | SSnXSSnXSSnX SSSnX SSSnXSS |
| WV-15968 | fG * SfG * SfUn001 fA * SfU * SfCn001 fA * SfU * SmCn001 fU * SmG * SfC * SmAn001 fG * SfA * SfA * SfUn001 fA * SfA * SfU | 2213 | GGUAUCAUCU GCAGAAUAAU | SSnXSSnXSSnX SSSnX SSSnXSS |
| WV-15969 | fU * SfU * SfUn001 fC * SfA * SfGn001 fG * SfG * SmCn001 fC * SmA * SfA * SmGn001 fU * SfC * SfA * SfUn001 fU * SfU * SfG | 2214 | UUUCAGGGCCA AGUCAUUUG | SSnXSSnXSSnX SSSnX SSSnXSS |
| WV-15970 | fC * SfC * SfAn001 fC * SfA * SfUn001 fC * SfU * SmAn001 fC * SmA * SfU * SmUn001 fU * SfG * SfU * SfCn001 fU * SfG * SfC | 2215 | CCACAUCUACAU UUGUCUGC | SSnXSSnXSSnX SSSnX SSSnXSS |
| WV-15971 | fC * SfU * SfUn001 fU * SfC * SfCn001 fU * SfU * SmAn001 fC * SmG * SfG * SmGn001 fU * SfA * SfG * SfCn001 fA * SfU * SfC | 2216 | CUUUCCUUACG GGUAGCAUC | SSnXSSnXSSnX SSSnX SSSnXSS |
| WV-15972 | fU * SfU * SfCn001 fU * SfU * SfCn001 fC * SfA * SmAn001 fA * SmG * SfC * SmAn001 fG * SfC * SfC * SfUn001 fC * SfU * SfC | 2217 | UUCUUCC AAAGCAGCCUCUC | SSnXSSnXSSnX SSSnX SSSnXSS |
| WV-15973 | fU * SfC * SfCn001 fU * SfG * SfUn001 fA * SfG * SmGn001 fA * SmC * SfA * SmUn001 fU * SfG * SfG * SfCn001 fA * SfG * SfU | 2218 | UCCUGUAGGA CAUUGGCAGU | SSnXSSnXSSnX SSSnX SSSnXSS |
| WV- | L001fC * SfU * SfCn001 RfC * SfG * SfGn001 RfU * SfU * SmCfU * | 2219 | CUCCGGUUCUGAAG | OSSnR SSnR |

TABLE A1-continued

| | | | | |
|---|---|---|---|---|
| 16004 | SmG * SfA * SmAfGfG * SfU * SfGn001 RfU * SfU * SfC | | GUGUUC | SSOSSSOOSSnR SS |
| WV-16005 | Mod071L001fC * SfU * SfCn001 RfC * SfG * SfGn001 RfU * SfU * SmCfU * SmG * SfA * SmAfGfG * SfU * SfCn001 RfU * SfU * SfC | 2220 | CUCCGGUUCUGAAG GUGUC | OSSnR SSnR SSOSSSOOSSnR SS |
| WV-16006 | fC * SfU * SfCn003RfC * SfG * SfGn003RfU * SfU * SmCfU * SmG * SfA * SmAfGfG * SfU * SfGn003RfU * SfU * SfC | 2221 | CUCCGGUUCUGAAG GUGUUC | SSnR SSnR SSOSSSOOSSnR SS |
| WV-16007 | fC * SfU * SfCn004RfC * SfG * SfGn004RfU * SfU * SmCfU * SmG * SfA * SmAfGfG * SfU * SfGn004RfU * SfU * SfC | 2222 | CUCCGGUUCUGAAG GUGUUC | SSnR SSnR SSOSSSOOSSnR SS |
| WV-16008 | fU * SfC * SfA * SfC * SfU * SfC * SmAn003fG * SfA * SmU * SfA * SmGn003mUn003fU * SfG * SfA * SfA * SfG * SfC * SfC | 2223 | UCACUCAGAUA GUUGAAGCC | SSSSSSnX SSSSnXnX SSSSSS |
| WV-16009 | fU * SfC * SfA * SfC * SfU * SfC * SmAn004fG * SfA * SmU * SfA * SmGn004mUn004fU * SfG * SfA * SfA * SfG * SfC * SfC | 2224 | UCACUCAGAUA GUUGAAGCC | SSSSSSnX SSSSnXnX SSSSSS |
| WV-16010 | L001L005fC * SfU * SfCn001 RfC * SfG * SfGn001 RfU * SfU * SmCfU * SmG * SfA * SmAfGfG * SfU * SfGn001 RfU * SfU * SfC | 2225 | CUCCGGUUCUGAAG GUGUUC | OOSSnR SSnR SSOSSSOOSSnR SS |
| WV-16011 | Mod107fC * SfU * SfCn001 RfC * SfG * SfUn001 RfU * SfU * SmCfU * SmG * SfA * SmAfGfG * SfU * SfGn001 RfU * SfU * SfC | 2226 | CUCCGGUUCUGAAG GUGUUC | SSnR SSnR SSOSSSOOSSnR SS |
| WV-16366 | Mod108L001fC * SfU * SfCn001 RfC * SfG * SfGn001 RfU * SfU * SmCfU * SmG * SfA * SmAfGfG * SfU * SfGn001 RfU * SfU * SfC | 2227 | CUCCGGUUCUGAAG GUGUUC | OSSnR SSnR SSOSSSOOSSnR SS |
| WV-16367 | fC * SfC * SfG * SfG * SfU * SfU * SmCfU * SmG * SfA * SmAmGfG * SfU * SfG * SfU * SfU * SfC * SfU | 2228 | CCGGUUCUGAAG GUGUUCU | SSSSSSOSSSOO SSSSSS |
| WV-16368 | fU * SfCn001 RfC * SfG * SfGn001 RfU * SfU * SmCfU * SmG * SfA * SmAfG * SfG * SfU * SfGn001 RfU * SfU * SfC | 2229 | UCCGGUUCUGAAG GUGUUC | SnRSSnR SSOSSSOSSSnR SS |
| WV-16369 | fU * SfCn001 RfC * SfG * SfGn001 RfU * SfU * SmCfU * SmG * SfA * SmAfGfG * SfU * SfGn001 RfU * SfU * SfC | 2230 | UCCGGUUCUGAAG GUGUUC | SnRSSnR SSOSSSOOSSnR SS |
| WV-16370 | fC * SfC * SfG * SfG * SfU * SfU * SmCfU * SmG * SfA * SmAmGfG * SfU * SfG * SfU * SfU * SfC | 2231 | CCGGUUCUGAAG GUGUUC | SSSSSSOSSSOO SSSSS |
| WV-16371 | fU * SfCn001 RfC * SfG * SfGn001 RfU * SfU * SmCfU * SmG * SfA * SmAfG * SfG * SfU * SfGn001 RfU * SfU | 2232 | UCCGGUUCUGAAG GUGUU | SnRSSnR SSOSSSOSSSnRS |
| WV-16372 | fU * SfCn001 RfC * SfG * SfGn001 RfU * SfU * SmCfU * SmG * SfA * SmAfGfG * SfU * SfUn001 RfU * SfU | 2233 | UCCGGUUCUGAAG GUGUU | SnRSSnR SSOSSSOOSSnRS |
| WV-16499 | Mod105L001fC * SfU * SfCn001 RfC * SfG * SfGn001 RfU * SfU * SmCfU * SmG * SfA * SmAfGfG * SfU * SfGn001 RfU * SfU * SfC | 2234 | CUCCGGUUCUGAAG GUGUUC | OSSnR SSnR SSOSSSOOSSnR SS |
| WV-16500 | mU * mC * mA * mC * mU * mC * mA * mG * mA * mU * mA * mG * mU * mU * mG * mA * mA * mG * mC * mC | 2235 | UCACUCAGAUA GUUGAAGCC | XXXXX XXXXX XXXXX XXXX |
| WV-16501 | fU * fA * fA * fG * fG * mAfA * mGmA * fU * mGmGfC * fA * fU * fU * fU * fC * fU | 2236 | CAAGGAAGA UGG CAUUUCU | XXXXX OXOXXOOXXXXX X |

TABLE A1-continued

| | | | | |
|---|---|---|---|---|
| WV-16502 | fA * fA * fG * fG * mAfA * mGmA * fU * mGmGfC * fA * mU * fU * fU * fU * fC * fU | 2237 | AAGGAAGA UG GCAUUUCU | XXXXOXOXXOOXXXX X X |
| WV-16503 | fUfC * fA * fA * fG * fG * mAfA * mGmA * fU * mGmGfC * fA * fU * fU * fU * fC * fU | 2238 | UCAAGGAAGA UGGCAUUUCU | OXXXXX OXOXXOOXXXXX X |
| WV-16504 | fU * fU * fC * fA * fA * fG * fG * mAfA * mGmA * fU * mGmGfC * fA * fU * fU * fU * fC * fU | 2239 | UUCAAGGAAGA UGGCAUUUCU | XXXXX XXOXOXXOOXXXXX X |
| WV-16505 | Mod105L001fU * SfC * SfA * SfC * SfU * SfC * SmAn001 fG * SfA * SmU * SfA * SmGn001 mUn001 fU * SfG * SfA * SfA * SfG * SfC * SfC | 2240 | UCACUCAGAUA GUUGAAGCC | O SSSSSSnX SSSSnXnX SSSSSS |
| WV-16506 | Mod108L001fU * SfC * SfA * SfC * SfU * SfC * SmAn001 fG * SfA * SmU * SfA * SmGn001 mUn001 fU * SfG * SfA * SfA * SfG * SfC * SfC | 2241 | UCACUCAGAUA GUUGAAGCC | O SSSSSSnX SSSSnXnX SSSSSS |
| WV-16507 | Mod099L001fU * SfC * SfA * SfC * SfU * SfC * SmAn001 fG * SfA * SmU * SfA * SmGn001 mUn001 fU * SfG * SfA * SfA * SfG * SfC * SfC | 2242 | UCACUCAGAUA GUUGAAGCC | O SSSSSSnX SSSSnXnX SSSSSS |
| WV-17765 | Mod102L001fU * SfC * SfA * SfC * SfU * SfC * SmAn001fG * SfA * SmU * SfA * SmGn001 mUn001fU * SfG * SfA * SfA * SfG * SfC * SfC | 2243 | UCACUCAGAU AGUUGAAGCC | OSSSS SSnXSS SSnXnXS SSSSS |
| WV-17774 | fU * SfC * SfAn001RfC * SfU * SfCn001RmAfG * SfA * SmU * SfA * SmGmUfU * SfG * SfA * SfAn001RfG * SfC * SfC | 2244 | UCACUCAGAU AGUUGAAGCC | SSnRSS nR OSSSS OOSS SnRSS |
| WV-17775 | L001fU * SfC * SfAn001RfC * SfU * SfCn001RmAfG * SfA * SmU * SfA * SmGmUfU * SfG * SfA * SfAn001RfG * SfC * SfC | 2245 | UCACUCAGAU AGUUGAAGCC | OSSnRS SnROSS SSOOS SSnRSS |
| WV-17801 | fU * SfC * SfAn001SfC * SfU * SfCn001SmAfG * SfA * SmU * SfA * SmGmUfU * SfG * SfA * SfAn001SfG * SfC * SfC | 2246 | UCACUCAGAU AGUUGAAGCC | SSnSSSnS OSSSS OOSSSnS SS |
| WV-17802 | fU * SfC * SfAn001RfC * SfU * SfC * SmAn001RfG * SfA * SmU * SfA * SmGmUfU * SfG * SfA * SfAn001RfG * SfC * SfC | 2247 | UCACUCAGAU AGUUGAAGCC | SSnRSS SnRSSS SOOSS SnRSS |
| WV-17803 | fU * SfC * SfAn001RfC * SfU * SfCn001RmA * SfG * SfA * SmU * SfA * SmGmUfU * SfG * SfA * SfAn001RfG * SfC * SfC | 2248 | UCACUCAGAU AGUUGAAGCC | SSnRSS nR SSSSS OOSS SnRSS |
| WV-17831 | Mod007L001fU * SfC * SfA * SfC * SfU * SfC * SmAn001fG * SfA * SmU * SfA * SmGn001mUn001fU * SfG * SfA * SfA * SfG * SfC * SfC | 2249 | UCACUCAGAU AGUUGAAGCC | OSSSS SSnXSS SSnXnXS SSSSS |
| WV-17832 | Mod027L001fU * SfC * SfA * SfC * SfU * SfC * SmAn001fG * SfA * SmU * SfA * SmGn001mUn001fU * SfG * SfA * SfA * SfG * SfC * SfC | 2250 | UCACUCAGAU AGUUGAAGCC | OSSSS SSnXSS SSnXnXS SSSSS |
| WV-17833 | Mod028L001fU * SfC * SfA * SfC * SfU * SfC * SmAn001fG * SfA * SmU * SfA * SmGn001mUn001fU * SfG * SfA * SfA * SfG * SfC * SfC | 2251 | UCACUCAGAU AGUUGAAGCC | OSSSS SSnXSS SSnXnXS SSSSS |
| WV-17834 | Mod029L001fU * SfC * SfA * SfC * SfU * SfC * SmAn001fG * SfA * SmU * SfA * SmGn001mUn001fU * SfG * SfA * SfA * SfG * SfC * SfC | 2252 | UCACUCAGAU AGUUGAAGCC | OSSSS SSnXSS SSnXnXS SSSSS |

TABLE A1-continued

| | | | | |
|---|---|---|---|---|
| WV-17835 | fG * SfG * SfU * SfU * SmCfU * SmG * SfA * SmAmGfG * SfU * SfG * SfU * SfU * SfC * SfU | 2253 | GGUUCUGAAG GUGUUCU | SSSSO SSSOO SSSSS S |
| WV-17836 | fUfC * SfC * SfG * SfG * SfU * SfU * SmCfU * SmG * SfA * SmAmGfG * SfU * SfG * SfU * SfU * SfC * SfU | 2254 | UCCGGUUCUG AAGGUGUUCU | OSSSS SSOSS SOOSS SSSS |
| WV-17837 | fG * SfU * SfC * SfC * SfG * SfG * SfU * SfU * SmCfU * SmG * SfA * SmAmGfG * SfU * SfG * SfU * SfU * SfC * SfU | 2255 | GUCCGGUUCU GAAGGUGUUCU | SSSSS SSSOS SSOOS SSSSS |
| WV-17838 | fCn001RfC * SfG * SfGn001RfU * SfU * SmCfU * SmG * SfA * SmAfGfG * SfU * SfGn001RfU * SfU * SfC | 2256 | CCGGUUCUGA AGGUGUUC | nRSSnRS SOSSS OOSSnRSS |
| WV-17839 | fCfU * SfCn001RfC * SfG * SfGn001RfU * SfU * SmCfU * SmG * SfA * SmAfGfG * SfU * SfGn001RfU * SfU * SfC | 2257 | CUCCGGUUCU GAAGGUGUUC | OSnRSSnR SSOSS SOOSSnRSS |
| WV-17840 | fC * SfC * SfU * SfCn001RfC * SfG * SfGn001RfU * SfU * SmCfU * SmG * SfA * SmAfGfG * SfU * SfGn001RfU * SfU * SfC | 2258 | CCUCCGGUUC UGAAGGUGUUC | SSSnRS SnRSSO SSSOO SSnRSS |
| WV-17841 | fCn001RfC * SfG * SfGn001RfU * SfU * SmCfU * SmG * SfA * SmAfG * SfG * SfU * SfGn001RfU * SfU * SfC | 2259 | CCGGUUCUGA AGGUGUUC | nRSSnRS SOSSS OSSSnRSS |
| WV-17842 | fCfU * SfCn001RfC * SfG * SfGn001RfU * SfU * SmCfU * SmG * SfA * SmAfG * SfG * SfU * SfGn001RfU * SfU * SfC | 2260 | CUCCGGUUCU GAAGGUGUUC | OSnRSSnR SSOSS SOSSSnRSS |
| WV-17843 | fC * SfC * SfU * SfCn001RfC * SfG * SfGn001RfU * SfU * SmCfU * SmG * SfA * SmAfG * SfG * SfU * SfGn001RfU * SfU * SfC | 2261 | CCUCCGGUUC UGAAGGUGUUC | SSSnRS SnRSSOSSSOSSSnRSS |
| WV-17844 | rC rA rG rA rG rU rA rA rC rA rG rU rC rU rG rA rG rU rA rG rG rU rU rU rU rA rG rA rG rC rU rA | 2262 | CAGAGUAACA GUCUGAGUAG GUUUUAGAGC UA | OOOOO OOOOO OOOOO OOOOO OOOOO OOOOO O |
| WV-17845 | rG rA rG rU rA rA rC rA rG rU rC rU rG rA rG rU rA rG rG rU rU rU rU rA rG rA rG rC rU rA | 2263 | GAGUAACAGU CUGAGUAGGU UUUAGAGCUA | OOOOO OOOOO OOOOO OOOOO OOOOO OOOO |
| WV-17846 | rG * rA * rG * rU * rA * rA * rC * rA * rG rU rC rU rG rA rG rU rA rG rG rU rU rU rU * rA * rG * rA * rG * rC * rU * rA | 2264 | GAGUAACAGU CUGAGUAGGU UUUAGAGCUA | XXXXX XXXOO OOOOO OOOOO OOXXXXXXX |
| WV-17847 | rG * rA * rG * rU * rA * rA * rC * rA * rG * rU * rC * rU * rG * rA * rG * rU * rA * rG * rG * rU * rU * rU * rU * rA * rG * rA * rG * rC * rU * rA | 2265 | GAGUAACAGU CUGAGUAGGU UUUAGAGCUA | XXXXX XXXXX XXXXX XXXXX XXXXX XXXX |
| WV-17848 | mGmAmGmUmAmAmCmA rG rU rC rU rG rA rG rU rA rG rG rU rU rUmUmAmGmAmGmCmUmA | 2266 | GAGUAACAGU CUGAGUAGGU UUUAGAGCUA | OOOOO OOOOO OOOOO OOOOO OOOOO OOOO |
| WV-17849 | mG * mA * mG * mU * mA * mA * mC * mA * rG rU rC rU rG rA rG rU rA rG rG rU rU rUmU * mA * mG * mA * mG * mC * mU * mA | 2267 | GAGUAACAGU CUGAGUAGGU UUUAGAGCUA | XXXXX XXXOO OOOOO OOOOO OOXXXXXXX |
| WV-17850 | mG * mA * mG * mU * mA * mA * mC * mA * rG * rU * rC * rU * rG * rA * rG * rU * rA * rG * rG * rU * rU * rU * mU * mA * mG * | 2268 | GAGUAACAGU CUGAGUAGGU | XXXXX XXXXX XXXXX XXXXX |

TABLE A1-continued

| | | | | |
|---|---|---|---|---|
| | mA * mG * mC * mU * mA | | UUUAGAGCUA | XXXXX XXXX |
| WV-17851 | fGfAfGfUfAfAfCfA rG rU rC rU rG rA rG rU rA rG rG rU rU rUfUfAfGfAfGfCfUfA | 2269 | GAGUAACAGU CUGAGUAGGU UUUAGAGCUA | OOOOO OOOOO OOOOO OOOOO OOOOO OOOO |
| WV-17852 | fG * fA * fG * fU * fA * fA * fC * fA * rG rU rC rU rG rA rG rU rA rG rG rU rU rUfU * fA* fG * fA * fG * fC * fU * fA | 2270 | GAGUAACAGU CUGAGUAGGU UUUAGAGCUA | XXXXX XXXOO OOOOO OOOOO OOXXXXXXX |
| WV-17853 | fG * fA * fG * fU * fA * fA * fC * fA * rG * rU * rC * rU * rG * rA * rG * rU * rA * rG * rG * rU * rU * rU * fU * fA * fG * fA * fG * fC * fU * fA | 2271 | GAGUAACAGU CUGAGUAGGU UUUAGAGCUA | XXXXX XXXXX XXXXX XXXXX XXXXX XXXX |
| WV-17854 | rG rA rG rU rAn001 rAn001 rCn001 rAn001 rG rU rC rU rG rA rG rU rA rG rG rU rU rU rU rA rG rA rGn001 rCn001 rUn001 rA | 2272 | GAGUAACAGU CUGAGUAGGU UUUAGAGCUA | OOOOnX nXnXnXOO OOOOO OOOOO OOOOO OnXnXnX |
| WV-17855 | rG rA rG rU rA rA rC rA rG rU rC rU rG rA rG rU rA rG rG rU rU rU rU rA rG rA rGn001 rCn001 rUn001 rA | 2273 | GAGUAACAGU CUGAGUAGGU UUUAGAGCUA | OOOOO OOOOO OOOOO OOOOO OOOOO OnXnXnX |
| WV-17856 | rG rA rG rU rAn001 rAn001 rCn001 rAn001 rG rU rC rU rG rA rG rU rA rG rG rU rU rU rU rA rG rA rG rC rU rA | 2274 | GAGUAACAGU CUGAGUAGGU UUUAGAGCUA | OOOOnX nXnXnXOO OOOOO OOOOO OOOOO OOOO |
| WV-17857 | rG rA rG rU rA rAn001 rC rAn001 rG rU rC rU rG rA rG rU rA rG rG rU rU rU rU rA rG rA rGn001 rC rUn001 rA | 2275 | GAGUAACAGU CUGAGUAGGU UUUAGAGCUA | OOOOO nXOnXOO OOOOO OOOOO OOOOO OnXOnX |
| WV-17858 | rG rA rG rU rAn001 rA rCn001 rA rG rU rC rU rG rA rG rU rA rG rG rU rU rU rU rA rG rA rG rCn001 rUn001 rA | 2276 | GAGUAACAGU CUGAGUAGGU UUUAGAGCUA | OOOOnX OnXOOO OOOOO OOOOO OOOOO OOnXnX |
| WV-17859 | fU * SfC * SfAn001fA * SfG * SfG * SmA * SfA * SmGmA * SfU * SmGmGfCn001fA * SfU * SfUn001fU * SfC * SfU | 2277 | UCAAGGAAGA UGGCAUUUCU | SSnXSS SSSOS SOOnXS SnXSS |
| WV-17860 | fU * SfC * SfAn001fA * SfG * SfG * SmAfA * SmGmA * SfU * SmGmG * SfCn001fA * SfU * SfUn001fU * SfC * SfU | 2278 | UCAAGGAAGA UGGCAUUUCU | SSnXSS SOSOS SOSnXS SnXSS |
| WV-17861 | fU * SfC * SfAn001fA * SfG * SfG * SmA * SfA * SmGmA * SfU * SmGmG * SfCn001fA * SfU * SfUn001fU * SfC * SfU | 2279 | UCAAGGAAGA UGGCAUUUCU | SSnXSS SSSOS SOSnXS SnXSS |
| WV-17862 | fU * SfC * SfAn001fA * SfG * SfG * SfA * SfA * SmGmA * SfU * SmGfG * SfCn001fA * SfU * SfUn001fU * SfC * SfU | 2280 | UCAAGGAAGA UGGCAUUUCU | SSnXSS SSSOS SOSnXS SnXSS |
| WV-17863 | fU * SfC * SfAn001fA * SfG * SfGn001mA * SfA * SmGmA * SfU * SmGmGfC * SfA * SfU * SfUn001fU * SfC * SfU | 2281 | UCAAGGAAGA UGGCAUUUCU | SSnXSS nXSSOS SOOSS SnXSS |
| WV-17864 | fU * SfC * SfAn001fA * SfG * SfGn001mAfA * SmGmA * SfU * SmGmG * SfC * SfA * SfU * SfUn001fU * SfC * SfU | 2282 | UCAAGGAAGA UGGCAUUUCU | SSnXSS nXOSOS SOSSS SnXSS |
| WV- | fU * SfC * SfAn001fA * SfG * SfGn001mA * SfA * SmGmA * SfU * | 2283 | UCAAGGAAGA | SSnXSS nXSSOS SOSSS |

TABLE A1-continued

| | | | | |
|---|---|---|---|---|
| 17865 | SmGmG * SfC * SfA * SfU * SfUn001fU * SfC * SfU | | UGGCAUUUCU | SnXSS |
| WV-17866 | fU * SfC * SfAn001fA * SfG * SfGn001fA * SfA * SmGmA * SfU * SmGfG * SfC * SfA * SfU * SfUn001fU * SfC * SfU | 2284 | UCAAGGAAGA UGGCAUUUCU | SSnXSS nXSSOS SOSSS SnXSS |
| WV-17881 | fG fA fG fUn001 fA fA fCn001 fA rG rU rC rU rG rA rG rU rA rG rG rU rU rU fU fA fGn001 fA fG fCn001 fU fA | 2285 | GAGUAACAGUCUGAGUA GGUU UUAGAGCUA | XXXnXX XnXXO OOOOO OOOOO OOOXX nXXXnXX |
| WV-17882 | fG fA fG fUn001 fA fA fCn001 fA rG rU rC rU rG rA rG rU rA rG rG rU rU rUn001 fU fA fGn001 fA fG fCn001 fU fA | 2286 | GAGUAACAGUCUGAGUA GGUU UUAGAGCUA | XXXnXX XnXXO OOOOO OOOOO OOnXXX nXXXnXX |
| WV-17883 | fG fA fG fUn001 fA fA fCn001 fA rG rU rC rU rG rA rG rU rA rG rGn001 rU rU rUn001 fU fA fUn001 fA fG fCn001 fU fA | 2287 | GAGUAACAGUCUGAGUA GGUU UUAGAGCUA | XXXnXX XnXXO OOOOO OOOOnX OOnXXX nXXXnXX |
| WV-18853 | fC fC fUn001 fA fC fCn001 fC fU mA fU mG fU mAn001 fC fA fU fCn001 fG fU fU | 2288 | CCUACCCUAUGUACAUC GUU | SSnXSS nXSSSS SSnXSS SnXSS |
| WV-18854 | fC fC fUn001 fA fU fGn001 fU fA mC fA mU fC mGn001 fU fU fC fUn001 fG fC fU | 2289 | CCUAUGUACAUCGUUCU GCU | SSnXSS nXSSSS SSnXSS SnXSS |
| WV-18855 | fG fU fAn001 fC fA fUn001 fC fG mU fU mC fU mGn001 fC fU fU fCn001 fU fG fA | 2290 | GUACAUCGUUCUGCUUC UGA | SSnXSS nXSSSS SSnXSS SnXSS |
| WV-18856 | fU fC fGn001 fU fU fCn001 fU fG mC fU mU fC mUn001 fG fA fA fCn001 fU fG fC | 2291 | UCGUUCUGCUUCUGAAC UGC | SSnXSS nXSSSS SSnXSS SnXSS |
| WV-18857 | fU fC fUn001 fG fC fUn001 fU fC mU fG mA fA mCn001 fU fG fC fUn001 fG fG fA | 2292 | UCUGCUUCUGAACUGCU GGA | SSnXSS nXSSSS SSnXSS SnXSS |
| WV-18858 | fU fU fCn001 fU fG fAn001 fA fC mU fG mC fU mGn001 fG fA fA fAn001 fG fU fC | 2293 | UUCUGAACUGCUGGAAA GUC | SSnXSS nXSSSS SSnXSS SnXSS |
| WV-18859 | fA fA fCn001 fU fG fCn001 fU fG mG fA mA fA mGn001 fU fC fG fCn001 fC fU fC | 2294 | AACUGCUGGAAAGUCGC CUC | SSnXSS nXSSSS SSnXSS SnXSS |
| WV-18860 | fA fA fGn001 fU fC fGn001 fC fC mU fC mC fA mAn001 fU fA fG fGn001 fU fG fC | 2295 | AAGUCGCCUCCAAUAGG UGC | SSnXSS nXSSSS SSnXSS SnXSS |
| WV-18861 | fG fC fCn001 fU fC fCn001 fA fA mU fA mG fG mUn001 fG fC fC fUn001 fG fC fC | 2296 | GCCUCCAAUAGGUGCCU GCC | SSnXSS nXSSSS SSnXSS SnXSS |
| WV-18862 | fC fA fAn001 fU fA fGn001 fG fU mG fC mC fU mGn001 fC fC fG fGn001 fC fU fU | 2297 | CAAUAGGUGCCUGCCGG CUU | SSnXSS nXSSSS SSnXSS SnXSS |
| WV-18863 | fU fG fUn001 fG fC fCn001 fU fG mC fC mG fG mCn001 fU fU fA fAn001 fU fU fC | 2298 | GGUGCCUGCCGGCUUAA UUC | SSnXSS nXSSSS SSnXSS SnXSS |
| WV-18864 | fC fU fGn001 fC fU fGn001 fG fC mU fU mA fA mUn001 fU fC fA fUn001 fC fA fU | 2299 | CUGCCGGCUUAAUUCAU CAU | SSnXSS nXSSSS SSnXSS SnXSS |
| WV-18865 | fG fG fCn001 fU fU fAn001 fA fU mU fC mA fU mCn001 fA fU fC fUn001 fU fU fC | 2300 | GGCUUAAUUCAUCAUCU UUC | SSnXSS nXSSSS SSnXSS SnXSS |

TABLE A1-continued

| | | | | |
|---|---|---|---|---|
| WV-18866 | fA fA fUn001 fU fC fAn001 fU fC mA fU mC fU mUn001 fU fC fA fGn001 fC fU fG | 2301 | AAUUCAUCAUCUUUCAGCUG | SSnXSS nXSSSS SSnXSS SnXSS |
| WV-18867 | fA fU fCn001 fA fU fCn001 fU fU mU fC mA fG mCn001 fU fG fU fAn001 fG fC fC | 2302 | AUCAUCUUUCAGCUGUAGCC | SSnXSS nXSSSS SSnXSS SnXSS |
| WV-18868 | fC fU fUn001 fU fC fAn001 fG fC mU fG mU fA mGn001 fC fC fA fCn001 fA fC fC | 2303 | CUUUCAGCUGUAGCCACACC | SSnXSS nXSSSS SSnXSS SnXSS |
| WV-18869 | fA fG fCn001 fU fG fUn001 fA fG mC fC mA fC mAn001 fC fC fA fGn001 fA fA fG | 2304 | AGCUGUAGCCACACCAGAAG | SSnXSS nXSSSS SSnXSS SnXSS |
| WV-18870 | fU fA fGn001 fC fC fAn001 fC fA mC fC mA fG mAn001 fA fG fU fUn001 fC fC fU | 2305 | UAGCCACACCAGAAGUUCCU | SSnXSS nXSSSS SSnXSS SnXSS |
| WV-18871 | fA fC fAn001 fC fC fAn001 fG fA mA fG mU fU mCn001 fC fU fG fCn001 fA fG fA | 2306 | ACACCAGAAGUUCCUGCAGA | SSnXSS nXSSSS SSnXSS SnXSS |
| WV-18872 | fA fG fAn001 fA fG fUn001 fU fC mC fU mG fC mAn001 fG fA fG fAn001 fA fA fG | 2307 | AGAAGUUCCUGCAGAGAAAG | SSnXSS nXSSSS SSnXSS SnXSS |
| WV-18873 | fU fC fCn001 fU fG fCn001 fA fG mA fG mA fA mAn001 fG fG fU fGn001 fC fA fG | 2308 | UCCUGCAGAGAAAGGUGCAG | SSnXSS nXSSSS SSnXSS SnXSS |
| WV-18874 | fC fA fGn001 fA fG fAn001 fA fA mG fG mU fG mCn001 fA fG fA fCn001 fG fC fU | 2309 | CAGAGAAAGGUGCAGACGCU | SSnXSS nXSSSS SSnXSS SnXSS |
| WV-18875 | fA fA fAn001 fG fG fUn001 fG fC mA fG mA fC mGn001 fC fU fU fCn001 fC fA fC | 2310 | AAAGGUGCAGACGCUUCCAC | SSnXSS nXSSSS SSnXSS SnXSS |
| WV-18876 | fU fG fCn001 fA fG fAn001 fC fG mC fU mU fC mCn001 fA fC fU fGn001 fG fU fC | 2311 | UGCAGACGCUUCCACUGGUC | SSnXSS nXSSSS SSnXSS SnXSS |
| WV-18877 | fA fC fGn001 fC fU fUn001 fC fC mA fC mU fG mGn001 fU fC fA fGn001 fA fA fC | 2312 | ACGCUUCCACUGGUCAGAAC | SSnXSS nXSSSS SSnXSS SnXSS |
| WV-18878 | fU fC fCn001 fA fC fUn001 fG fG mU fC mA fG mAn001 fA fC fU fGn001 fG fC fU | 2313 | UCCACUGGUCAGAACUGGCU | SSnXSS nXSSSS SSnXSS SnXSS |
| WV-18879 | fU fG fGn001 fU fC fAn001 fG fA mA fC mU fG mGn001 fC fU fU fCn001 fC fA fA | 2314 | UGGUCAGAACUGGCUUCCAA | SSnXSS nXSSSS SSnXSS SnXSS |
| WV-18880 | fA fG fAn001 fA fC fUn001 fG fG mC fU mU fC mCn001 fA fA fA fCn001 fG fG fG | 2315 | AGAACUGGCUUCCAAAUGGG | SSnXSS nXSSSS SSnXSS SnXSS |
| WV-18881 | fU fG fGn001 fC fU fUn001 fC fC mA fA mA fU mGn001 fG fG fA fCn001 fC fU fG | 2316 | UGGCUUCCAAAUGGGACCUG | SSnXSS nXSSSS SSnXSS SnXSS |
| WV-18882 | fA fG fGn001 fC fA fCn001 fG fA mG fG mC fU mUn001 fA fA fA fAn001 fA fU fG | 2317 | AGGCACGAGGCUUAAAAAUG | SSnXSS nXSSSS SSnXSS SnXSS |

TABLE A1-continued

| | | | | |
|---|---|---|---|---|
| WV-18883 | fG fG fCn001 fA fC fGn001 fA fG mG fC mU fU mAn001 fA fA fA fAn001 fU fG fU | 2318 | GGCACGAGGCUUAAAAAUGU | SSnXSS nXSSSS SSnXSS SnXSS |
| WV-18884 | fG fC fAn001 fC fG fAn001 fG fG mC fU mU fA mAn001 fA fA fA fUn001 fG fU fC | 2319 | GCACGAGGCUUAAAAAUGUC | SSnXSS nXSSSS SSnXSS SnXSS |
| WV-18885 | fC fA fCn001 fG fA fGn001 fG fC mU fU mA fA mAn001 fA fA fU fGn001 fU fC fC | 2320 | CACGAGGCUUAAAAAUGUCC | SSnXSS nXSSSS SSnXSS SnXSS |
| WV-18886 | fA fC fGn001 fA fG fGn001 fC fU mU fA mA fA mAn001 fA fU fG fUn001 fC fC fU | 2321 | ACGAGGCUUAAAAAUGUCCU | SSnXSS nXSSSS SSnXSS SnXSS |
| WV-18887 | fC fG fAn001 fG fG fCn001 fU fU mA fA fA mAn001 fU fG fU fCn001 fC fU fA | 2322 | CGAGGCUUAAAAAUGUCCUA | SSnXSS nXSSSS SSnXSS SnXSS |
| WV-18888 | fG fA fGn001 fG fC fUn001 fU fA mA fA mA fA mUn001 fG fU fC fCn001 fU fA fC | 2323 | GAGGCUUAAAAAUGUCCUAC | SSnXSS nXSSSS SSnXSS SnXSS |
| WV-18889 | fA fG fGn001 fC fU fUn001 fA fA mA fA mA fU mGn001 fU fC fC fUn001 fA fC fC | 2324 | AGGCUUAAAAAUGUCCUACC | SSnXSS nXSSSS SSnXSS SnXSS |
| WV-18890 | fG fG fCn001 fU fU fAn001 fA fA mA fA mU fG mUn001 fC fC fU fAn001 fC fC fC | 2325 | GGCUUAAAAAUGUCCUACCC | SSnXSS nXSSSS SSnXSS SnXSS |
| WV-18891 | fG fC fUn001 fU fA fAn001 fA fA mA fU mG fU mCn001 fC fU fA fCn001 fC fC fU | 2326 | GCUUAAAAAUGUCCUACCCU | SSnXSS nXSSSS SSnXSS SnXSS |
| WV-18892 | fC fU fUn001 fA fA fAn001 fA fA mU fG mU fC mCn001 fU fA fC fCn001 fC fU fA | 2327 | CUUAAAAAUGUCCUACCCUA | SSnXSS nXSSSS SSnXSS SnXSS |
| WV-18893 | fU fU fAn001 fA fA fAn001 fA fU mG fU mC fC mUn001 fA fC fC fCn001 fU fA fU | 2328 | UUAAAAAUGUCCUACCCUAU | SSnXSS nXSSSS SSnXSS SnXSS |
| WV-18894 | fU fA fAn001 fA fA fAn001 fU fG mU fC mC fU mAn001 fC fC fC fUn001 fA fU fG | 2329 | UAAAAAUGUCCUACCCUAUG | SSnXSS nXSSSS SSnXSS SnXSS |
| WV-18895 | fA fA fAn001 fA fA fUn001 fG fU mC fC mU fA mCn001 fC fC fU fAn001 fU fG fU | 2330 | AAAAAUGUCCUACCCUAUGU | SSnXSS nXSSSS SSnXSS SnXSS |
| WV-18896 | fA fA fAn001 fA fU fGn001 fU fC mC fU mA fC mCn001 fC fU fA fUn001 fG fU fA | 2331 | AAAAUGUCCUACCCUAUGUA | SSnXSS nXSSSS SSnXSS SnXSS |
| WV-18897 | fA fA fAn001 fU fG fUn001 fU fC mU fA mC fC mCn001 fU fA fU fGn001 fU fA fC | 2332 | AAAUGUCCUACCCUAUGUAC | SSnXSS nXSSSS SSnXSS SnXSS |
| WV-18898 | fA fA fUn001 fG fU fCn001 fC fU mA fC mC fC mUn001 fA fU fG fUn001 fA fC fA | 2333 | AAUGUCCUACCCUAUGUACA | SSnXSS nXSSSS SSnXSS SnXSS |
| WV-18899 | fA fU fGn001 fU fC fCn001 fU fA mC fC mC fU mAn001 fU fG fU fAn001 fC fA fU | 2334 | AUGUCCUACCCUAUGUACAU | SSnXSS nXSSSS SSnXSS SnXSS |
| WV-18900 | fU fG fUn001 fC fC fUn001 fA fC mC fC mU fA mAn001 fG fU fA fCn001 fA fU fC | 2335 | UGUCCUACCCUAUGUACAUC | SSnXSS nXSSSS SSnXSS SnXSS |

TABLE A1-continued

| | | | | |
|---|---|---|---|---|
| WV-18901 | fG fU fCn001 fC fU fAn001 fC fC mC fU mA fU mGn001 fU fA fC fAn001 fU fC fG | 2336 | GUCCUACCCUAUGUACAUCG | SSnXSS nXSSSS SSnXSS SnXSS |
| WV-18902 | fU fC fCn001 fU fA fCn001 fC fC mU fA mU fG mUn001 fA fC fA fUn001 fC fG fU | 2337 | UCCUACCCUAUGUACAUCGU | SSnXSS nXSSSS SSnXSS SnXSS |
| WV-18903 | fC fU fAn001 fC fC fCn001 fU fA mU fG mU fA mCn001 fA fU fC fGn001 fU fU fC | 2338 | CUACCCUAUGUACAUCGUUC | SSnXSS nXSSSS SSnXSS SnXSS |
| WV-18904 | fU fA fCn001 fC fC fUn001 fA fU mG fU mA fC mAn001 fU fC fG fUn001 fU fC fU | 2339 | UACCCUAUGUACAUCGUUCU | SSnXSS nXSSSS SSnXSS SnXSS |
| WV-18905 | fU fU fCn001 fG fA fAn001 fA fA mA fA mC fA mAn001 fA fU fC fAn001 fA fA fG | 2340 | UUCGAAAAAACAAAUCAAAG | SSnXSS nXSSSS SSnXSS SnXSS |
| WV-18906 | fU fC fGn001 fA fA fAn001 fA fA mA fC mA fA mAn001 fU fC fA fAn001 fA fG fA | 2341 | UCGAAAAAACAAAUCAAAGA | SSnXSS nXSSSS SSnXSS SnXSS |
| WV-18907 | fC fG fAn001 fA fA fAn001 fA fA mC fA mA fA mUn001 fC fA fA fAn001 fG fA fC | 2342 | CGAAAAAACAAAUCAAAGAC | SSnXSS nXSSSS SSnXSS SnXSS |
| WV-18908 | fG fA fAn001 fA fA fAn001 fA fC mA fA mA fU mCn001 fA fA fA fGn001 fA fC fU | 2343 | GAAAAAACAAAUCAAAGACU | SSnXSS nXSSSS SSnXSS SnXSS |
| WV-18909 | fA fA fAn001 fA fA fAn001 fC fA mA fA mU fC mAn001 fA fA fG fAn001 fC fU fU | 2344 | AAAAAACAAAUCAAAGACUU | SSnXSS nXSSSS SSnXSS SnXSS |
| WV-18910 | fA fA fAn001 fA fA fCn001 fA fA mA fU mC fA mAn001 fA fG fA fCn001 fU fU fA | 2345 | AAAAACAAAUCAAAGACUUA | SSnXSS nXSSSS SSnXSS SnXSS |
| WV-18911 | fA fA fAn001 fA fC fAn001 fA fA mU fC mA fA mAn001 fG fA fC fUn001 fU fA fC | 2346 | AAAACAAAUCAAAGACUUAC | SSnXSS nXSSSS SSnXSS SnXSS |
| WV-18912 | fA fA fAn001 fC fA fAn001 fA fU mC fA mA fA mGn001 fA fC fU fUn001 fA fC fC | 2347 | AAACAAAUCAAAGACUUACC | SSnXSS nXSSSS SSnXSS SnXSS |
| WV-18913 | fA fA fCn001 fA fA fAn001 fU fC mA fA mA fG mAn001 fC fU fU fAn001 fC fC fU | 2348 | AACAAAUCAAAGACUUACCU | SSnXSS nXSSSS SSnXSS SnXSS |
| WV-18914 | fA fC fAn001 fA fA fUn001 fC fA mA fA mG fA mCn001 fU fU fA fCn001 fC fU fU | 2349 | ACAAAUCAAAGACUUACCUU | SSnXSS nXSSSS SSnXSS SnXSS |
| WV-18915 | fC fA fAn001 fA fU fCn001 fA fA mA fG mA fC mUn001 fU fA fC fCn001 fU fU fA | 2350 | CAAAUCAAAGACUUACCUUA | SSnXSS nXSSSS SSnXSS SnXSS |
| WV-18916 | fA fA fAn001 fU fC fAn001 fA fA mG fA mC fU mUn001 fA fC fC fUn001 fU fA fA | 2351 | AAAUCAAAGACUUACCUUAA | SSnXSS nXSSSS SSnXSS SnXSS |
| WV-18917 | fA fA fUn001 fC fA fAn001 fA fG mA fC mU fU mAn001 fC fC fU fUn001 fA fA fG | 2352 | AAUCAAAGACUUACCUUAAG | SSnXSS nXSSSS SSnXSS SnXSS |
| WV-18918 | fA fU fCn001 fA fA fAn001 fG fA mC fU mU fA mCn001 fC fU fU fAn001 fA fG fA | 2353 | AUCAAAGACUUACCUUAAGA | SSnXSS nXSSSS SSnXSS SnXSS |

TABLE A1-continued

| | | | | |
|---|---|---|---|---|
| WV-18919 | fU fC fAn001 fA fA fGn001 fA fC mU fU mA fC mCn001 fU fU fA fAn001 fG fA fU | 2354 | UCAAAGACUUACCUUAA GAU | SSnXSS nXSSSS SSnXSS SnXSS |
| WV-18920 | fC fA fAn001 fA fG fAn001 fC fU mU fA fC fC mUn001 fU fA fA fGn001 fA fU fA | 2355 | CAAAGACUUACCUUAAG AUA | SSnXSS nXSSSS SSnXSS SnXSS |
| WV-18921 | fA fA fAn001 fG fA fCn001 fU fU mA fC mC fU mUn001 fA fA fG fAn001 fU fA fC | 2356 | AAAGACUUACCUUAAGA UAC | SSnXSS nXSSSS SSnXSS SnXSS |
| WV-18922 | fA fA fGn001 fA fC fUn001 fU fA mC fC mU fU mAn001 fA fG fA fUn001 fA fC fC | 2357 | AAGACUUACCUUAAGAU ACC | SSnXSS nXSSSS SSnXSS SnXSS |
| WV-18923 | fA fG fAn001 fC fU fUn001 fA fC mC fU mU fA mAn001 fG fA fU fAn001 fC fC fA | 2358 | AGACUUACCUUAAGAUA CCA | SSnXSS nXSSSS SSnXSS SnXSS |
| WV-18924 | fG fA fCn001 fU fU fAn001 fC fC mU fU mA fA mGn001 fA fU fA fCn001 fC fA fU | 2359 | GACUUACCUUAAGAUAC CAU | SSnXSS nXSSSS SSnXSS SnXSS |
| WV-18925 | fA fC fUn001 fU fA fCn001 fC fU mU fA mA fG mAn001 fU fA fC fCn001 fA fU fU | 2360 | ACUUACCUUAAGAUACC AUU | SSnXSS nXSSSS SSnXSS SnXSS |
| WV-18926 | fC fU fUn001 fA fC fCn001 fU fU mA fA mG fA mUn001 fA fC fC fAn001 fU fU fU | 2361 | CUUACCUUAAGAUACCA UUU | SSnXSS nXSSSS SSnXSS SnXSS |
| WV-18927 | fU fU fAn001 fC fC fUn001 fU fA mA fG mA fU mAn001 fC fC fA fUn001 fU fU fG | 2362 | UUACCUUAAGAUACCAU UUG | SSnXSS nXSSSS SSnXSS SnXSS |
| WV-18928 | fU fA fCn001 fC fU fUn001 fA fA mG fA mU fA mCn001 fC fA fU fUn001 fU fG fU | 2363 | UACCUUAAGAUACCAUU UGU | SSnXSS nXSSSS SSnXSS SnXSS |
| WV-18929 | fA fG fGn001 fC fA fAn001 fA fA mC fA mA fA mAn001 fA fU fG fAn001 fA fG fC | 2364 | AGGCAAAACAAAAAUGA AGC | SSnXSS nXSSSS SSnXSS SnXSS |
| WV-18930 | fG fC fAn001 fA fA fAn001 fC fA mA fA mA fA mUn001 fG fA fA fGn001 fC fC fC | 2365 | GCAAAACAAAAAUGAAG CCC | SSnXSS nXSSSS SSnXSS SnXSS |
| WV-18931 | fA fA fAn001 fA fC fAn001 fA fA mA fA mU fG mAn001 fA fG fC fCn001 fC fC fA | 2366 | AAAACAAAAAUGAAGCC CCA | SSnXSS nXSSSS SSnXSS SnXSS |
| WV-18932 | fA fA fCn001 fA fA fAn001 fA fA mU fG mA fA mGn001 fC fC fC fCn001 fA fU fG | 2367 | AACAAAAAUGAAGCCCC AUG | SSnXSS nXSSSS SSnXSS SnXSS |
| WV-18933 | fC fA fAn001 fA fA fAn001 fU fG mA fA mG fC mCn001 fC fC fA fUn001 fG fU fC | 2368 | CAAAAAUGAAGCCCCAU GUC | SSnXSS nXSSSS SSnXSS SnXSS |
| WV-18934 | fA fA fAn001 fA fU fGn001 fA fA mG fC mC fC mCn001 fA fU fG fUn001 fC fU fU | 2369 | AAAAUGAAGCCCCAUGU CUU | SSnXSS nXSSSS SSnXSS SnXSS |

TABLE A1-continued

| | | | | |
|---|---|---|---|---|
| WV-18935 | fA fA fUn001 fG fA fAn001 fG fC mC fC mC fA mUn001 fG fU fC fUn001 fU fU fU | 2370 | AAUGAAGCCCCAUGUCUUUU | SSnXSS nXSSSS SSnXSS SnXSS |
| WV-18936 | fA fU fGn001 fA fA fGn001 fC fC mC fC mA fU mGn001 fU fC fU fUn001 fU fU fU | 2371 | AUGAAGCCCCAUGUCUUUUU | SSnXSS nXSSSS SSnXSS SnXSS |
| WV-18937 | fG fA fAn001 fG fC fCn001 fC fC mA fU mG fU mCn001 fU fU fU fUn001 fU fA fU | 2372 | GAAGCCCCAUGUCUUUUUAU | SSnXSS nXSSSS SSnXSS SnXSS |
| WV-18938 | fA fG fCn001 fC fC fCn001 fA fU mG fU mC fU mUn001 fU fU fU fAn001 fU fU fU | 2373 | AGCCCCAUGUCUUUUUAUUU | SSnXSS nXSSSS SSnXSS SnXSS |
| WV-18939 | fC fC fCn001 fC fA fUn001 fG fU mC fU mU fU mUn001 fU fA fU fUn001 fU fG fA | 2374 | CCCCAUGUCUUUUUAUUUGA | SSnXSS nXSSSS SSnXSS SnXSS |
| WV-18940 | fU fG fAn001 fA fG fCn001 fC fC mC fA mU fG mUn001 fC fU fU fUn001 fU fU fA | 2375 | UGAAGCCCCAUGUCUUUUUA | SSnXSS nXSSSS SSnXSS SnXSS |
| WV-18941 | fA fA fGn001 fC fC fCn001 fC fA mU fG mU fC mUn001 fU fU fU fUn001 fA fU fU | 2376 | AAGCCCCAUGUCUUUUUAUU | SSnXSS nXSSSS SSnXSS SnXSS |
| WV-18942 | fG fC fCn001 fC fC fAn001 fU fG mU fC mU fU mUn001 fU fU fA fUn001 fU fU fG | 2377 | GCCCCAUGUCUUUUUAUUUG | SSnXSS nXSSSS SSnXSS SnXSS |
| WV-18944 | fU fC fA fC fU fC mAn001 fG fA mU fA mGn001 mUn001 fU fG fA fA fG fC fC | 2378 | UCACUCAGAUAGUUGAAGCC | XXXXX XnXXXX XnXnXXX XXXX |
| WV-18945 | fU fC fAn001 fC fU fCn001 mA fG fA mU fA mG mU fU fG fA fAn001 fG fC fC | 2379 | UCACUCAGAUAGUUGAAGCC | XXnXXX nXOXXX XOOXXX nXXX |
| WV-18983 | fC fC fU fA fC fC fC fU mA fU mG fU mA fC fA fU fC fG fU fU | 2380 | CCUACCCUAUGUACAUCGUU | SSSSS SSSSS SSSSS SSSS |
| WV-18984 | fC fC fU fA fU fG fU fA mC fA mU fC mG fU fU fC fU fG fC fU | 2381 | CCUAUGUACAUCGUUCUGCU | SSSSS SSSSS SSSSS SSSS |
| WV-18985 | fG fU fA fC fA fU fC fG mU fU mC fU mG fC fU fU fC fU fG fA | 2382 | GUACAUCGUUCUGCUUCUGA | SSSSS SSSSS SSSSS SSSS |
| WV-18986 | fU fC fG fU fU fC fU fG mC fU mU fC mU fG fA fA fC fU fG fC | 2383 | UCGUUCUGCUUCUGAACUGC | SSSSS SSSSS SSSSS SSSS |
| WV-18987 | fU fC fU fG fC fU fU fC mU fG mA fA mC fU fG fC fU fG fG fA | 2384 | UCUGCUUCUGAACUGCUGGA | SSSSS SSSSS SSSSS SSSS |
| WV-18988 | fU fU fC fU fG fA fA fC mU fG mC fU mG fG fA fA fA fG fU fC | 2385 | UUCUGAACUGCUGGAAAGUC | SSSSS SSSSS SSSSS SSSS |
| WV-18989 | fA fA fC fU fG fC fU fG mG fA mA fA mG fU fC fG fC fC fU fC | 2386 | AACUGCUGGAAAGUCGCCUC | SSSSS SSSSS SSSSS SSSS |

TABLE A1-continued

| | | | | |
|---|---|---|---|---|
| WV-18990 | fA fA fG fU fC fG fC fC mU fC mC fA mA fU fA fG fG fU fG fC | 2387 | AAGUCGCCUCCAAUAGGUGC | SSSSS SSSSS SSSSS SSSS |
| WV-18991 | fG fC fC fU fC fC fA fA mU fA mG fG mU fG fC fC fU fG fC fC | 2388 | GCCUCCAAUAGGUGCCUGCC | SSSSS SSSSS SSSSS SSSS |
| WV-18992 | fC fA fA fU fA fG fG fU mG fC mC fU mG fC fC fG fG fC fU fU | 2389 | CAAUAGGUGCCUGCCGGCUU | SSSSS SSSSS SSSSS SSSS |
| WV-18993 | fG fG fU fG fC fC fU fG mC fC mG fG mC fU fU fA fA fU fU fC | 2390 | GGUGCCUGCCGGCUUAAUUC | SSSSS SSSSS SSSSS SSSS |
| WV-18994 | fC fU fG fC fC fG fG fC mU fU mA fA mU fU fC fA fU fC fA fU | 2391 | CUGCCGGCUUAAUUCAUCAU | SSSSS SSSSS SSSSS SSSS |
| WV-18995 | fG fG fC fU fU fA fA fU mU fC mA fU mC fA fU fC fU fU fU fC | 2392 | GGCUUAAUUCAUCAUCUUUC | SSSSS SSSSS SSSSS SSSS |
| WV-18996 | fA fA fU fU fC fA fU fC mA fU mC fU mU fU fC fA fG fC fU fG | 2393 | AAUUCAUCAUCUUUCAGCUG | SSSSS SSSSS SSSSS SSSS |
| WV-18997 | fA fU fC fA fU fC fU fU mU fC mA fG mC fU fG fU fA fG fC fC | 2394 | AUCAUCUUUCAGCUGUAGCC | SSSSS SSSSS SSSSS SSSS |
| WV-18998 | fC fU fU fU fC fA fG fC mU fG mU fA mG fC fC fA fC fA fC fC | 2395 | CUUUCAGCUGUAGCCACACC | SSSSS SSSSS SSSSS SSSS |
| WV-18999 | fA fG fC fU fG fU fA fG mC fC mA fC mA fC fC fA fG fA fA fG | 2396 | AGCUGUAGCCACACCAGAAG | SSSSS SSSSS SSSSS SSSS |
| WV-19000 | fU fA fG fC fC fA fC fA mC fC mA fG mA fA fG fU fU fC fC fU | 2397 | UAGCCACACCAGAAGUUCCU | SSSSS SSSSS SSSSS SSSS |
| WV-19001 | fA fC fA fC fC fA fG fA mA fG mU fU mC fC fU fG fC fA fG fA | 2398 | ACACCAGAAGUUCCUGCAGA | SSSSS SSSSS SSSSS SSSS |
| WV-19002 | fA fG fA fA fG fU fU fC mC fU mG fC mA fG fA fG fA fA fA fG | 2399 | AGAAGUUCCUGCAGAGAAAG | SSSSS SSSSS SSSSS SSSS |
| WV-19003 | fU fC fC fU fG fC fA fG mA fG mA fA mA fG fG fU fG fC fA fG | 2400 | UCCUGCAGAGAAAGGUGCAG | SSSSS SSSSS SSSSS SSSS |
| WV-19004 | fC fA fG fA fG fA fA fA mG fG mU fG mC fA fG fA fC fG fC fU | 2401 | CAGAGAAAGGUGCAGACGCU | SSSSS SSSSS SSSSS SSSS |
| WV-19005 | fA fA fA fG fG fU fG fC mA fG mA fC mG fC fU fU fC fC fA fC | 2402 | AAAGGUGCAGACGCUUCCAC | SSSSS SSSSS SSSSS SSSS |
| WV-19006 | fU fG fC fA fG fA fC fG mC fU mU fC mC fA fC fU fG fG fU fC | 2403 | UGCAGACGCUUCCACUGGUC | SSSSS SSSSS SSSSS SSSS |

TABLE A1-continued

| | | | | |
|---|---|---|---|---|
| WV-19007 | fA fC fG fC fU fU fC fC mA fC mU fG mG fU fC fA fG fA fA fC | 2404 | ACGCUUCCACUGGUCAG AAC | SSSSS SSSSS SSSSS SSSS |
| WV-19008 | fU fC fC fA fC fU fG fG mU fC mA fG mA fA fC fU fG fG fC fU | 2405 | UCCACUGGUCAGAACUG GCU | SSSSS SSSSS SSSSS SSSS |
| WV-19009 | fU fG fG fU fC fA fG fA mA fC mU fG mG fC fU fU fC fC fA fA | 2406 | UGGUCAGAACUGGCUUC CAA | SSSSS SSSSS SSSSS SSSS |
| WV-19010 | fA fG fA fA fC fU fG fG mC fU mU fC mC fA fA fA fU fG fG fG | 2407 | AGAACUGGCUUCCAAAU GGG | SSSSS SSSSS SSSSS SSSS |
| WV-19011 | fU fG fG fC fU fU fC fC mA fA mA fU mG fG fG fA fC fC fU fG | 2408 | UGGCUUCCAAAUGGGAC CUG | SSSSS SSSSS SSSSS SSSS |
| WV-19012 | fA fG fG fC fA fC fG fA mG fG mC fU mU fA fA fA fA fA fU fG | 2409 | AGGCACGAGGCUUAAAA AUG | SSSSS SSSSS SSSSS SSSS |
| WV-19013 | fG fG fC fA fC fG fA fG mG fC mU fU mA fA fA fA fA fU fG fU | 2410 | GGCACGAGGCUUAAAAA UGU | SSSSS SSSSS SSSSS SSSS |
| WV-19014 | fG fC fA fC fG fA fG fG mC fU mU fA mA fA fA fA fU fG fU fC | 2411 | GCACGAGGCUUAAAAAU GUC | SSSSS SSSSS SSSSS SSSS |
| WV-19015 | fC fA fC fG fA fG fG fC mU fU mA fA mA fA fA fU fG fU fC fC | 2412 | CACGAGGCUUAAAAAUG UCC | SSSSS SSSSS SSSSS SSSS |
| WV-19016 | fA fC fG fA fG fG fC fU mU fA mA fA mA fA fU fG fU fC fC fU | 2413 | ACGAGGCUUAAAAAUGU CCU | SSSSS SSSSS SSSSS SSSS |
| WV-19017 | fC fG fA fG fG fC fU fU mA fA mA fA mA fU fG fU fC fC fU fA | 2414 | CGAGGCUUAAAAAUGUC CUA | SSSSS SSSSS SSSSS SSSS |
| WV-19018 | fG fA fG fG fC fU fU fA mA fA mA fA mU fG fU fC fC fU fA fC | 2415 | GAGGCUUAAAAAUGUCC UAC | SSSSS SSSSS SSSSS SSSS |
| WV-19019 | fA fG fG fC fU fU fA fA mA fA mA fU mG fU fC fC fU fA fC fC | 2416 | AGGCUUAAAAAUGUCCU ACC | SSSSS SSSSS SSSSS SSSS |
| WV-19020 | fG fG fC fU fU fA fA fA mA fA mU fG mU fC fC fU fA fC fC fC | 2417 | GGCUUAAAAAUGUCCUA CCC | SSSSS SSSSS SSSSS SSSS |
| WV-19021 | fG fC fU fU fA fA fA fA mA fU mG fU mC fC fU fA fC fC fC fU | 2418 | GCUUAAAAAUGUCCUAC CCU | SSSSS SSSSS SSSSS SSSS |
| WV-19022 | fC fU fU fA fA fA fA fA mU fG mU fC mC fU fA fC fC fC fU fA | 2419 | CUUAAAAAUGUCCUACC CUA | SSSSS SSSSS SSSSS SSSS |
| WV-19023 | fU fU fA fA fA fA fA fU mG fU mC fC mU fA fC fC fC fU fA fU | 2420 | UUAAAAAUGUCCUACCC UAU | SSSSS SSSSS SSSSS SSSS |

TABLE A1-continued

| | | | | |
|---|---|---|---|---|
| WV-19024 | fU fA fA fA fA fA fU fG mU fC mC fU mA fC fC fC fU fA fU fG | 2421 | UAAAAAUGUCCUACCCUAUG | SSSSS SSSSS SSSSS SSSS |
| WV-19025 | fA fA fA fA fA fU fG fU mC fC mU fA mC fC fC fU fA fU fG fU | 2422 | AAAAAUGUCCUACCCUAUGU | SSSSS SSSSS SSSSS SSSS |
| WV-19026 | fA fA fA fA fU fG fU fC mC fU mA fC mC fC fU fA fU fG fU fA | 2423 | AAAAUGUCCUACCCUAUGUA | SSSSS SSSSS SSSSS SSSS |
| WV-19027 | fA fA fA fU fG fU fC fC mU fA mC fC mC fU fA fU fG fU fA fC | 2424 | AAAUGUCCUACCCUAUGUAC | SSSSS SSSSS SSSSS SSSS |
| WV-19028 | fA fA fU fG fU fC fC fU mA fC mC fC mU fA fU fG fU fA fC fA | 2425 | AAUGUCCUACCCUAUGUACA | SSSSS SSSSS SSSSS SSSS |
| WV-19029 | fA fU fG fU fC fC fU fA mC fC mC fU mA fU fG fU fA fC fA fU | 2426 | AUGUCCUACCCUAUGUACAU | SSSSS SSSSS SSSSS SSSS |
| WV-19030 | fU fG fU fC fC fU fA fC mC fC mU fA mU fG fU fA fC fA fU fC | 2427 | UGUCCUACCCUAUGUACAUC | SSSSS SSSSS SSSSS SSSS |
| WV-19031 | fG fU fC fC fU fA fC fC mC fU mA fU mG fU fA fC fA fG fC fG | 2428 | GUCCUACCCUAUGUACAUCG | SSSSS SSSSS SSSSS SSSS |
| WV-19032 | fU fC fC fU fA fC fC fC mU fA mU fG mU fA fC fA fU fC fG fU | 2429 | UCCUACCCUAUGUACAUCGU | SSSSS SSSSS SSSSS SSSS |
| WV-19033 | fC fU fA fC fC fC fU fA mU fG mU fA mC fA fU fC fG fU fU fC | 2430 | CUACCCUAUGUACAUCGUUC | SSSSS SSSSS SSSSS SSSS |
| WV-19034 | fU fA fC fC fC fU fA fU mG fU mA fC mA fU fC fG fU fU fC fU | 2431 | UACCCUAUGUACAUCGUUCU | SSSSS SSSSS SSSSS SSSS |
| WV-19801 | fC fC fU fU fC fC mC fU fG mA fA mG mG fU fU fC fC fU fC fC | 2432 | CCUUCCCUGAAGGUUCCUCC | XXXXX XOXXX XOOXX XXXX |
| WV-19802 | fC fC fU fU fC fC mC fU fG mA fA mG mG fU fU fC fC fU fC fC | 2433 | CCUUCCCUGAAGGUUCCUCC | SSSSS SOSSS SOOSS SSSS |
| WV-19803 | fC fC fU fU fC fC mCn001 fU fG mA fA mGn001 mGn001 fU fU fC fC fU fC fC | 2434 | CCUUCCCUGAAGGUUCCUCC | XXXXX XnXXXX XnXnXXX XXXX |
| WV-19804 | fC fC fU fU fC fC mCn001 fU fG mA fA mGn001 mGn001 fU fU fC fC fU fC fC | 2435 | CCUUCCCUGAAGGUUCCUCC | SSSSS SnXSSS SnXnXSS SSSS |
| WV-19805 | fC fC fUn001 fU fC fCn001 mC fU fG mA fA mG mG fU fU fC fCn001 fU fC fC | 2436 | CCUUCCCUGAAGGUUCCUCC | XXnXXX nXOXXX XOOXX XnXXX |
| WV-19806 | fC fC fUn001 R fU fC fCn001 R mC fU fG mA fA mG mG fU fU fC fCn001 R fU fC fC | 2437 | CCUUCCCUGAAGGUUCCUCC | SSnRSS nROSSS SOOSS SnRSS |

TABLE A1-continued

| | | | | |
|---|---|---|---|---|
| WV-19886 | fC fU fUn001 fC fU fGn001 fC fC mA fA mC fU mU fU fU fA fUn001 fC fA fU | 2438 | CUUCUGCCAACUUUUAU CAU | SSnXSS nXSSSS SSSSS SnXSS |
| WV-19887 | fU fU fCn001 fU fG fCn001 fC fA mA fC mU fU mU fU fA fU fCn001 fA fU fU | 2439 | UUCUGCCAACUUUUAUC AUU | SSnXSS nXSSSS SSSSS SnXSS |
| WV-19888 | fU fC fUn001 fG fC fCn001 fA fA mC fU mU fU mU fA fU fC fAn001 fU fU fU | 2440 | UCUGCCAACUUUUAUCA UUU | SSnXSS nXSSSS SSSSS SnXSS |
| WV-19889 | fC fU fGn001 fC fC fAn001 fA fC mU fU mU fU mA fU fC fA fUn001 fU fU fU | 2441 | CUGCCAACUUUUAUCAU UUU | SSnXSS nXSSSS SSSSS SnXSS |
| WV-19890 | fU fG fCn001 fC fA fAn001 fC fU mU fU mU fA mU fC fA fU fUn001 fU fU fU | 2442 | UGCCAACUUUUAUCAUU UUU | SSnXSS nXSSSS SSSSS SnXSS |
| WV-19891 | fG fC fCn001 fA fA fCn001 fU fU mU fU mA fU mC fA fU fU fUn001 fU fU fU | 2443 | GCCAACUUUUAUCAUUU UUU | SSnXSS nXSSSS SSSSS SnXSS |
| WV-19892 | fC fC fAn001 fA fC fUn001 fU fU mU fA mU fC mA fU fU fU fUn001 fU fU fC | 2444 | CCAACUUUUAUCAUUUU UUC | SSnXSS nXSSSS SSSSS SnXSS |
| WV-19893 | fC fA fAn001 fC fU fUn001 fU fU mA fU mC fA mU fU fU fU fUn001 fU fC fU | 2445 | CAACUUUUAUCAUUUUU UCU | SSnXSS nXSSSS SSSSS SnXSS |
| WV-19894 | fA fA fCn001 fU fU fUn001 fU fA mU fC mA fU mU fU fU fU fUn001 fC fU fC | 2446 | AACUUUUAUCAUUUUUU CUC | SSnXSS nXSSSS SSSSS SnXSS |
| WV-19895 | fA fC fUn001 fU fU fUn001 fA fU mC fA mU fU mU fU fU fU fCn001 fU fC fA | 2447 | ACUUUUAUCAUUUUUUC UCA | SSnXSS nXSSSS SSSSS SnXSS |
| WV-19896 | fC fU fUn001 fU fU fAn001 fU fC mA fU mU fU mU fU fU fC fUn001 fC fA fU | 2448 | CUUUUAUCAUUUUUUCU CAU | SSnXSS nXSSSS SSSSS SnXSS |
| WV-19897 | fU fU fUn001 fU fA fUn001 fC fA mU fU mU fU mU fU fC fU fCn001 fA fU fA | 2449 | UUUUAUCAUUUUUUCUC AUA | SSnXSS nXSSSS SSSSS SnXSS |
| WV-19898 | fU fU fUn001 fA fU fCn001 fA fU mU fU mU fU mU fC fU fC fAn001 fU fA fC | 2450 | UUUAUCAUUUUUUCUCA UAC | SSnXSS nXSSSS SSSSS SnXSS |
| WV-19899 | fU fU fAn001 fU fC fAn001 fU fU mU fU mU fU mC fU fC fA fUn001 fA fC fC | 2451 | UUAUCAUUUUUUCUCAU ACC | SSnXSS nXSSSS SSSSS SnXSS |
| WV-19900 | fU fA fUn001 fC fA fUn001 fU fU mU fU mU fC mU fC fA fU fAn001 fC fC fU | 2452 | UAUCAUUUUUUCUCAUA CCU | SSnXSS nXSSSS SSSSS SnXSS |
| WV-19901 | fA fU fCn001 fA fU fUn001 fU fU mU fU mC fU mC fA fU fA fCn001 fC fU fU | 2453 | AUCAUUUUUUCUCAUAC CUU | SSnXSS nXSSSS SSSSS SnXSS |
| WV-19902 | fU fC fAn001 fU fU fUn001 fU fU mU fC mU fC mA fU fA fC fCn001 fU fU fC | 2454 | UCAUUUUUUCUCAUACC UUC | SSnXSS nXSSSS SSSSS SnXSS |
| WV-19903 | fC fA fUn001 fU fU fUn001 fU fU mC fU mC fA mU fA fC fC fUn001 fU fC fU | 2455 | CAUUUUUUCUCAUACCU UCU | SSnXSS nXSSSS SSSSS SnXSS |

TABLE A1-continued

| | | | | |
|---|---|---|---|---|
| WV-19904 | fA fG fUn001 fU fU fUn001 fU fC mU fC mA fU mA fC fC fU fUn001 fC fU fG | 2456 | AUUUUUUCUCAUACCUUCUG | SSnXSS nXSSSS SSSSS SnXSS |
| WV-19905 | fU fU fUn001 fU fU fUn001 fC fU mC fA mU fA mC fC fU fU fCn001 fU fG fC | 2457 | UUUUUUCUCAUACCUUCUGC | SSnXSS nXSSSS SSSSS SnXSS |
| WV-19906 | fU fU fUn001 fU fU fCn001 fU fC mA fU mA fC mC fU fU fC fUn001 fG fC fU | 2458 | UUUUUCUCAUACCUUCUGCU | SSnXSS nXSSSS SSSSS SnXSS |
| WV-19907 | fU fU fUn001 fU fC fUn001 fC fA mU fA mC fC mU fU fC fU fGn001 fC fU fU | 2459 | UUUUCUCAUACCUUCUGCUU | SSnXSS nXSSSS SSSSS SnXSS |
| WV-19908 | fU fU fUn001 fC fU fCn001 fA fU mA fC mC fU mU fC fU fG fCn001 fU fU fG | 2460 | UUUCUCAUACCUUCUGCUUG | SSnXSS nXSSSS SSSSS SnXSS |
| WV-19909 | fU fU fCn001 fU fC fAn001 fU fA mC fC mU fU mC fU fG fC fUn001 fU fG fA | 2461 | UUCUCAUACCUUCUGCUUGA | SSnXSS nXSSSS SSSSS SnXSS |
| WV-19910 | fU fC fUn001 fC fA fUn001 fA fC mC fU mU fC mU fG fC fU fUn001 fG fA fU | 2462 | UCUCAUACCUUCUGCUUGAU | SSnXSS nXSSSS SSSSS SnXSS |
| WV-19911 | fC fU fCn001 fA fU fAn001 fC fC mU fU mC fU mG fC fU fU fGn001 fA fU fG | 2463 | CUCAUACCUUCUGCUUGAUG | SSnXSS nXSSSS SSSSS SnXSS |
| WV-19912 | fU fC fAn001 fU fA fCn001 fC fU mU fC mU fG mC fU fU fG fAn001 fU fG fA | 2464 | UCAUACCUUCUGCUUGAUGA | SSnXSS nXSSSS SSSSS SnXSS |
| WV-19913 | fC fA fUn001 fA fC fCn001 fU fU mC fU mG fC mU fU fG fA fUn001 fG fA fU | 2465 | CAUACCUUCUGCUUGAUGAU | SSnXSS nXSSSS SSSSS SnXSS |
| WV-19914 | fA fU fAn001 fC fC fUn001 fU fC mU fG mC fU mU fG fA fU fGn001 fA fU fC | 2466 | AUACCUUCUGCUUGAUGAUC | SSnXSS nXSSSS SSSSS SnXSS |
| WV-19915 | fU fA fCn001 fc fU fUn001 fC fU mG fC mU fU mG fA fU fG fAn001 fU fC fA | 2467 | UACCUUCUGCUUGAUGAUCA | SSnXSS nXSSSS SSSSS SnXSS |
| WV-19916 | fA fC fCn001 fU fU fCn001 fU fG mC fU mU fG mA fU fG fA fUn001 fC fA fU | 2468 | ACCUUCUGCUUGAUGAUCAU | SSnXSS nXSSSS SSSSS SnXSS |
| WV-19917 | fC fC fUn001 fU fC fUn001 fG fC mU fU mG fA mU fG fA fU fCn001 fA fU fC | 2469 | CCUUCUGCUUGAUGAUCAUC | SSnXSS nXSSSS SSSSS SnXSS |
| WV-19918 | fC fU fUn001 fC fU fGn001 fC fU mU fG mA fU mG fA fU fC fAn001 fU fC fU | 2470 | CUUCUGCUUGAUGAUCAUCU | SSnXSS nXSSSS SSSSS SnXSS |
| WV-19919 | fU fU fCn001 fU fG fCn001 fU fU mG fA mU fG mA fU fC fA fUn001 fC fU fC | 2471 | UUCUGCUUGAUGAUCAUCUC | SSnXSS nXSSSS SSSSS SnXSS |
| WV-19920 | fU fC fUn001 fG fC fUn001 fU fG mA fU mG fA mU fC fA fU fCn001 fU fC fG | 2472 | UCUGCUUGAUGAUCAUCUCG | SSnXSS nXSSSS SSSSS SnXSS |
| WV-19921 | fC fU fGn001 fC fU fUn001 fG fA mU fG mA fU mC fA fU fC fUn001 fC fG fU | 2473 | CUGCUUGAUGAUCAUCUCGU | SSnXSS nXSSSS SSSSS SnXSS |

TABLE A1-continued

| | | | | |
|---|---|---|---|---|
| WV-19922 | fU fU fCn001 fU fU fGn001 fA fU mG fA mU fC mA fU fC fU fCn001 fG fU fU | 2474 | UGCUUGAUGAUCAUCUC GUU | SSnXSS nXSSSS SSSSS SnXSS |
| WV-19923 | fG fC fUn001 fU fG fAn001 fU fG mA fU mC fA mU fC fU fC fGn001 fU fU fG | 2475 | GCUUGAUGAUCAUCUCG UUG | SSnXSS nXSSSS SSSSS SnXSS |
| WV-19924 | fC mU fUn001 fG fA fU fUn001 fG fA mU fC mA fU mC fU fC fG fUn001 fU fG fA | 2476 | CUUGAUGAUCAUCUCGU UGA | SSnXSS nXSSSS SSSSS SnXSS |
| WV-19925 | fU fU fGn001 fA fU fGn001 fA fU mC fA mU fC mU fC fG fU fUn001 fG fA fU | 2477 | UUGAUGAUCAUCUCGUU GAU | SSnXSS nXSSSS SSSSS SnXSS |
| WV-19926 | fU fG fAn001 fU fG fAn001 fU fC mA fU mC fU mC fG fU fU fGn001 fA fU fA | 2478 | UGAUGAUCAUCUCGUUG AUA | SSnXSS nXSSSS SSSSS SnXSS |
| WV-19927 | fG fA fUn001 fG fA fUn001 fC fA mU fC mU fC mG fU fU fG fAn001 fU fA fU | 2479 | GAUGAUCAUCUCGUUGA UAU | SSnXSS nXSSSS SSSSS SnXSS |
| WV-19928 | fA fU fGn001 fA fU fCn001 fA fU mC fU mC fG mU fU fG fA fUn001 fA fU fC | 2480 | AUGAUCAUCUCGUUGAU AUC | SSnXSS nXSSSS SSSSS SnXSS |
| WV-19929 | fU fG fAn001 fU fC fAn001 fU fC mU fC mG fU mU fG fA fU fAn001 fU fC fC | 2481 | UGAUCAUCUCGUUGAUA UCC | SSnXSS nXSSSS SSSSS SnXSS |
| WV-19930 | fG fA fUn001 fC fA fUn001 fC fU mC fG mU fU mG fA fU fA fUn001 fC fC fU | 2482 | GAUCAUCUCGUUGAUAU CCU | SSnXSS nXSSSS SSSSS SnXSS |
| WV-19931 | fA fU fCn001 fA fU fCn001 fU fC mG fU mU fG mA fU fA fU fCn001 fC fU fC | 2483 | AUCAUCUCGUUGAUAUC CUC | SSnXSS nXSSSS SSSSS SnXSS |
| WV-19932 | fU fC fAn001 fU fC fUn001 fC fG mU fU mG fA mU fA fU fC fCn001 fU fC fA | 2484 | UCAUCUCGUUGAUAUCC UCA | SSnXSS nXSSSS SSSSS SnXSS |
| WV-19933 | fC fA fUn001 fC fu fCn001 fG fU mU fG mA fU mA fU fC fC fUn001 fC fA fA | 2485 | CAUCUCGUUGAUAUCCU CAA | SSnXSS nXSSSS SSSSS SnXSS |
| WV-19934 | fA fU fCn001 fU fC fGn001 fU fU mG fA mU fA mU fC fC fU fCn001 fA fA fG | 2486 | AUCUCGUUGAUAUCCUC AAG | SSnXSS nXSSSS SSSSS SnXSS |
| WV-19935 | fU fC fUn001 fC fG fUn001 fU fG mA fU mA fU mC fC fU fC fAn001 fA fG fG | 2487 | UCUCGUUGAUAUCCUCA AGG | SSnXSS nXSSSS SSSSS SnXSS |
| WV-19936 | fC fU fCn001 fG fU fUn001 fG fA mU fA mU fC mC fU fC fA fAn001 fG fG fU | 2488 | CUCGUUGAUAUCCUCAA GGU | SSnXSS nXSSSS SSSSS SnXSS |
| WV-19937 | fU fC fGn001 fU fU fGn001 fA fU mA fU mC fC mU fC fA fA fGn001 fG fU fC | 2489 | UCGUUGAUAUCCUCAAG GUC | SSnXSS nXSSSS SSSSS SnXSS |
| WV-19938 | fC fG fUn001 fU fG fAn001 fU fA mU fC mC fU mC fA fA fG fGn001 fU fC fA | 2490 | CGUUGAUAUCCUCAAGG UCA | SSnXSS nXSSSS SSSSS SnXSS |

TABLE A1-continued

| | | | | |
|---|---|---|---|---|
| WV-19939 | fG fU fUn001 fG fA fUn001 fA fU mC fC mU fC mA fA fG fG fUn001 fC fA fC | 2491 | GUUGAUAUCCUCAAGGUCAC | SSnXSS nXSSSS SSSSS SnXSS |
| WV-19940 | fU fU fGn001 fA fU fAn001 fU fC mC fU mC fA mA fG fG fU fCn001 fA fC fC | 2492 | UUGAUAUCCUCAAGGUCACC | SSnXSS nXSSSS SSSSS SnXSS |
| WV-19941 | fU fG fAn001 fU fA fUn001 fC fC mU fC mA fA mG fG fU fC fAn001 fC fC fC | 2493 | UGAUAUCCUCAAGGUCACCC | SSnXSS nXSSSS SSSSS SnXSS |
| WV-19942 | fG fA fUn001 fA fU fCn001 fC fU mC fA mA fG mG fU fC fA fCn001 fC fC fA | 2494 | GAUAUCCUCAAGGUCACCCA | SSnXSS nXSSSS SSSSS SnXSS |
| WV-19943 | fA fU fAn001 fU fC fCn001 fU fC mA fA mG fG mU fC fA fC fUn001 fC fA fC | 2495 | AUAUCCUCAAGGUCACCCAC | SSnXSS nXSSSS SSSSS SnXSS |
| WV-19944 | fU fA fUn001 fC fC fUn001 fC fA mA fG mG fU mC fA fC fC fCn001 fA fC fC | 2496 | UAUCCUCAAGGUCACCCACC | SSnXSS nXSSSS SSSSS SnXSS |
| WV-19945 | fA fU fCn001 fC fU fCn001 fA fA mG fG mU fC mA fC fC fC fAn001 fC fC fA | 2497 | AUCCUCAAGGUCACCCACCA | SSnXSS nXSSSS SSSSS SnXSS |
| WV-19946 | fU fC fCn001 fU fC fAn001 fA fG mG fU mC fA mC fC fC fA fCn001 fC fA fU | 2498 | UCCUCAAGGUCACCCACCAU | SSnXSS nXSSSS SSSSS SnXSS |
| WV-19947 | fC fC fUn001 fC fA fAn001 fG fG mU fC mA fC mC fC fA fC fCn001 fA fU fC | 2499 | CCUCAAGGUCACCCACCAUC | SSnXSS nXSSSS SSSSS SnXSS |
| WV-19948 | fC fU fCn001 fA fA fGn001 fG fU mC fA mC fC mC fA fC fC fAn001 fU fC fA | 2500 | CUCAAGGUCACCCACCAUCA | SSnXSS nXSSSS SSSSS SnXSS |
| WV-19949 | fU fC fAn001 fA fG fGn001 fU fC mA fC mC fC mA fC fC fA fUn001 fC fA fC | 2501 | UCAAGGUCACCCACCAUCAC | SSnXSS nXSSSS SSSSS SnXSS |
| WV-19950 | fC fA fAn001 fG fG fUn001 fC fA mC fC mC fA mC fC fA fU fCn001 fA fC fC | 2502 | CAAGGUCACCCACCAUCACC | SSnXSS nXSSSS SSSSS SnXSS |
| WV-19951 | fA fA fGn001 fG fU fCn001 fA fC mC fC mA fC mC fA fU fC fAn001 fC fC fC | 2503 | AAGGUCACCCACCAUCACCC | SSnXSS nXSSSS SSSSS SnXSS |
| WV-19952 | fA fG fGn001 fU fC fAn001 fC fC mC fA mC fC mA fU fC fA fCn001 fC fC fU | 2504 | AGGUCACCCACCAUCACCCU | SSnXSS nXSSSS SSSSS SnXSS |
| WV-19953 | fG fG fUn001 fC fA fCn001 fC fC mA fC mC fA mU fC fA fC fCn001 fC fU fC | 2505 | GGUCACCCACCAUCACCCUC | SSnXSS nXSSSS SSSSS SnXSS |
| WV-19954 | fG fU fCn001 fA fC fCn001 fC fA mC fC mA fU mC fA fC fC fCn001 fU fC fU | 2506 | GUCACCCACCAUCACCCUCU | SSnXSS nXSSSS SSSSS SnXSS |
| WV-19955 | fU fC fAn001 fC fC fCn001 fA fC mC fA mU fC mA fC fC fC fUn001 fC fU fG | 2507 | UCACCCACCAUCACCCUCUG | SSnXSS nXSSSS SSSSS SnXSS |

TABLE A1-continued

| | | | | |
|---|---|---|---|---|
| WV-19956 | fC fA fCn001 fC fC fAn001 fC fC mA fU mC fA mC fC fC fU fCn001 fU fG fU | 2508 | CACCCACCAUCACCCUCUGU | SSnXSS nXSSSS SSSSS SnXSS |
| WV-19957 | fA fC fCn001 fC fA fCn001 fC fA mU fC mA fC mC fC fU fC fUn001 fG fU fG | 2509 | ACCCACCAUCACCCUCUGUG | SSnXSS nXSSSS SSSSS SnXSS |
| WV-19958 | fC fC fCn001 fA fC fCn001 fA fU mC fA mC fC mC fU fC fU fGn001 fU fG fA | 2510 | CCCACCAUCACCCUCUGUGA | SSnXSS nXSSSS SSSSS SnXSS |
| WV-19959 | fC fC fAn001 fC fC fAn001 fU fC mA fC mC fC mU fC fU fG fUn001 fG fA fU | 2511 | CCACCAUCACCCUCUGUGAU | SSnXSS nXSSSS SSSSS SnXSS |
| WV-19960 | fC fA fCn001 fC fA fUn001 fC fA mC fC mC fU mC fU fG fU fGn001 fA fU fU | 2512 | CACCAUCACCCUCUGUGAUU | SSnXSS nXSSSS SSSSS SnXSS |
| WV-19961 | fA fC fCn001 fA fU fUn001 fA fC mC fC mU fC mU fG fU fG fAn001 fU fU fU | 2513 | ACCAUCACCCUCUGUGAUUU | SSnXSS nXSSSS SSSSS SnXSS |
| WV-19962 | fC fC fAn001 fU fC fAn001 fC fC mC fU mC fU mG fU fG fA fUn001 fU fU fU | 2514 | CCAUCACCCUCUGUGAUUUU | SSnXSS nXSSSS SSSSS SnXSS |
| WV-19963 | fC fA fUn001 fC fA fCn001 fC fC mU fC mU fG mU fG fA fU fUn001 fU fU fA | 2515 | CAUCACCCUCUGUGAUUUUA | SSnXSS nXSSSS SSSSS SnXSS |
| WV-19964 | fA fU fCn001 fA fC fCn001 fC fU mC fU mG fU mG fA fU fU fUn001 fU fA fU | 2516 | AUCACCCUCUGUGAUUUUAU | SSnXSS nXSSSS SSSSS SnXSS |
| WV-19965 | fU fC fAn001 fC fC fCn001 fU fC mU fG mU fG mA fU fU fU fUn001 fA fU fA | 2517 | UCACCCUCUGUGAUUUUAUA | SSnXSS nXSSSS SSSSS SnXSS |
| WV-19966 | fC fA fCn001 fC fC fUn001 fC fU mG fU mG fA mU fU fU fU fAn001 fU fA fA | 2518 | CACCCUCUGUGAUUUUAUAA | SSnXSS nXSSSS SSSSS SnXSS |
| WV-19967 | fA fC fCn001 fC fU fCn001 fU fG mU fG mA fU mU fU fU fA fUn001 fA fA fC | 2519 | ACCCUCUGUGAUUUUAUAAC | SSnXSS nXSSSS SSSSS SnXSS |
| WV-19968 | fC fC fCn001 fU fC fUn001 fG fU mG fA mU fU mU fU fA fU fAn001 fA fC fU | 2520 | CCCUCUGUGAUUUUAUAACU | SSnXSS nXSSSS SSSSS SnXSS |
| WV-19969 | fC fC fUn001 fC fU fGn001 fU fG mA fU mU fU mU fA fU fA fAn001 fC fU fU | 2521 | CCUCUGUGAUUUUAUAACUU | SSnXSS nXSSSS SSSSS SnXSS |
| WV-19970 | fC fU fCn001 fU fG fUn001 fG fA mU fU mU fU mA fU fA fA fCn001 fU fU fG | 2522 | CUCUGUGAUUUUAUAACUUG | SSnXSS nXSSSS SSSSS SnXSS |
| WV-19971 | fU fC fUn001 fG fU fGn001 fA fU mU fU mU fA mU fA fA fC fUn001 fU fG fA | 2523 | UCUGUGAUUUUAUAACUUGA | SSnXSS nXSSSS SSSSS SnXSS |
| WV-19972 | fC fU fGn001 fU fG fAn001 fU fU mU fU mA fU mA fA fC fU fUn001 fG fA fU | 2524 | CUGUGAUUUUAUAACUUGAU | SSnXSS nXSSSS SSSSS SnXSS |

TABLE A1-continued

| | | | | |
|---|---|---|---|---|
| WV-19973 | fU fG fUn001 fG fA fUn001 fU fU mU fA mU fA mA fC fU fU fGn001 fA fU fC | 2525 | UGUGAUUUUAUAACUUG AUC | SSnXSS nXSSSS SSSSS SnXSS |
| WV-19974 | fG fU fGn001 fA fU fUn001 fU fU mA fU mA fA mC fU fU fG fAn001 fU fC fA | 2526 | GUGAUUUUAUAACUUGA UCA | SSnXSS nXSSSS SSSSS SnXSS |
| WV-19975 | fU fG fAn001 fU fU fUn001 fU fA mU fA mA fC mU fU fG fA fUn001 fC fA fA | 2527 | UGAUUUUAUAACUUGAU CAA | SSnXSS nXSSSS SSSSS SnXSS |
| WV-19976 | fG fA fUn001 fU fU fUn001 fA fU mA fA mC fU mU fG fA fU fCn001 fA fA fG | 2528 | GAUUUUAUAACUUGAUC AAG | SSnXSS nXSSSS SSSSS SnXSS |
| WV-19977 | fA fU fUn001 fU fU fAn001 fU fA mA fC mU fU mG fA fU fC fAn001 fA fG fC | 2529 | AUUUUAUAACUUGAUCA AGC | SSnXSS nXSSSS SSSSS SnXSS |
| WV-19978 | fU fU fUn001 fU fA fUn001 fA fA mC fU mU fG mA fU fC fA fAn001 fG fC fA | 2530 | UUUUAUAACUUGAUCAA GCA | SSnXSS nXSSSS SSSSS SnXSS |
| WV-19979 | fU fU fUn001 fA fU fAn001 fA fC mU fU mG fA mU fC fA fA fGn001 fC fA fG | 2531 | UUUAUAACUUGAUCAAG CAG | SSnXSS nXSSSS SSSSS SnXSS |
| WV-19980 | fU fU fAn001 fU fA fAn001 fC fU mU fG mA fU mC fA fA fG fCn001 fA fG fA | 2532 | UUAUAACUUGAUCAAGC AGA | SSnXSS nXSSSS SSSSS SnXSS |
| WV-19981 | fU fA fUn001 fA fA fCn001 fU fU mG fA mU fC mA fA fG fC fAn001 fG fA fG | 2533 | UAUAACUUGAUCAAGCA GAG | SSnXSS nXSSSS SSSSS SnXSS |
| WV-19982 | fA fU fAn001 fA fC fUn001 fU fG mA fU mC fA mA fG fC fA fGn001 fA fG fA | 2534 | AUAACUUGAUCAAGCAG AGA | SSnXSS nXSSSS SSSSS SnXSS |
| WV-19983 | fU fA fAn001 fC fU fUn001 fG fA mU fC mA fA mG fC fA fG fAn001 fG fA fA | 2535 | UAACUUGAUCAAGCAGA GAA | SSnXSS nXSSSS SSSSS SnXSS |
| WV-19984 | fA fA fCn001 fU fU fGn001 fA fU mC fA mA fG mC fA fG fA fGn001 fA fA fA | 2536 | AACUUGAUCAAGCAGAG AAA | SSnXSS nXSSSS SSSSS SnXSS |
| WV-19985 | fA fC fUn001 fU fG fAn001 fU fC mA fA mG fC mA fG fA fG fAn001 fA fA fG | 2537 | ACUUGAUCAAGCAGAGA AAG | SSnXSS nXSSSS SSSSS SnXSS |
| WV-19986 | fC fU fUn001 fG fA fUn001 fC fA mA fG mC fA mG fA fG fA fAn001 fA fG fC | 2538 | CUUGAUCAAGCAGAGAA AGC | SSnXSS nXSSSS SSSSS SnXSS |
| WV-19987 | fU fU fGn001 fA fU fCn001 fA fA mG fC mA fG mA fG fA fA fAn001 fG fC fC | 2539 | UUGAUCAAGCAGAGAAA GCC | SSnXSS nXSSSS SSSSS SnXSS |
| WV-19988 | fU fG fAn001 fU fC fAn001 fA fG mC fA mG fA mG fA fA fA fGn001 fC fC fA | 2540 | UGAUCAAGCAGAGAAAG CCA | SSnXSS nXSSSS SSSSS SnXSS |
| WV-19989 | fG fA fUn001 fC fA fAn001 fG fC mA fG mA fG mA fA fA fG fCn001 fC fA fG | 2541 | GAUCAAGCAGAGAAAGC CAG | SSnXSS nXSSSS SSSSS SnXSS |
| WV-19990 | fA fU fCn001 fA fA fGn001 fC fA mG fA mG fA mA fA fG fC fCn001 fA fG fU | 2542 | AUCAAGCAGAGAAAGCC AGU | SSnXSS nXSSSS SSSSS SnXSS |

TABLE A1-continued

| | | | | |
|---|---|---|---|---|
| WV-19991 | fU fC fAn001 fA fG fCn001 fA fG mA fG mA fA mA fG fC fC fAn001 fG fU fC | 2543 | UCAAGCAGAGAAAGCCAGUC | SSnXSS nXSSSS SSSSS SnXSS |
| WV-19992 | fC fA fAn001 fG fC fAn001 fG fA mG fA mA fA mG fC fC fA fGn001 fU fC fG | 2544 | CAAGCAGAGAAAGCCAGUCG | SSnXSS nXSSSS SSSSS SnXSS |
| WV-19993 | fA fA fGn001 fC fA fGn001 fA fG mA fA mA fG mC fC fA fG fUn001 fC fG fG | 2545 | AAGCAGAGAAAGCCAGUCGG | SSnXSS nXSSSS SSSSS SnXSS |
| WV-19994 | fA fG fCn001 fA fG fAn001 fG fA mA fA mG fC mC fA fG fU fCn001 fG fG fU | 2546 | AGCAGAGAAAGCCAGUCGGU | SSnXSS nXSSSS SSSSS SnXSS |
| WV-19995 | fG fC fAn001 fG fA fGn001 fA fA mA fG mC fC mA fG fU fC fGn001 fG fU fA | 2547 | GCAGAGAAAGCCAGUCGGUA | SSnXSS nXSSSS SSSSS SnXSS |
| WV-19996 | fC fA fGn001 fA fG fAn001 fA fA mG fC mC fA mG fU fC fG fGn001 fU fA fA | 2548 | CAGAGAAAGCCAGUCGGUAA | SSnXSS nXSSSS SSSSS SnXSS |
| WV-19997 | fA fG fAn001 fG fA fAn001 fA fG mC fC mA fG mU fC fG fG fUn001 fA fA fG | 2549 | AGAGAAAGCCAGUCGGUAAG | SSnXSS nXSSSS SSSSS SnXSS |
| WV-19998 | fG fA fGn001 fA fA fAn001 fG fC mC fA mG fU mC fG fG fU fAn001 fA fG fU | 2550 | GAGAAAGCCAGUCGGUAAGU | SSnXSS nXSSSS SSSSS SnXSS |
| WV-19999 | fA fG fAn001 fA fA fGn001 fC fC mA fG mU fC mG fG fU fA fAn001 fG fU fU | 2551 | AGAAAGCCAGUCGGUAAGUU | SSnXSS nXSSSS SSSSS SnXSS |
| WV-20000 | fG fA fAn001 fA fG fCn001 fC fA mG fU mC fG mG fU fA fA fGn001 fU fU fC | 2552 | GAAAGCCAGUCGGUAAGUUC | SSnXSS nXSSSS SSSSS SnXSS |
| WV-20001 | fA fA fAn001 fG fC fCn001 fA fG mU fC mG fG mU fA fA fG fUn001 fU fC fU | 2553 | AAAGCCAGUCGGUAAGUUCU | SSnXSS nXSSSS SSSSS SnXSS |
| WV-20002 | fA fA fGn001 fC fC fAn001 fG fU mC fG mG fU mA fA fG fU fUn001 fC fU fG | 2554 | AAGCCAGUCGGUAAGUUCUG | SSnXSS nXSSSS SSSSS SnXSS |
| WV-20003 | fA fG fCn001 fC fA fGn001 fU fC mG fG mU fA mA fG fU fU fCn001 fU fG fU | 2555 | AGCCAGUCGGUAAGUUCUGU | SSnXSS nXSSSS SSSSS SnXSS |
| WV-20004 | fG fC fCn001 fA fG fUn001 fC fG mG fU mA fA mG fU fU fC fUn001 fG fU fC | 2556 | GCCAGUCGGUAAGUUCUGUC | SSnXSS nXSSSS SSSSS SnXSS |
| WV-20005 | fC fC fAn001 fG fU fCn001 fG fG mU fA mA fG mU fU fC fU fGn001 fU fC fC | 2557 | CCAGUCGGUAAGUUCUGUCC | SSnXSS nXSSSS SSSSS SnXSS |
| WV-20006 | fC fA fGn001 fU fC fGn001 fG fU mA fA mG fU mU fC fU fG fUn001 fC fC fA | 2558 | CAGUCGGUAAGUUCUGUCCA | SSnXSS nXSSSS SSSSS SnXSS |
| WV-20007 | fA fG fUn001 fC fG fGn001 fU fA mA fG mU fU mC fU fG fU fCn001 fC fA fA | 2559 | AGUCGGUAAGUUCUGUCCAA | SSnXSS nXSSSS SSSSS SnXSS |
| WV-20008 | fG fU fCn001 fG fG fUn001 fA fA mG fU mU fC mU fG fU fC fCn001 fA fA fG | 2560 | GUCGGUAAGUUCUGUCCAAG | SSnXSS nXSSSS SSSSS SnXSS |

TABLE A1-continued

| | | | | |
|---|---|---|---|---|
| WV-20009 | fU fC fGn001 fG fU fAn001 fA fG mU fU mC fU mG fU fC fC fAn001 fA fG fC | 2561 | UCGGUAAGUUCUGUCCAAGC | SSnXSS nXSSSS SSSSS SnXSS |
| WV-20010 | fC fG fGn001 fU fA fAn001 fG fU mU fC mU fG mU fC fC fA fAn001 fG fC fC | 2562 | CGGUAAGUUCUGUCCAAGCC | SSnXSS nXSSSS SSSSS SnXSS |
| WV-2001 | fG fG fUn001 fA fA fGn001 fU fU mC fU mG fU mC fC fA fA fGn001 fC fC fC | 2563 | GGUAAGUUCUGUCCAAGCCC | SSnXSS nXSSSS SSSSS SnXSS |
| WV-20012 | fG fU fAn001 fA fG fUn001 fU fC mU fG mU fC mC fA fA fG fCn001 fC fC fG | 2564 | GUAAGUUCUGUCCAAGCCCG | SSnXSS nXSSSS SSSSS SnXSS |
| WV-20013 | fG fA fAn001 fG fU fUn001 fC fU mG fU mC fC mA fA fG fC fCn001 fC fG fG | 2565 | UAAGUUCUGUCCAAGCCCGG | SSnXSS nXSSSS SSSSS SnXSS |
| WV-20014 | fA fA fGn001 fU fU fCn001 fU fG mU fC mC fA mA fG fC fC fCn001 fG fG fU | 2566 | AAGUUCUGUCCAAGCCCGGU | SSnXSS nXSSSS SSSSS SnXSS |
| WV-20015 | fA fG fUn001 fU fC fUn001 fG fU mC fC mA fA mG fC fC fC fGn001 fG fU fU | 2567 | AGUUCUGUCCAAGCCCGGUU | SSnXSS nXSSSS SSSSS SnXSS |
| WV-20016 | fG fU fUn001 fC fU fGn001 fU fC mC fA mA fG mC fC fC fG fGn001 fU fU fG | 2568 | GUUCUGUCCAAGCCCGGUUG | SSnXSS nXSSSS SSSSS SnXSS |
| WV-20017 | fU fU fCn001 fU fG fUn001 fC fC mA fA mG fC mC fC fG fG fUn001 fU fG fA | 2569 | UUCUGUCCAAGCCCGGUUGA | SSnXSS nXSSSS SSSSS SnXSS |
| WV-20018 | fU fC fUn001 fG fU fCn001 fC fA mA fG mC fC mC fG fG fU fUn001 fG fA fA | 2570 | UCUGUCCAAGCCCGGUUGAA | SSnXSS nXSSSS SSSSS SnXSS |
| WV-20019 | fC fU fGn001 fU fC fCn001 fA fA mG fC mC fC mG fU fU fU fGn001 fA fA fA | 2571 | CUGUCCAAGCCCGGUUGAAA | SSnXSS nXSSSS SSSSS SnXSS |
| WV-20020 | fU fG fUn001 fC fC fAn001 fA fG mC fC mC fG mG fU fU fG fAn001 fA fA fU | 2572 | UGUCCAAGCCCGGUUGAAAU | SSnXSS nXSSSS SSSSS SnXSS |
| WV-20021 | fG fU fCn001 fC fA fAn001 fG fC mC fC mG fG mU fU fG fA fAn001 fA fU fC | 2573 | GUCCAAGCCCGGUUGAAAUC | SSnXSS nXSSSS SSSSS SnXSS |
| WV-20022 | fU fC fCn001 fA fA fGn001 fC fC mC fG mG fU mU fG fA fA fAn001 fU fC fU | 2574 | UCCAAGCCCGGUUGAAAUCU | SSnXSS nXSSSS SSSSS SnXSS |
| WV-20023 | fC fC fAn001 fA fG fCn001 fC fC mG fG mU fU mG fA fA fA fUn001 fC fU fG | 2575 | CCAAGCCCGGUUGAAAUCUG | SSnXSS nXSSSS SSSSS SnXSS |
| WV-20024 | fC fA fAn001 fG fC fCn001 fC fG mG fU mU fG mA fA fA fU fCn001 fU fG fC | 2576 | CAAGCCCGGUUGAAAUCUGC | SSnXSS nXSSSS SSSSS SnXSS |
| WV-20025 | fA fA fGn001 fC fC fCn001 fG fG mU fU mG fA mA fA fU fC fUn001 fG fC fC | 2577 | AAGCCCGGUUGAAAUCUGCC | SSnXSS nXSSSS SSSSS SnXSS |

TABLE A1-continued

| | | | | |
|---|---|---|---|---|
| WV-20026 | fA fG fCn001 fC fC fGn001 fG fU mU fG mA fA mA fU fC fU fGn001 fC fC fA | 2578 | AGCCCGGUUGAAAUCUG CCA | SSnXSS nXSSSS SSSSS SnXSS |
| WV-20027 | fG fC fCn001 fC fG fGn001 fU fU mG fA mA fA mU fC fU fG fCn001 fC fA fG | 2579 | GCCCGGUUGAAAUCUGC CAG | SSnXSS nXSSSS SSSSS SnXSS |
| WV-20028 | fC fC fCn001 fG fG fUn001 fU fG mA fA mA fU mC fU fG fC fCn001 fA fG fA | 2580 | CCCGGUUGAAAUCUGCC AGA | SSnXSS nXSSSS SSSSS SnXSS |
| WV-20029 | fC fC fGn001 fG fU fUn001 fG fA mA fA mU fC mU fG fC fC fAn001 fG fA fG | 2581 | CCGGUUGAAAUCUGCCA GAG | SSnXSS nXSSSS SSSSS SnXSS |
| WV-20030 | fC fG fGn001 fU fU fGn001 fA fA mA fU mC fU mG fC fC fA fGn001 fA fG fC | 2582 | CGGUUGAAAUCUGCCAG AGC | SSnXSS nXSSSS SSSSS SnXSS |
| WV-20031 | fG fG fUn001 fU fG fAn001 fA fA mU fC mU fG mC fC fA fG fAn001 fG fC fA | 2583 | GGUUGAAAUCUGCCAGA GCA | SSnXSS nXSSSS SSSSS SnXSS |
| WV-20032 | fG fU fUn001 fG fA fAn001 fA fU mC fU mG fC mC fA fG fA fGn001 fC fA fG | 2584 | GUUGAAAUCUGCCAGAG CAG | SSnXSS nXSSSS SSSSS SnXSS |
| WV-20033 | fU fU fGn001 fA fA fAn001 fU fC mU fG mC fC mA fG fA fG fCn001 fA fG fG | 2585 | UUGAAAUCUGCCAGAGC AGG | SSnXSS nXSSSS SSSSS SnXSS |
| WV-20034 | fU fG fAn001 fA fA fUn001 fC fU mG fC mC fA mG fA fG fC fAn001 fG fG fU | 2586 | UGAAAUCUGCCAGAGCA GGU | SSnXSS nXSSSS SSSSS SnXSS |
| WV-20035 | fG fA fAn001 fA fU fCn001 fU fG mC fC mA fG mA fG fC fA fGn001 fG fU fA | 2587 | GAAAUCUGCCAGAGCAG GUA | SSnXSS nXSSSS SSSSS SnXSS |
| WV-20036 | fA fA fAn001 fU fC fUn001 fG fC mC fA mG fA mG fC fA fG fGn001 fU fA fC | 2588 | AAAUCUGCCAGAGCAGG UAC | SSnXSS nXSSSS SSSSS SnXSS |
| WV-20037 | fA fA fUn001 fC fU fGn001 fC fC mA fG mA fG mC fA fG fG fUn001 fA fC fC | 2589 | AAUCUGCCAGAGCAGGU ACC | SSnXSS nXSSSS SSSSS SnXSS |
| WV-20038 | fA fU fCn001 fU fG fCn001 fC fA mG fA mG fC mA fG fG fU fAn001 fC fC fU | 2590 | AUCUGCCAGAGCAGGUA CCU | SSnXSS nXSSSS SSSSS SnXSS |
| WV-20039 | fU fC fUn001 fG fC fCn001 fA fG mA fG mC fA mG fG fU fA fCn001 fC fU fC | 2591 | UCUGCCAGAGCAGGUAC CUC | SSnXSS nXSSSS SSSSS SnXSS |
| WV-20040 | fC fU fGn001 fC fC fAn001 fG fA mG fC mA fG mG fU fA fC fCn001 fU fC fC | 2592 | CUGCCAGAGCAGGUACC UCC | SSnXSS nXSSSS SSSSS SnXSS |
| WV-20041 | fU fG fCn001 fC fA fGn001 fA fG mC fA mG fG mU fA fC fC fUn001 fC fC fA | 2593 | UGCCAGAGCAGGUACCU CCA | SSnXSS nXSSSS SSSSS SnXSS |
| WV-20042 | fG fC fCn001 fA fG fAn001 fG fC mA fG mG fU mA fC fC fU fCn001 fC fA fA | 2594 | GCCAGAGCAGGUACCUC CAA | SSnXSS nXSSSS SSSSS SnXSS |
| WV-20043 | fC fC fAn001 fG fA fGn001 fC fA mG fG mU fA mC fC fU fC fCn001 fA fA fC | 2595 | CCAGAGCAGGUACCUCC AAC | SSnXSS nXSSSS SSSSS SnXSS |

TABLE A1-continued

| | | | | |
|---|---|---|---|---|
| WV-20044 | fC fA fGn001 fA fG fCn001 fA fG mG fU mA fC mC fU fC fC fAn001 fA fC fA | 2596 | CAGAGCAGGUACCUCCA ACA | SSnXSS nXSSSS SSSSS SnXSS |
| WV-20045 | fA fG fAn001 fG fC fAn001 fG fG mU fA mC fC mU fC fC fA fAn001 fC fA fU | 2597 | AGAGCAGGUACCUCCAA CAU | SSnXSS nXSSSS SSSSS SnXSS |
| WV-20046 | fG fA fGn001 fC fA fGn001 fG fU mA fC mC fU mC fC fA fA fCn001 fA fU fC | 2598 | GAGCAGGUACCUCCAAC AUC | SSnXSS nXSSSS SSSSS SnXSS |
| WV-20047 | fA fG fCn001 fA fG fGn001 fU fA mC fC mU fC mC fA fA fC fAn001 fU fC fA | 2599 | AGCAGGUACCUCCAACA UCA | SSnXSS nXSSSS SSSSS SnXSS |
| WV-20048 | fG fC fAn001 fG fG fUn001 fA fC mC fU mC fC mA fA fC fA fUn001 fC fA fA | 2600 | GCAGGUACCUCCAACAU CAA | SSnXSS nXSSSS SSSSS SnXSS |
| WV-20049 | fC fA fGn001 fG fU fAn001 fC fC mU fC mC fA mA fC fA fU fCn001 fA fA fG | 2601 | CAGGUACCUCCAACAUC AAG | SSnXSS nXSSSS SSSSS SnXSS |
| WV-20050 | fA fG fGn001 fU fA fCn001 fC fU mC fC mA fA mC fA fU fC fAn001 fA fG fG | 2602 | AGGUACCUCCAACAUCA AGG | SSnXSS nXSSSS SSSSS SnXSS |
| WV-20051 | fG fG fUn001 fA fC fCn001 fU fC mC fA mA fC mA fU fC fA fAn001 fG fG fA | 2603 | GGUACCUCCAACAUCAA GGA | SSnXSS nXSSSS SSSSS SnXSS |
| WV-20052 | fG fU fAn001 fC fC fUn001 fC fC mA fA mC fA mU fC fA fA fGn001 fG fA fA | 2604 | GUACCUCCAACAUCAAG GAA | SSnXSS nXSSSS SSSSS SnXSS |
| WV-20053 | fU fA fCn001 fC fU fCn001 fC fA mA fC mA fU mC fA fA fG fGn001 fA fA fG | 2605 | UACCUCCAACAUCAAGG AAG | SSnXSS nXSSSS SSSSS SnXSS |
| WV-20054 | fA fC fCn001 fU fC fCn001 fA fA mC fA mU fC mA fA fG fG fAn001 fA fG fA | 2606 | ACCUCCAACAUCAAGGA AGA | SSnXSS nXSSSS SSSSS SnXSS |
| WV-20055 | fC fC fUn001 fC fC fAn001 fA fC mA fU mC fA mA fG fG fA fAn001 fG fA fU | 2607 | CCUCCAACAUCAAGGAA GAU | SSnXSS nXSSSS SSSSS SnXSS |
| WV-20056 | fC fU fCn001 fC fA fAn001 fC fA mU fC mA fA mG fG fA fA fGn001 fA fU fG | 2608 | CUCCAACAUCAAGGAAG AUG | SSnXSS nXSSSS SSSSS SnXSS |
| WV-20057 | fU fC fCn001 fA fA fCn001 fA fU mC fA mA fG mG fA fA fG fAn001 fU fG fG | 2609 | UCCAACAUCAAGGAAGA UGG | SSnXSS nXSSSS SSSSS SnXSS |
| WV-20058 | fC fC fAn001 fA fC fAn001 fU fC mA fA mG fG mA fA fG fA fUn001 fG fG fC | 2610 | CCAACAUCAAGGAAGAU GGC | SSnXSS nXSSSS SSSSS SnXSS |
| WV-20059 | fC fA fAn001 fC fA fUn001 fC fA mA fG mG fA mA fG fA fU fGn001 fG fC fA | 2611 | CAACAUCAAGGAAGAUG GCA | SSnXSS nXSSSS SSSSS SnXSS |
| WV-20060 | fA fA fCn001 fA fU fCn001 fA fA mG fG mA fA mG fA fU fG fGn001 fC fA fU | 2612 | AACAUCAAGGAAGAUGG CAU | SSnXSS nXSSSS SSSSS SnXSS |
| WV-20061 | fA fC fAn001 fU fC fAn001 fA fG mG fA mA fG mA fU fG fG fCn001 fA fU fU | 2613 | ACAUCAAGGAAGAUGGC AUU | SSnXSS nXSSSS SSSSS SnXSS |

TABLE A1-continued

| | | | | |
|---|---|---|---|---|
| WV-20062 | fC fA fUn001 fC fA fAn001 fG fG mA fA mG fA mU fG fG fC fAn001 fU fU fU | 2614 | CAUCAAGGAAGAUGGCA UUU | SSnXSS nXSSSS SSSSS SnXSS |
| WV-20063 | fA fU fCn001 fA fA fGn001 fG fA mA fG mA fU mG fG fC fA fUn001 fU fU fC | 2615 | AUCAAGGAAGAUGGCAU UUC | SSnXSS nXSSSS SSSSS SnXSS |
| WV-20064 | fU fC fAn001 fA fG fGn001 fA fA mG fA mU fG mG fC fA fU fUn001 fU fC fU | 2616 | UCAAGGAAGAUGGCAUU UCU | SSnXSS nXSSSS SSSSS SnXSS |
| WV-20065 | fC fA fAn001 fG fG fAn001 fA fG mA fU mG fG mC fA fU fU fUn001 fC fU fA | 2617 | CAAGGAAGAUGGCAUUU CUA | SSnXSS nXSSSS SSSSS SnXSS |
| WV-20066 | fA fA fGn001 fG fA fAn001 fG fA mU fG mG fC mA fU fU fU fCn001 fU fA fG | 2618 | AAGGAAGAUGGCAUUUC UAG | SSnXSS nXSSSS SSSSS SnXSS |
| WV-20067 | fA fG fGn001 fA fA fGn001 fA fU mG fG mC fA mU fU fU fC fUn001 fA fG fU | 2619 | AGGAAGAUGGCAUUUCU AGU | SSnXSS nXSSSS SSSSS SnXSS |
| WV-20068 | fG fG fAn001 fA fG fAn001 fU fG mG fC mA fU mU fU fC fU fAn001 fG fU fU | 2620 | GGAAGAUGGCAUUUCUA GUU | SSnXSS nXSSSS SSSSS SnXSS |
| WV-20069 | fG fA fAn001 fG fA fUn001 fG fG mC fA mU fU mU fC fU fA fGn001 fU fU fU | 2621 | GAAGAUGGCAUUUCUAG UUU | SSnXSS nXSSSS SSSSS SnXSS |
| WV-20070 | fA fA fGn001 fA fU fGn001 fG fC mA fU mU fU mC fU fA fG fUn001 fU fU fG | 2622 | AAGAUGGCAUUUCUAGU UUG | SSnXSS nXSSSS SSSSS SnXSS |
| WV-20071 | fA fG fAn001 fU fG fGn001 fC fA mU fU mU fC mU fA fG fU fUn001 fU fG fG | 2623 | AGAUGGCAUUUCUAGUU UGG | SSnXSS nXSSSS SSSSS SnXSS |
| WV-20072 | fG fA fUn001 fG fG fCn001 fA fU mU fU mC fU mA fG fU fU fUn001 fG fG fA | 2624 | GAUGGCAUUUCUAGUUU GGA | SSnXSS nXSSSS SSSSS SnXSS |
| WV-20073 | fA fU fGn001 fG fC fAn001 fU fU mU fC mU fA mG fU fU fU fGn001 fG fA fG | 2625 | AUGGCAUUUCUAGUUUG GAG | SSnXSS nXSSSS SSSSS SnXSS |
| WV-20074 | fU fG fGn001 fC fA fUn001 fU fU mC fU mA fG mU fU fU fG fGn001 fA fG fA | 2626 | UGGCAUUUCUAGUUUGG AGA | SSnXSS nXSSSS SSSSS SnXSS |
| WV-20075 | fG fG fCn001 fA fU fUn001 fU fC mU fA mG fU mU fU fG fG fAn001 fG fA fU | 2627 | GGCAUUUCUAGUUUGGA GAU | SSnXSS nXSSSS SSSSS SnXSS |
| WV-20076 | fG fC fAn001 fU fU fUn001 fC fU mA fG mU fU mU fG fG fA fGn001 fA fU fG | 2628 | GCAUUUCUAGUUUGGAG AUG | SSnXSS nXSSSS SSSSS SnXSS |
| WV-20077 | fC fA fUn001 fU fU fCn001 fU fA mG fU mU fU mG fG fA fG fAn001 fU fG fG | 2629 | CAUUUCUAGUUUGGAGA UGG | SSnXSS nXSSSS SSSSS SnXSS |
| WV-20078 | fA fU fUn001 fU fC fUn001 fA fG mU fU mU fG mG fA fG fA fUn001 fG fG fC | 2630 | AUUUCUAGUUUGGAGAU GGC | SSnXSS nXSSSS SSSSS SnXSS |

TABLE A1-continued

| | | | | |
|---|---|---|---|---|
| WV-20079 | fU fU fUn001 fC fU fAn001 fG fU mU fU mG fG mA fG fA fU fGn001 fG fC fA | 2631 | UUUCUAGUUUGGAGAUGGCA | SSnXSS nXSSSS SSSSS SnXSS |
| WV-20080 | fU fU fCn001 fU fA fGn001 fU fU mU fG mG fA mG fA fU fG fGn001 fC fA fG | 2632 | UUCUAGUUUGGAGAUGGCAG | SSnXSS nXSSSS SSSSS SnXSS |
| WV-20081 | fU fC fUn001 fA fG fUn001 fU fU mG fG mA fG mA fU fG fG fCn001 fA fG fU | 2633 | UCUAGUUUGGAGAUGGCAGU | SSnXSS nXSSSS SSSSS SnXSS |
| WV-20082 | fC fU fAn001 fG fU fUn001 fU fG mG fA mG fA mU fG fG fC fAn001 fG fU fU | 2634 | CUAGUUUGGAGAUGGCAGUU | SSnXSS nXSSSS SSSSS SnXSS |
| WV-20083 | fU fA fGn001 fU fU fUn001 fG fG mA fG mA fU mG fG fC fA fGn001 fU fU fU | 2635 | UAGUUUGGAGAUGGCAGUUU | SSnXSS nXSSSS SSSSS SnXSS |
| WV-20084 | fA fG fUn001 fU fU fGn001 fG fA mG fA mU fG mG fC fA fG fUn001 fU fU fC | 2636 | AGUUUGGAGAUGGCAGUUUC | SSnXSS nXSSSS SSSSS SnXSS |
| WV-20085 | fG fU fUn001 fU fG fGn001 fA fG mA fU mG fG mC fA fG fU fUn001 fU fC fC | 2637 | GUUUGGAGAUGGCAGUUUCC | SSnXSS nXSSSS SSSSS SnXSS |
| WV-20086 | fU fU fUn001 fG fG fAn001 fG fA mU fG mG fC mA fG fU fU fUn001 fC fC fU | 2638 | UUUGGAGAUGGCAGUUUCCU | SSnXSS nXSSSS SSSSS SnXSS |
| WV-20087 | fU fU fGn001 fG fA fGn001 fA fU mG fG mC fA mG fU fU fU fCn001 fC fU fU | 2639 | UUGGAGAUGGCAGUUUCCUU | SSnXSS nXSSSS SSSSS SnXSS |
| WV-20088 | fU fG fGn001 fA fG fAn001 fU fG mG fC mA fG mU fU fU fC fCn001 fU fU fA | 2640 | UGGAGAUGGCAGUUUCCUUA | SSnXSS nXSSSS SSSSS SnXSS |
| WV-20089 | fG fG fAn001 fG fA fUn001 fG fG mC fA mG fU mU fU fC fC fUn001 fU fA fG | 2641 | GGAGAUGGCAGUUUCCUUAG | SSnXSS nXSSSS SSSSS SnXSS |
| WV-20090 | fG fA fGn001 fA fU fGn001 fG fC mA fG mU fU mU fC fC fU fUn001 fA fG fU | 2642 | GAGAUGGCAGUUUCCUUAGU | SSnXSS nXSSSS SSSSS SnXSS |
| WV-20091 | fA fG fAn001 fU fG fGn001 fC fA mG fU mU fU mC fC fU fU fAn001 fG fU fA | 2643 | AGAUGGCAGUUUCCUUAGUA | SSnXSS nXSSSS SSSSS SnXSS |
| WV-20092 | fG fA fUn001 fG fG fCn001 fA fG mU fU mU fC mC fU fU fA fGn001 fU fA fA | 2644 | GAUGGCAGUUUCCUUAGUAA | SSnXSS nXSSSS SSSSS SnXSS |
| WV-20093 | fA fU fGn001 fG fC fAn001 fG fU mU fU mC fC mU fU fA fG fUn001 fA fA fC | 2645 | AUGGCAGUUUCCUUAGUAAC | SSnXSS nXSSSS SSSSS SnXSS |
| WV-20094 | fU fG fGn001 fC fA fGn001 fU fU mU fC mC fU mU fA fG fU fAn001 fA fC fC | 2646 | UGGCAGUUUCCUUAGUAACC | SSnXSS nXSSSS SSSSS SnXSS |
| WV-20095 | fG fG fCn001 fA fG fUn001 fU fU mC fC mU fU mA fG fU fA fAn001 fC fC fA | 2647 | GGCAGUUUCCUUAGUAACCA | SSnXSS nXSSSS SSSSS SnXSS |
| WV-20096 | fG fC fAn001 fG fU fUn001 fU fC mC fU mU fA mG fU fA fA fCn001 fC fA fC | 2648 | GCAGUUUCCUUAGUAACCAC | SSnXSS nXSSSS SSSSS SnXSS |

TABLE A1-continued

| | | | | |
|---|---|---|---|---|
| WV-20097 | fC fA fGn001 fU fU fUn001 fC fC mU fU mA fG mU fA fA fC fCn001 fA fC fA | 2649 | CAGUUUCCUUAGUAACCACA | SSnXSS nXSSSS SSSSS SnXSS |
| WV-20098 | fA fG fUn001 fU fU fCn001 fC fU mU fA mG fU mA fA fC fC fAn001 fC fA fG | 2650 | AGUUUCCUUAGUAACCACAG | SSnXSS nXSSSS SSSSS SnXSS |
| WV-20099 | fG fU fUn001 fU fC fCn001 fU fU mA fG mU fA mA fC fC fA fCn001 fA fG fG | 2651 | GUUUCCUUAGUAACCACAGG | SSnXSS nXSSSS SSSSS SnXSS |
| WV-20100 | fU fU fUn001 fC fC fUn001 fU fA mG fU mA fA mC fC fA fC fAn001 fG fG fU | 2652 | UUUCCUUAGUAACCACAGGU | SSnXSS nXSSSS SSSSS SnXSS |
| WV-20101 | fU fU fCn001 fC fU fUn001 fA fG mU fA mA fC mC fA fC fA fGn001 fG fU fU | 2653 | UUCCUUAGUAACCACAGGUU | SSnXSS nXSSSS SSSSS SnXSS |
| WV-20102 | fU fC fCn001 fU fU fAn001 fG fU mA fA mC fC mA fC fA fG fGn001 fU fU fG | 2654 | UCCUUAGUAACCACAGGUUG | SSnXSS nXSSSS SSSSS SnXSS |
| WV-20103 | fC fC fUn001 fU fA fGn001 fU fA mA fC mC fA mC fA fG fG fUn001 fU fG fU | 2655 | CCUUAGUAACCACAGGUUGU | SSnXSS nXSSSS SSSSS SnXSS |
| WV-20104 | fC fU fUn001 fA fG fUn001 fA fA mC fC mA fC mA fG fG fU fUn001 fG fU fG | 2656 | CUUAGUAACCACAGGUUGUG | SSnXSS nXSSSS SSSSS SnXSS |
| WV-20105 | fU fU fAn001 fG fU fAn001 fA fC mC fA mC fA mG fG fU fU fGn001 fU fG fU | 2657 | UUAGUAACCACAGGUUGUGU | SSnXSS nXSSSS SSSSS SnXSS |
| WV-20106 | fU fA fGn001 fU fA fAn001 fC fC mA fC mA fG mG fU fU fG fUn001 fG fU fC | 2658 | UAGUAACCACAGGUUGUGUC | SSnXSS nXSSSS SSSSS SnXSS |
| WV-20107 | fA fG fUn001 fA fA fCn001 fC fA mC fA mG fG mU fU fG fU fGn001 fU fC fA | 2659 | AGUAACCACAGGUUGUGUCA | SSnXSS nXSSSS SSSSS SnXSS |
| WV-20108 | fG fU fAn001 fA fC fCn001 fA fC mA fG mG fU mU fG fU fG fUn001 fC fA fC | 2660 | GUAACCACAGGUUGUGUCAC | SSnXSS nXSSSS SSSSS SnXSS |
| WV-20109 | fU fA fAn001 fC fC fAn001 fC fA mG fG mU fU mG fU fG fU fCn001 fA fC fC | 2661 | UAACCACAGGUUGUGUCACC | SSnXSS nXSSSS SSSSS SnXSS |
| WV-20110 | fA fA fCn001 fC fA fCn001 fA fG mG fU mU fG mU fG fU fC fAn001 fC fC fA | 2662 | AACCACAGGUUGUGUCACCA | SSnXSS nXSSSS SSSSS SnXSS |
| WV-20111 | fA fC fCn001 fA fC fAn001 fG fG mU fU mG fU mG fU fC fA fCn001 fC fA fG | 2663 | ACCACAGGUUGUGUCACCAG | SSnXSS nXSSSS SSSSS SnXSS |
| WV-20112 | fC fC fAn001 fC fA fGn001 fG fU mU fG mU fG mU fC fA fC fCn001 fA fG fA | 2664 | CCACAGGUUGUGUCACCAGA | SSnXSS nXSSSS SSSSS SnXSS |
| WV-20113 | fC fA fCn001 fA fG fGn001 fU fU mG fU mG fU mC fA fC fC fAn001 fG fA fG | 2665 | CACAGGUUGUGUCACCAGAG | SSnXSS nXSSSS SSSSS SnXSS |
| WV-20114 | fA fC fAn001 fG fG fUn001 fU fG mU fG mU fC mA fC fC fA fGn001 fA fG fU | 2666 | ACAGGUUGUGUCACCAGAGU | SSnXSS nXSSSS SSSSS SnXSS |

TABLE A1-continued

| | | | | |
|---|---|---|---|---|
| WV-20115 | fC fA fGn001 fG fU fUn001 fG fU mG fU mC fA mC fC fA fG fAn001 fG fU fA | 2667 | CAGGUUGUGUCACCAGAGUA | SSnXSS nXSSSS SSSSS SnXSS |
| WV-20116 | fA fG fGn001 fU fU fGn001 fU fG mU fC mA fC mC fA fG fA fGn001 fU fA fA | 2668 | AGGUUGUGUCACCAGAGUAA | SSnXSS nXSSSS SSSSS SnXSS |
| WV-20117 | fG fG fUn001 fU fG fUn001 fG fU mC fA mC fC mA fG fA fG fUn001 fA fA fC | 2669 | GGUUGUGUCACCAGAGUAAC | SSnXSS nXSSSS SSSSS SnXSS |
| WV-20118 | fG fU fUn001 fG fU fUn001 fU fC mA fC mC fA mG fA fG fU fAn001 fA fC fA | 2670 | GUUGUGUCACCAGAGUAACA | SSnXSS nXSSSS SSSSS SnXSS |
| WV-20119 | fU fU fGn001 fU fG fUn001 fC fA mC fC mA fG mA fG fU fA fAn001 fC fA fG | 2671 | UUGUGUCACCAGAGUAACAG | SSnXSS nXSSSS SSSSS SnXSS |
| WV-20120 | fU fG fUn001 fG fU fCn001 fA fC mC fA mG fA mG fU fA fA fCn001 fA fG fU | 2672 | UGUGUCACCAGAGUAACAGU | SSnXSS nXSSSS SSSSS SnXSS |
| WV-20121 | fG fU fUn001 fU fC fAn001 fC fC mA fG mA fG mU fA fA fC fAn001 fG fU fC | 2673 | GUGUCACCAGAGUAACAGUC | SSnXSS nXSSSS SSSSS SnXSS |
| WV-20122 | fU fG fUn001 fC fA fCn001 fC fA mG fA mG fU mA fA fC fA fGn001 fU fC fU | 2674 | UGUCACCAGAGUAACAGUCU | SSnXSS nXSSSS SSSSS SnXSS |
| WV-20123 | fG fU fCn001 fA fC fCn001 fA fG mA fG mU fA mA fC fA fG fUn001 fC fU fG | 2675 | GUCACCAGAGUAACAGUCUG | SSnXSS nXSSSS SSSSS SnXSS |
| WV-20124 | fU fC fAn001 fC fC fAn001 fG fA mG fU mA fA mC fA fG fU fCn001 fU fG fA | 2676 | UCACCAGAGUAACAGUCUGA | SSnXSS nXSSSS SSSSS SnXSS |
| WV-20125 | fC fA fCn001 fC fA fGn001 fA fG mU fA mA fC mA fG fU fC fUn001 fG fA fG | 2677 | CACCAGAGUAACAGUCUGAG | SSnXSS nXSSSS SSSSS SnXSS |
| WV-20126 | fA fC fCn001 fA fG fAn001 fG fU mA fA mC fA mG fU fC fU fGn001 fA fG fU | 2678 | ACCAGAGUAACAGUCUGAGU | SSnXSS nXSSSS SSSSS SnXSS |
| WV-20127 | fC fC fAn001 fG fA fGn001 fU fA mA fC mA fG mU fC fU fG fAn001 fG fU fA | 2679 | CCAGAGUAACAGUCUGAGUA | SSnXSS nXSSSS SSSSS SnXSS |
| WV-20128 | fC fA fGn001 fA fG fUn001 fA fA mC fA mG fU mC fU fG fA fGn001 fU fA fG | 2680 | CAGAGUAACAGUCUGAGUAG | SSnXSS nXSSSS SSSSS SnXSS |
| WV-20129 | fA fG fAn001 fG fU fAn001 fA fC mA fG mU fC mU fG fA fG fUn001 fA fG fG | 2681 | AGAGUAACAGUCUGAGUAGG | SSnXSS nXSSSS SSSSS SnXSS |
| WV-20130 | fG fA fGn001 fU fA fAn001 fC fA mG fU mC fU mG fA fG fU fAn001 fG fG fA | 2682 | GAGUAACAGUCUGAGUAGGA | SSnXSS nXSSSS SSSSS SnXSS |
| WV-20131 | fA fG fUn001 fA fA fCn001 fA fG mU fC mU fG mA fG fU fA fGn001 fG fA fG | 2683 | AGUAACAGUCUGAGUAGGAG | SSnXSS nXSSSS SSSSS SnXSS |

TABLE A1-continued

| | | | | |
|---|---|---|---|---|
| WV-20132 | fG fU fAn001 fA fC fAn001 fG fU mC fU mG fA mG fU fA fG fGn001 fA fG fC | 2684 | GUAACAGUCUGAGUAGG AGC | SSnXSS nXSSSS SSSSS SnXSS |
| WV-20133 | fU fA fAn001 fC fA fGn001 fU fC mU fG mA fG mU fA fG fG fAn001 fG fC fU | 2685 | UAACAGUCUGAGUAGGA GCU | SSnXSS nXSSSS SSSSS SnXSS |
| WV-20134 | fA fA fCn001 fA fG fUn001 fC fU mG fA mG fU mA fG fG fA fGn001 fC fU fA | 2686 | AACAGUCUGAGUAGGAG CUA | SSnXSS nXSSSS SSSSS SnXSS |
| WV-20135 | fA fC fAn001 fG fU fCn001 fU fG mA fG mU fA mG fG fA fG fCn001 fU fA fA | 2687 | ACAGUCUGAGUAGGAGC UAA | SSnXSS nXSSSS SSSSS SnXSS |
| WV-20136 | fC fA fGn001 fU fC fUn001 fG fA mG fU mA fG mG fA fG fC fUn001 fA fA fA | 2688 | CAGUCUGAGUAGGAGCU AAA | SSnXSS nXSSSS SSSSS SnXSS |
| WV-20137 | fA fG fUn001 fC fG fGn001 fA fG mU fA mG fG mA fG fC fU fAn001 fA fA fA | 2689 | AGUCUGAGUAGGAGCUA AAA | SSnXSS nXSSSS SSSSS SnXSS |
| WV-20138 | fG fU fCn001 fU fG fAn001 fG fU mA fG mG fA mG fC fU fA fAn001 fA fA fU | 2690 | GUCUGAGUAGGAGCUAA AAU | SSnXSS nXSSSS SSSSS SnXSS |
| WV-20139 | fU fC fUn001 fG fA fGn001 fU fA mG fG mA fG mC fU fA fA fAn001 fA fU fA | 2691 | UCUGAGUAGGAGCUAAA AUA | SSnXSS nXSSSS SSSSS SnXSS |
| WV-20140 | fC fU fGn001 fA fG fUn001 fA fG mG fA mG fC mU fA fA fA fAn001 fU fA fU | 2692 | CUGAGUAGGAGCUAAAA UAU | SSnXSS nXSSSS SSSSS SnXSS |
| WV-20141 | fU fG fAn001 fG fU fAn001 fG fG mA fG mC fU mA fA fA fA fUn001 fA fU fU | 2693 | UGAGUAGGAGCUAAAAU AUU | SSnXSS nXSSSS SSSSS SnXSS |
| WV-20142 | fG fA fGn001 fU fA fGn001 fG fA mG fC mU fA mA fA fA fU fAn001 fU fU fU | 2694 | GAGUAGGAGCUAAAAUA UUU | SSnXSS nXSSSS SSSSS SnXSS |
| WV-20143 | fA fG fUn001 fA fG fGn001 fA fG mC fU mA fA mA fA fU fA fUn001 fU fU fU | 2695 | AGUAGGAGCUAAAAUAU UUU | SSnXSS nXSSSS SSSSS SnXSS |
| WV-20144 | fG fU fAn001 fG fG fAn001 fG fC mU fA mA fA mA fU fA fU fUn001 fU fU fG | 2696 | GUAGGAGCUAAAAUAUU UUG | SSnXSS nXSSSS SSSSS SnXSS |
| WV-20145 | fU fA fGn001 fG fA fGn001 fC fU mA fA mA fA mU fA fU fU fUn001 fU fG fG | 2697 | UAGGAGCUAAAAUAUUU UGG | SSnXSS nXSSSS SSSSS SnXSS |
| WV-20146 | fA fG fGn001 fA fG fCn001 fU fA mA fA mA fU mA fU fU fU fUn001 fG fG fG | 2698 | AGGAGCUAAAAUAUUUU GGG | SSnXSS nXSSSS SSSSS SnXSS |
| WV-20147 | fG fG fAn001 fG fC fUn001 fA fA mA fA mU fA mU fU fU fU fGn001 fG fG fU | 2699 | GGAGCUAAAAUAUUUUG GGU | SSnXSS nXSSSS SSSSS SnXSS |
| WV-20148 | fG fA fGn001 fC fU fAn001 fA fA mA fU mA fU mU fU fU fG fGn001 fG fU fU | 2700 | GAGCUAAAAUAUUUUGG GUU | SSnXSS nXSSSS SSSSS SnXSS |
| WV-20149 | fA fG fCn001 fU fA fAn001 fA fA mU fA mU fU mU fU fG fG fGn001 fU fU fU | 2701 | AGCUAAAAUAUUUUGGG UUU | SSnXSS nXSSSS SSSSS SnXSS |

TABLE A1-continued

| | | | | |
|---|---|---|---|---|
| WV-20150 | fG fC fUn001 fA fA fAn001 fA fU mA fU mU fU mU fG fG fG fUn001 fU fU fU | 2702 | GCUAAAAUAUUUUGGGUUUU | SSnXSS nXSSSS SSSSS SnXSS |
| WV-20151 | fC fU fAn001 fA fA fAn001 fU fA mU fU mU fU mG fG fG fU fUn001 fU fU fU | 2703 | CUAAAAUAUUUUGGGUUUUU | SSnXSS nXSSSS SSSSS SnXSS |
| WV-20152 | fU fA fAn001 fA fA fUn001 fA fU mU fU mU fG mG fG fU fU fUn001 fU fU fG | 2704 | UAAAAUAUUUUGGGUUUUUG | SSnXSS nXSSSS SSSSS SnXSS |
| WV-20153 | fA fA fAn001 fA fU fAn001 fU fU mU fU mG fG mG fU fU fU fUn001 fU fG fC | 2705 | AAAAUAUUUUGGGUUUUUGC | SSnXSS nXSSSS SSSSS SnXSS |
| WV-20154 | fA fA fAn001 fU fA fUn001 fU fU mU fG mG fG mU fU fU fU fUn001 fG fC fA | 2706 | AAAUAUUUUGGGUUUUUGCA | SSnXSS nXSSSS SSSSS SnXSS |
| WV-20155 | fA fA fUn001 fA fU fUn001 fU fU mG fG mG fU mU fU fU fU fGn001 fC fA fA | 2707 | AAUAUUUUGGGUUUUUGCAA | SSnXSS nXSSSS SSSSS SnXSS |
| WV-20156 | fA fU fAn001 fU fU fUn001 fU fG mG fG mU fU mU fU fU fG fCn001 fA fA fA | 2708 | AUAUUUUGGGUUUUUGCAAA | SSnXSS nXSSSS SSSSS SnXSS |
| WV-20157 | fU fA fUn001 fU fU fUn001 fG fG mG fU mU fU mU fU fG fC fAn001 fA fA fA | 2709 | UAUUUUGGGUUUUUGCAAAA | SSnXSS nXSSSS SSSSS SnXSS |
| WV-20158 | fA fU fUn001 fU fU fGn001 fG fG mU fU mU fU mU fG fC fA fAn001 fA fA fA | 2710 | AUUUUGGGUUUUUGCAAAAA | SSnXSS nXSSSS SSSSS SnXSS |
| WV-20159 | fU fU fUn001 fU fG fGn001 fG fU mU fU mU fU mG fC fA fA fAn001 fA fA fG | 2711 | UUUUGGGUUUUUGCAAAAAG | SSnXSS nXSSSS SSSSS SnXSS |
| WV-20160 | fU fU fUn001 fG fG fGn001 fU fU mU fU mU fG mC fA fA fA fAn001 fA fG fG | 2712 | UUUGGGUUUUUGCAAAAAGG | SSnXSS nXSSSS SSSSS SnXSS |
| WV-20314 | fU fU fC fG fA fA fA fA mA fA mC fA mA fA fU fC fA fA fA fG | 2713 | UUCGAAAAAACAAAUCAAAG | SSSSS SSSSS SSSSS SSSS |
| WV-20315 | fU fC fG fA fA fA fA fA mA fC mA fA mA fU fC fA fA fA fG fA | 2714 | UCGAAAAAACAAAUCAAAGA | SSSSS SSSSS SSSSS SSSS |
| WV-20316 | fC fG fA fA fA fA fA fA mC fA mA fA mU fC fA fA fA fG fA fC | 2715 | CGAAAAAACAAAUCAAAGAC | SSSSS SSSSS SSSSS SSSS |
| WV-20317 | fG fA fA fA fA fA fA fC mA fA mA fU mC fA fA fA fG fA fC fU | 2716 | GAAAAAACAAAUCAAAGACU | SSSSS SSSSS SSSSS SSSS |
| WV-20318 | fA fA fA fA fA fA fC fA mA fA mU fC mA fA fA fG fA fC fU fU | 2717 | AAAAAACAAAUCAAAGACUU | SSSSS SSSSS SSSSS SSSS |
| WV-20319 | fA fA fA fA fA fC fA fA mA fU mC fA mA fA fG fA fC fU fU fA | 2718 | AAAAACAAAUCAAAGACUUA | SSSSS SSSSS SSSSS SSSS |
| WV-20320 | fA fA fA fA fC fA fA fA mU fC mA fA mA fG fA fC fU fU fA fC | 2719 | AAAACAAAUCAAAGACUUAC | SSSSS SSSSS SSSSS SSSS |

TABLE A1-continued

| | | | | |
|---|---|---|---|---|
| WV-20321 | fA fA fA fC fA fA fA fU mC fA mA fA mG fA fC fU fU fA fC fC | 2720 | AAACAAAUCAAAGACUUACC | SSSSS SSSSS SSSSS SSSS |
| WV-20322 | fA fA fC fA fA fA fU fC mA fA mA fG mA fC fU fU fA fC fC fU | 2721 | AACAAAUCAAAGACUUACCU | SSSSS SSSSS SSSSS SSSS |
| WV-20323 | fA fC fA fA fA fU fC fA mA fA mG fA mC fU fU fA fC fC fU fU | 2722 | ACAAAUCAAAGACUUACCUU | SSSSS SSSSS SSSSS SSSS |
| WV-20324 | fC fA fA fA fU fC fA fA mA fG mA fC mU fU fA fC fC fU fU fA | 2723 | CAAAUCAAAGACUUACCUUA | SSSSS SSSSS SSSSS SSSS |
| WV-20325 | fA fA fA fU fC fA fA fA mG fA mC fU mU fA fC fC fU fU fA fA | 2724 | AAAUCAAAGACUUACCUUAA | SSSSS SSSSS SSSSS SSSS |
| WV-20326 | fA fA fU fC fA fA fA fG mA fC mU fU mA fC fC fU fU fA fA fG | 2725 | AAUCAAAGACUUACCUUAAG | SSSSS SSSSS SSSSS SSSS |
| WV-20327 | fA fU fC fA fA fA fG fA mC fU mU fA mC fC fU fU fA fA fG fA | 2726 | AUCAAAGACUUACCUUAAGA | SSSSS SSSSS SSSSS SSSS |
| WV-20328 | fU fC fA fA fA fG fA fC mU fU mA fC mC fU fU fA fA fG fA fU | 2727 | UCAAAGACUUACCUUAAGAU | SSSSS SSSSS SSSSS SSSS |
| WV-20329 | fC fA fA fA fG fA fC fU mU fA mC fC mU fU fA fA fG fA fU fA | 2728 | CAAAGACUUACCUUAAGAUA | SSSSS SSSSS SSSSS SSSS |
| WV-20330 | fA fA fA fG fA fC fU fU mA fC mC fU mU fA fA fG fA fU fA fC | 2729 | AAAGACUUACCUUAAGAUAC | SSSSS SSSSS SSSSS SSSS |
| WV-20331 | fA fA fG fA fC fU fU fA mC fC mU fU mA fA fG fA fU fA fC fC | 2730 | AAGACUUACCUUAAGAUACC | SSSSS SSSSS SSSSS SSSS |
| WV-20332 | fA fG fA fC fU fU fA fC mC fU mU fA mA fG fA fU fA fC fC fA | 2731 | AGACUUACCUUAAGAUACCA | SSSSS SSSSS SSSSS SSSS |
| WV-20333 | fG fA fC fU fU fA fC fC mU fU mA fA mG fA fU fA fC fC fA fU | 2732 | GACUUACCUUAAGAUACCAU | SSSSS SSSSS SSSSS SSSS |
| WV-20334 | fA fC fU fU fA fC fC fU mU fA mA fG mA fU fA fC fC fA fU fU | 2733 | ACUUACCUUAAGAUACCAUU | SSSSS SSSSS SSSSS SSSS |
| WV-20335 | fC fU fU fA fC fC fU fU mA fA mG fA mU fA fC fC fA fU fU fU | 2734 | CUUACCUUAAGAUACCAUUU | SSSSS SSSSS SSSSS SSSS |
| WV-20336 | fU fU fA fC fC fU fU fA mA fG mA fU mA fC fC fA fU fU fU fG | 2735 | UUACCUUAAGAUACCAUUUG | SSSSS SSSSS SSSSS SSSS |
| WV-20337 | fU fA fC fC fU fU fA fA mG fA mU fA mC fC fA fU fU fU fG fU | 2736 | UACCUUAAGAUACCAUUUGU | SSSSS SSSSS SSSSS SSSS |

TABLE A1-continued

| | | | | |
|---|---|---|---|---|
| WV-20338 | fA fG fG fC fA fA fA fA mC fA mA fA mA fA fU fG fA fA fG fC | 2737 | AGGCAAAACAAAAAUGAAGC | SSSSS SSSSS SSSSS SSSS |
| WV-20339 | fG fC fA fA fA fA fC fA mA fA mA fA mU fG fA fA fG fC fC fC | 2738 | GCAAAACAAAAAUGAAGCCC | SSSSS SSSSS SSSSS SSSS |
| WV-20340 | fA fA fA fA fC fA fA fA mA fA mU fG mA fA fG fC fC fC fC fA | 2739 | AAAACAAAAAUGAAGCCCCA | SSSSS SSSSS SSSSS SSSS |
| WV-20341 | fA fA fC fA fA fA fA fA mU fG mA fA mG fC fC fC fC fA fU fG | 2740 | AACAAAAAUGAAGCCCCAUG | SSSSS SSSSS SSSSS SSSS |
| WV-20342 | fC fA fA fA fA fA fU fG mA fA mG fC mC fC fC fA fU fG fU fC | 2741 | CAAAAAUGAAGCCCCAUGUC | SSSSS SSSSS SSSSS SSSS |
| WV-20343 | fA fA fA fA fU fG fA fA mG fC mC fC mC fA fU fG fU fC fU fU | 2742 | AAAAUGAAGCCCCAUGUCUU | SSSSS SSSSS SSSSS SSSS |
| WV-20344 | fA fA fU fG fA fA fG fC mC fC mC fA mU fG fU fC fU fU fU fU | 2743 | AAUGAAGCCCCAUGUCUUUU | SSSSS SSSSS SSSSS SSSS |
| WV-20345 | fA fU fG fA fA fG fC fC mC fC mA fU mG fU fC fU fU fU fU fU | 2744 | AUGAAGCCCCAUGUCUUUUU | SSSSS SSSSS SSSSS SSSS |
| WV-20346 | fG fA fA fG fC fC fC fC mA fU mG fU mC fU fU fU fU fU fA fU | 2745 | GAAGCCCCAUGUCUUUUUAU | SSSSS SSSSS SSSSS SSSS |
| WV-20347 | fA fG fC fC fC fC fA fU mG fU mC fU mU fU fU fU fA fU fU fU | 2746 | AGCCCCAUGUCUUUUUAUUU | SSSSS SSSSS SSSSS SSSS |
| WV-20348 | fC fC fC fC fA fU fG fU mC fU mU fU mU fU fA fU fU fU fG fA | 2747 | CCCCAUGUCUUUUUAUUUGA | SSSSS SSSSS SSSSS SSSS |
| WV-20349 | fU fG fA fA fG fC fC fC mC fA mU fG mU fC fU fU fU fU fU fA | 2748 | UGAAGCCCCAUGUCUUUUUA | SSSSS SSSSS SSSSS SSSS |
| WV-20350 | fA fA fG fC fC fC fC fA mU fG mU fC mU fU fU fU fU fA fU fU | 2749 | AAGCCCCAUGUCUUUUUAUU | SSSSS SSSSS SSSSS SSSS |
| WV-20351 | fG fC fC fC fC fA fU fG mU fC mU fU mU fU fU fA fU fU fU fG | 2750 | GCCCCAUGUCUUUUUAUUUG | SSSSS SSSSS SSSSS SSSS |
| WV-20352 | fC fU fG fC fA fU mA mU mU mC mA mA mA mG fG fA fC fA fC fC | 2751 | CUGCAUAUUCAAAGGACACC | SSSSS SSSSS SSSSS SSSS |
| WV-20353 | fC fU fG fC fA fU mU mG mU mU mU mU mG mG fC fC fU fC fU fG | 2752 | CUGCAUUGUUUUGGCCUCUG | SSSSS SSSSS SSSSS SSSS |
| WV-20354 | fA fU fA fA fA fG mC mC mG mA mA mA mU mA fC fA fC fA fC fU | 2753 | AUAAAGCCGAAAUACACACU | SSSSS SSSSS SSSSS SSSS |
| WV-20355 | fG fC fU fG fU fU mA mC mG mA mU mG mC mU fU fC fC fC fU fC | 2754 | GCUGUUACGAUGCUUCCCUC | SSSSS SSSSS SSSSS SSSS |

TABLE A1-continued

| | | | | |
|---|---|---|---|---|
| WV-20356 | fC fU fU fC fC fC mU mC mU mG mU mC mA mC fA fG fA fU fU fC | 2755 | CUUCCCUCUGUCACAGAUUC | SSSSS SSSSS SSSSS SSSS |
| WV-20357 | fC fA fG fA fU fA mA mA mC mC mA mG mC mU fC fC fG fU fC fC | 2756 | CAGAUAAACCAGCUCCGUCC | SSSSS SSSSS SSSSS SSSS |
| WV-20358 | fC fU fC fC fG fU mC mC mA mG mG mC mA mA fA fC fU fC fU fC | 2757 | CUCCGUCCAGGCAAACUCUC | SSSSS SSSSS SSSSS SSSS |
| WV-20359 | fG fG fC fA fA fA mC mU mC mU mC mU mC mA fU fC fC fU fG fA | 2758 | GGCAAACUCUCUCAUCCUGA | SSSSS SSSSS SSSSS SSSS |
| WV-20360 | fC fU fC fU fC fU mC mA mU mC mC mU mG mA fC fA fC fA fA fA | 2759 | CUCUCUCAUCCUGACACAAA | SSSSS SSSSS SSSSS SSSS |
| WV-20361 | fC fA fA fA fC fU mC mU mC mU mC mA mU mC fC fU fG fA fC fA | 2760 | CAAACUCUCUCAUCCUGACA | SSSSS SSSSS SSSSS SSSS |
| WV-20362 | fG fC fU fC fU fA mA mU mA mU mU mA mU mC fA fU fU fA fU fG | 2761 | GCUCUAAUAUUAUCAUUAUG | SSSSS SSSSS SSSSS SSSS |
| WV-20363 | fA fU fA fG fC fA mC mC mG mU mG mC mU mC fU fA fA fU fA fU | 2762 | AUAGCACCGUGCUCUAAUAU | SSSSS SSSSS SSSSS SSSS |
| WV-20364 | fC fC fG fU fG fC mU mC mU mA mA mU mA mU fU fA fU fC fA fU | 2763 | CCGUGCUCUAAUAUUAUCAU | SSSSS SSSSS SSSSS SSSS |
| WV-20365 | fU fA fU fG fA fU mA mA mU mU mU mU mC mU fU fU fC fU fA fG | 2764 | UAUGAUAAUUUUCUUUCUAG | SSSSS SSSSS SSSSS SSSS |
| WV-20366 | fC fU fU fU fC fU mA mG mU mA mA mU mA mU fA fA fU fG fA fU | 2765 | CUUUCUAGUAAUAUAAUGAU | SSSSS SSSSS SSSSS SSSS |
| WV-20367 | fU fA fA fU fU fU mU mC mU mU mU mC mU mA fG fU fA fA fU fA | 2766 | UAAUUUUCUUUCUAGUAAUA | SSSSS SSSSS SSSSS SSSS |
| WV-20368 | fA fC fA fA fC fA mA mC mA mG mU mC mA mA fA fA fG fU fA fA | 2767 | ACAACAACAGUCAAAGUAA | SSSSS SSSSS SSSSS SSSS |
| WV-20369 | fA fA fU fA fU fA mA mU mG mA mU mG mA mC fA fA fC fA fA fC | 2768 | AAUAUAAUGAUGACAACAAC | SSSSS SSSSS SSSSS SSSS |
| WV-20370 | fU fG fA fU fG fA mC mA mA mC mA mA mC mA fG fU fC fA fA fA | 2769 | UGAUGACAACAACAGUCAAA | SSSSS SSSSS SSSSS SSSS |
| WV-20371 | fU fA fA fU fU fU mC mC mA mU mC mA mC mC fC fU fU fC fA fG | 2770 | UAAUUUCCAUCACCCUUCAG | SSSSS SSSSS SSSSS SSSS |
| WV-20372 | fC fA fC fC fC fU mU mC mA mG mA mA mC mC fU fG fA fU fC fU | 2771 | CACCCUUCAGAACCUGAUCU | SSSSS SSSSS SSSSS SSSS |
| WV-20373 | fU fC fC fA fU fC mA mC mC mC mU mU mC mA fG fA fA fC fC fU | 2772 | UCCAUCACCCUUCAGAACCU | SSSSS SSSSS SSSSS SSSS |

TABLE A1-continued

| | | | | |
|---|---|---|---|---|
| WV-20374 | fA fC fC fU fG fA mU mC mU mU mU mA mA mG fA fA fG fU fU fA | 2773 | ACCUGAUCUUUAAGAAGUUA | SSSSS SSSSS SSSSS SSSS |
| WV-20375 | fC fA fC fC fC fU mU mC mA mG mA mA mC mC fU fG fA fU fC | 2774 | CACCCUUCAGAACCUGAUC | SSSSS SSSSS SSSSS SSS |
| WV-20376 | fC fA fG fA fA fC mC mU mG mA mU mC mU mU fU fA fA fG fA fA | 2775 | CAGAACCUGAUCUUUAAGAA | SSSSS SSSSS SSSSS SSSS |
| WV-20377 | fA fG fA fG fU fC mC mA mG mA mU mG mU mG fC fU fG fA fA | 2776 | AGAGUCCAGAUGUGCUGAA | SSSSS SSSSS SSSSS SSS |
| WV-20378 | fC fU fG fA fA fG mA mU mA mA mA mU mA mC fA fA fU fu fU fC | 2777 | CUGAAGAUAAAUACAAUUUC | SSSSS SSSSS SSSSS SSSS |
| WV-20379 | fU fG fU fG fC fU mG mA mA mG mA mU mA mA fA fU fA fC fA fA | 2778 | UGUGCUGAAGAUAAAUACAA | SSSSS SSSSS SSSSS SSSS |
| WV-20380 | fA fC fA fA fU fU mU mC mG mA mA mA mA mA fA fC fA fA fA | 2779 | ACAAUUUCGAAAAAACAAA | SSSSS SSSSS SSSSS SSS |
| WV-20381 | fC fU fG fA fA fG mA mU mA mA mA mU mA mC fA fA fU fU fU | 2780 | CUGAAGAUAAAUACAAUUU | SSSSS SSSSS SSSSS SSS |
| WV-20382 | fU fA fA fA fU fA mC mA mA mU mU mU mC mG fA fA fA fA fA | 2781 | UAAAUACAAUUUCGAAAAA | SSSSS SSSSS SSSSS SSS |
| WV-20383 | fA fC fU fU fA fC mC mU mU mA mA mG mA mU fA fC fC fA fU fU | 2782 | ACUUACCUUAAGAUACCAUU | SSSSS SSSSS SSSSS SSSS |
| WV-20384 | fA fA fU fC fA fA mA mG mA mC mU mU mA mC fC fU fU fA fA fG | 2783 | AAUCAAAGACUUACCUUAAG | SSSSS SSSSS SSSSS SSSS |
| WV-20385 | fA fA fG fA fC fU mU mA mC mC mU mU mA mA fG fA fU fA fC fC | 2784 | AAGACUUACCUUAAGAUACC | SSSSS SSSSS SSSSS SSSS |
| WV-20386 | fA fU fU fC fU fC mA mG mG mA mA mU mU mU fG fU fG fU fC fU | 2785 | AUUCUCAGGAAUUUGUGUCU | SSSSS SSSSS SSSSS SSSS |
| WV-20387 | fC fA fU fG fU fU mC mC mC mA mA mU mU mC fU fC fA fG fG | 2786 | CAUGUUCCCAAUUCUCAGG | SSSSS SSSSS SSSSS SSS |
| WV-20388 | fC fC fC fA fA fU mU mC mU mC mA mG mG mA fA fU fU fU fG | 2787 | CCCAAUUCUCAGGAAUUUG | SSSSS SSSSS SSSSS SSS |
| WV-20389 | fC fU fU fU fC fU mG mA mG mA mA mA mC mU fG fU fU fC fA fG | 2788 | CUUUCUGAGAAACUGUUCAG | SSSSS SSSSS SSSSS SSSS |
| WV-20390 | fA fG fG fA fA fU mU mU mG mU mG mU mC mU fU fU fC fU fG fA | 2789 | AGGAAUUUGUGUCUUUCUGA | SSSSS SSSSS SSSSS SSSS |

TABLE A1-continued

| | | | | |
|---|---|---|---|---|
| WV-20391 | fU fG fU fG fU fC mU mU mU mC mU mG mA mG fA fA fA fC fU fG | 2790 | UGUGUCUUUCUGAGAAACUG | SSSSS SSSSS SSSSS SSSS |
| WV-20392 | fC fU fU fU fA fU mA mU mC mA mU mA mA mU fG fA fA fA fA fC | 2791 | CUUUAUAUCAUAAUGAAAAC | SSSSS SSSSS SSSSS SSSS |
| WV-20393 | fC fA fC fU fG fA mU mU mA mA mA mU mA mU fC fU fU fU fA fU | 2792 | CACUGAUUAAAUAUCUUUAU | SSSSS SSSSS SSSSS SSSS |
| WV-20789 | L001 fU fC fA fA fG fG mA fA mG fA mU fG mG fC fA fU fU fU fC fU | 2793 | UCAAGGAAGAUGGCAUUUCU | ORRRR RRORO ROROR RRRRR |
| WV-20790 | Mod012L001 fU fC fA fA fG fG mA fA mG fA mU fG mG fC fA fU fU fU fC fU | 2794 | UCAAGGAAGAUGGCAUUUCU | ORRRR RRORO ROROR RRRRR |
| WV-21210 | Mod118L001 fU fC fA fC fU fC mAn001 fG fA mU fA mGn001 mUn001 fU fG fA fA fG fC fC | 2795 | UCACUCAGAUAGUUGAAGCC | OSSSS SSnXSS SSnXnXS SSSSS |
| WV-21211 | Mod119L001 fU fC fA fC fU fC mAn001 fG fA mU fA mGn001 mUn001 fU fG fA fA fG fC fC | 2796 | UCACUCAGAUAGUUGAAGCC | OSSSS SSnXSS SSnXnXS SSSSS |
| WV-21212 | Mod120L001 fU fC fA fC fU fC mAn001 fG fA mU fA mGn001 mUn001 fU fG fA fA fG fC fC | 2797 | UCACUCAGAUAGUUGAAGCC | OSSSS SSnXSS SSnXnXS SSSSS |
| WV-21217 | fC fU fCn001 R fC fG fGn001 R fU fU mC | | CUCCGGUUC | SSnRSS nRSS |
| WV-21218 | fU fC fAn001 R fC fU fCn001 R mA fG fA mU fA mG mU fU fG fA fAn001 R fG fC fC | 2798 | UCACUCAGAUAGUUGAAGCC | SSnRSS nROSSS SOSSS SnRSS |
| WV-21245 | fU fC fAn001 R fC fU fCn001 R mA fG fA mU fA mG mU fU fG fA fAn001 R fG fC fC | 2799 | UCACUCAGAUAGUUGAAGCC | SSnRSS nROSSS SSOSS SnRSS |
| WV-21257 | fC fG fGn001 R fU fU mC fU mG fA mA fG fG fU fGn001 R fU fU fC | 2800 | CGGUUCUGAAGGUGUUC | SSnRSS OSSSO SSSnRS S |
| WV-24310 | fU * SfC * SfA * SfA * SfG * SfG * SmAfA * SmGmA * SfU * SmGmGfC * SfA * SfU * SfU * SfU * SfC * SmG | 2801 | UCAAGGAAGAUGGCAUUUCG | SSSSSSOSOSSOOSSSSSS |
| WV-24311 | fU * SfC * SfA * SfA * SfG * SfG * SmAfA * SmGmA * SfU * SmGmGfC * SfA * SfC * SfC * SfC * SfC * SfG | 2802 | UCAAGGAAGAUGGCACCCCG | SSSSSSOSOSSOOSSSSSS |
| WV-24463 | fU * SfC * SfG * SfA * SfG * SfA * SmAfA * SmGmA * SfU * SmGmGfC * SfA * SfU * SfU * SfU * SfC * SfU | 2803 | UCGAGAAAGAUGGCAUUUCU | SSSSSSOSOSSOOSSSSSS |
| WV-24464 | fU * SfU * SfA * SfA * SfG * SfG * SmAfA * SmGmA * SfU * SmGmGfC * SfA * SfU * SfU * SfC * SfC * SfU | 2804 | UUAAGGAAGAUGGCAUUCCU | SSSSSSOSOSSOOSSSSSS |

TABLE A1-continued

| | | | | |
|---|---|---|---|---|
| WV-25439 | fU * RfC * SfC * SfG * SfG * SfU * SfU * SmCfU * SmG * SfA * SmAmGfG * SfU * SfG * SfU * SfU * SfC * SfU | 2805 | UCCGGUUCUGAAGGUGUUCU | RSSSSSSOSSSOOSSSSSS |
| WV-25440 | fU * SfC * RfC * SfG * SfG * SfU * SfU * SmCfU * SmG * SfA * SmAmGfG * SfU * SfG * SfU * SfU * SfC * SfU | 2806 | UCCGGUUCUGAAGGUGUUCU | SRSSSSSOSSSOOSSSSSS |
| WV-25441 | fU * SfC * SfC * RfG * SfG * SfU * SfU * SmCfU * SmG * SfA * SmAmGfG * SfU * SfG * SfU * SfU * SfC * SfU | 2807 | UCCGGUUCUGAAGGUGUUCU | SSRSSSSOSSSOOSSSSSS |
| WV-25442 | fU * SfC * SfC * SfG * RfG * SfU * SfU * SmCfU * SmG * SfA * SmAmGfG * SfU * SfG * SfU * SfU * SfC * SfU | 2808 | UCCGGUUCUGAAGGUGUUCU | SSSRSSSOSSSOOSSSSSS |
| WV-25443 | fU * SfC * SfC * SfG * SfG * RfU * SfU * SmCfU * SmG * SfA * SmAmGfG * SfU * SfG * SfU * SfU * SfC * SfU | 2809 | UCCGGUUCUGAAGGUGUUCU | SSSSRSSOSSSOOSSSSSS |
| WV-25444 | fU * SfC * SfC * SfG * SfG * SfU * RfU * SmCfU * SmG * SfA * SmAmGfG * SfU * SfG * SfU * SfU * SfC * SfU | 2810 | UCCGGUUCUGAAGGUGUUCU | SSSSSRSOSSSOOSSSSSS |
| WV-25445 | fU * SfC * SfC * SfG * SfG * SfU * SfU * RmCfU * SmG * SfA * SmAmGfG * SfU * SfG * SfU * SfU * SfC * SfU | 2811 | UCCGGUUCUGAAGGUGUUCU | SSSSSSROSSSOOSSSSSS |
| WV-25446 | fU * SfC * SfC * SfG * SfG * SfU * SfU * SmCfU * RmG * SfA * SmAmGfG * SfU * SfG * SfU * SfU * SfC * SfU | 2812 | UCCGGUUCUGAAGGUGUUCU | SSSSSSSORSSOOSSSSSS |
| WV-25447 | fU * SfC * SfC * SfG * SfG * SfU * SfU * SmCfU * SmG * RfA * SmAmGfG * SfU * SfG * SfU * SfU * SfC * SfU | 2813 | UCCGGUUCUGAAGGUGUUCU | SSSSSSSOSRSOOSSSSSS |
| WV-25448 | fU * SfC * SfC * SfG * SfG * SfU * SfU * SmCfU * SmG * SfA * RmAmGfG * SfU * SfG * SfU * SfU * SfC * SfU | 2814 | UCCGGUUCUGAAGGUGUUCU | SSSSSSSOSSROOSSSSSS |
| WV-25449 | fU * SfC * SfC * SfG * SfG * SfU * SfU * SmCfU * SmG * SfA * SmAmGfG * RfU * SfG * SfU * SfU * SfC * SfU | 2815 | UCCGGUUCUGAAGGUGUUCU | SSSSSSSOSSSOORSSSSS |
| WV-25450 | fU * SfC * SfC * SfG * SfG * SfU * SfU * SmCfU * SmG * SfA * SmAmGfG * SfU * RfG * SfU * SfU * SfC * SfU | 2816 | UCCGGUUCUGAAGGUGUUCU | SSSSSSSOSSSOOSRSSSS |
| WV-25451 | fU * SfC * SfC * SfG * SfG * SfU * SfU * SmCfU * SmG * SfA * SmAmGfG * SfU * SfG * RfU * SfU * SfC * SfU | 2817 | UCCGGUUCUGAAGGUGUUCU | SSSSSSSOSSSOOSSRSSS |
| WV-25452 | fU * SfC * SfC * SfG * SfG * SfU * SfU * SmCfU * SmG * SfA * SmAmGfG * SfU * SfG * SfU * RfU * SfC * SfU | 2818 | UCCGGUUCUGAAGGUGUUCU | SSSSSSSOSSSOOSSSRSS |

TABLE A1-continued

| | | | | |
|---|---|---|---|---|
| WV-25453 | fU * SfC * SfC * SfG * SfG * SfU * SfU * SmCfU * SmG * SfA * SmAmGfG * SfU * SfG * SfU * SfU * RfC * SfU | 2819 | UCCGGUUCUGAAGGUGUUCU | SSSSSSSOSSSOOSSSSRS |
| WV-25454 | fU * SfC * SfC * SfG * SfG * SfU * SfU * SmCfU * SmG * SfA * SmAmGfG * SfU * SfG * SfU * SfU * SfC * RfU | 2820 | UCCGGUUCUGAAGGUGUUCU | SSSSSSSOSSSOOSSSSSR |
| WV-25455 | fC * SfG * SfG * SfU * SfU * SmCfU * SmG * SfA * SmAmGfG * SfU * SfG * SfU * SfU * SfC * SfU | 2821 | CGGUUCUGAAGGUGUUCU | SSSSSOSSSOOSSSSSS |
| WV-25456 | fU * SfU * SfC * SfC * SfG * SfG * SfU * SfU * SmCfU * SmG * SfA * SmAmGfG * SfU * SfG * SfU * SfU * SfC * SfU | 2822 | UUCCGGUUCUGAAGGUGUUCU | SSSSSSSSOSSSOOSSSSSS |
| WV-25457 | fU * SfC * SfC * SfG * SfG * SfU * SfU * SfU * SmCfU * SmG * SfA * SmAmGfG * SfU * SfG * SfU * SfU * SfC * SfU | 2823 | UCCGGUUUCUGAAGGUGUUCU | SSSSSSSSOSSSOOSSSSSS |
| WV-25458 | fU * SfC * SfC * SfG * SfG * SfU * SfU * SmCfU * SmG * SfA * SmAmGfG * SfU * SfG * SfU * SfU * SfU * SfC * SfU | 2824 | UCCGGUUCUGAAGGUGUUUCU | SSSSSSSOSSSOOSSSSSSS |
| WV 25459 | fU * SfC * SfC * SfG * SfG * SfU * SmCfU * SmG * SfA * SmAmGfG * SfU * SfG * SfU * SfU * SfC * SfU | 2825 | UCCGGUCUGAAGGUGUUCU | SSSSSSOSSSOOSSSSSS |
| WV-25536 | lT * SfC * SlA * SfC * SfU * SfC * SmAfG * SfA * SmU * SfA * SmGmUfU * SfG * SfA * SfA * SfG * SfC * SfC | 2826 | TCACUCAGAUAGUUGAAGCC | SSSSSSOSSSSOOSSSSSS |
| WV-25537 | fU * SfC * SfA * SfC * SfU * SfC * SmAfG * SfA * SmU * SfA * SmGmUfU * SfG * SfA * SfA * SlG * SfC * SfC | 2827 | UCACUCAGAUAGUUGAAGCC | SSSSSSOSSSSOOSSSSSS |
| WV-25538 | lT * SfC * SlA * SfC * SfU * SfC * SmAfG * SfA * SmU * SfA * SmGmUfU * SfG * SfA * SfA * SlG * SfC * SfC | 2828 | TCACUCAGAUAGUUGAAGCC | SSSSSSOSSSSOOSSSSSS |
| WV-25539 | fU * SfC * SfA * SfC * SfU * SfC * SlAfG * SfA * SmU * SfA * SfGlTfU * SfG * SfA * SfA * SfG * SfC * SfC | 2829 | UCACUCAGAUAGTUGAAGCC | SSSSSSOSSSSOOSSSSSS |
| WV-25540 | fU * SfC * SfA * SfC * SfU * SfC * SlAfG * SfA * SmU * SfA * SlGlTlT * SfG * SfA * SfA * SfG * SfC * SfC | 2830 | UCACUCAGAUAGTTGAAGCC | SSSSSSOSSSSOOSSSSSS |
| WV-25541 | fU * SfC * SfA * SfC * SfU * SfC * SlAn001RfG * SfA * SmU * SfA * SlGn001RlTn001RlT * SfG * SfA * SfA * SfG * SfC * SfC | 2831 | UCACUCAGAUAGTTGAAGCC | SSSSSSnRSSSSnRnRSSSSSS |
| WV-25542 | lT * SfC * SlA * SfC * SfU * SfC * SmAn001RfG * SfA * SmU * SfA * SmGn001RmUn001RfU * SfG * SfA * SfA * SfG * SfC * SfC | 2832 | TCACUCAGAUAGUUGAAGCC | SSSSSSnRSSSSnRnRSSSSSS |

TABLE A1-continued

| | | | | |
|---|---|---|---|---|
| WV-25543 | fU * SfC * SfA * SfC * SfU * SfC * SmAn001RfG * SfA * SmU * SfA * SmGn001RmUn001RfU * SfG * SfA * SfA * SlG * SfC * SfC | 2833 | UCACUCAGAUAGUUGAAGCC | SSSSSSnRSSSSnRnRSSSSSS |
| WV-25544 | lT * SfC * SlA * SfC * SfU * SfC * SmAn001RfG * SfA * SmU * SfA * SmGn001RmUn001RfU * SfG * SfA * SfA * SlG * SfC * SfC | 2834 | TCACUCAGAUAGUUGAAGCC | SSSSSSnRSSSSnRnRSSSSSS |
| WV-27163 | L001fU * SfC * SfA * SfC * SfU * SfC * SmAfG * SfA * SmU * SfA * SmGmU * SfU * SfG * SfA * SfA * SfG * SfC * SfC | 2835 | UCACUCAGAUAGUUGAAGCC | OSSSSSSOSSSSOSSSSSSS |
| WV-27164 | L001fU * SfC * SfAn001RfC * SfU * SfCn001RmAfG * SfA * SmU * SfA * SmGmU * SfU * SfG * SfA * SfAn001RfG * SfC * SfC | 2836 | UCACUCAGAUAGUUGAAGCC | OSSnRSSnROSSSSOSSSSnRSS |
| WV-19790 | Mod020L001 fU fC fA fC fU fC mAn001 fG fA mU fA mGn001 mUn001 fU fG fA fA fG fC fC | 2837 | UCACUCAGAUAGUUGAA GCC | OSSSS SSnXSS SSnXnXS SSSSS |
| WV-19791 | Mod015L001 fU fC fA fC fU fC mAn001 fG fA mU fA mGn001 mUn001 fU fG fA fA fG fC fC | 2838 | UCACUCAGAUAGUUGAA GCC | OSSSS SSnXSS SSnXnXS SSSSS |
| WV-19792 | Mod109L001 fU fC fA fC fU fC mAn001 fG fA mU fA mGn001 mUn001 fU fG fA fA fG fC fC | 2839 | UCACUCAGAUAGUUGAA GCC | OSSSS SSnXSS SSnXnXS SSSSS |
| WV-19793 | Mod110L001 fU fC fA fC fU fC mAn001 fG fA mU fA mGn001 mUn001 fU fG fA fA fG fC fC | 2840 | UCACUCAGAUAGUUGAA GCC | OSSSS SSnXSS SSnXnXS SSSSS |
| WV-19794 | Mod111L001 fU fC fA fC fU fC mAn001 fG fA mU fA mGn001 mUn001 fU fG fA fA fG fC fC | 2841 | UCACUCAGAUAGUUGAA GCC | OSSSS SSnXSS SSnXnXS SSSSS |
| WV-19795 | Mod112L001 fU fC fA fC fU fC mAn001 fG fA mU fA mGn001 mUn001 fU fG fA fA fG fC fC | 2842 | UCACUCAGAUAGUUGAA GCC | OSSSS SSnXSS SSnXnXS SSSSS |
| WV-19796 | Mod113L001 fU fC fA fC fU fC mAn001 fG fA mU fA mGn001 mUn001 fU fG fA fA fG fC fC | 2843 | UCACUCAGAUAGUUGAA GCC | OSSSS SSnXSS SSnXnXS SSSSS |
| WV-19797 | Mod114L001 fU fC fA fC fU fC mAn001 fG fA mU fA mGn001 mUn001 fU fG fA fA fG fC fC | 2844 | UCACUCAGAUAGUUGAA GCC | OSSSS SSnXSS SSnXnXS SSSSS |
| WV-19798 | Mod115L001 fU fC fA fC fU fC mAn001 fG fA mU fA mGn001 mUn001 fU fG fA fA fG fC fC | 2845 | UCACUCAGAUAGUUGAA GCC | OSSSS SSnXSS SSnXnXS SSSSS |
| WV-15883 | fC * SfU * SfCn002RfC * SfG * SfGn002RfU * SfU * SmCfU * SmC * SfA * SmAfGfG * SfU * SfGn002RfU * SfU * SfC | 2846 | CUCCGGUUCUGAAGGUG UUC | SSnR SSnR SSOSSS OOSSnR SS |
| WV-15884 | mU * SGeon002m5Ceon002m5Ceon002mA * SG * SG * RC * ST * SG * RG * ST * ST * RA * ST * SmG * SmA * SmC * SmU * SmC | 2847 | UGCCAGGCTGGTTATGAC UC | SnX nX nX SSRSSR SSRSSSSSS |
| WV-15885 | mU * SGeon002Rm5Ceon002Rm5Ceon002RmA * SG * SG * RC * ST * SG * RG * ST * ST * RA * ST * SmG * SmA * SmC * SmU * SmC | 2848 | UGCCAGGCTGGTTATGAC UC | SnR nR nR SSRSSR SSRSSSSSS |

TABLE A1-continued

| | | | | |
|---|---|---|---|---|
| WV-15886 | fC * SfU * SfCn002fC * SfG * SfUn002fU * SfU * SmCfU * SmG * SfA * SmAfGfG * SfU * SfUn002fU * SfU * SfC | 2849 | CUCCGGUUCUGAAGGUG UUC | SSnX SSnX SSOSSS OOSSnX SS |
| WV-15887 | mU * SGeon002Sm5Ceon002Sm5Ceon002SmA * SG * SG * RC * ST * SG * RG * ST * ST * RA * ST * SmG * SmA * SmC * SmU * SmC | 2850 | UGCCAGGCTGGTTATGAC UC | SnS nS nS SSRSSR SSRSSSSS |
| WV-16006 | fCfUfCn003RfCfGfGn003RfUfUmCfUmGfAmAfGfGfUfGn0 03RfUfUfC | 2851 | CUCCGGUUCUGAAGGUG UUC | SSnR SSnR SSOSSS OOSSnR SS |
| WV-16008 | fUfCfAfCfUfCmAn003fGfAmUfAmGn003mUn003fUfGfAfA fGfCfC | 2852 | UCACUCAGAUAGUUGAA GCC | SSSSSSnX SSSSnX nX SSSSSS |
| WV-16007 | fCfUfCn004RfCfGfGn004RfUfUmCfU mGfAmAfGfGfUGn004RfUfUfC | 2853 | CUCCGGUUCUGAAGGUG UUC | SSnR SSnR SSOSSS OOSSnR SS |
| WV-16009 | fUfCfAfCfUfCmAn004fGfAmUfAmG n004mUn004fUfGfAfAfGfCfC | 2854 | UCACUCAGAUAGUUGAA GCC | SSSSSS nX SSSSnX nX SSSSSS |
| WV-24088 | fU * SfC * SfA * SfC * SfU * SfC * SmAn005fG * SfA * SmU * SfA * SmGn005mUn005fU * SfG * SfA * SfA * SfG * SfC * SfC | 2855 | UCACUCAGAUAGUUGAA GCC | SSSSS S nX SSSS nX nX SSSSS S |
| WV-24089 | fU * SfC * SfA * SfC * SfU * SfC * SmAn005RfG * SfA * SmU * SfA * SmGn005RmUn005RfU * SfG * SfA * SfA * SfG * SfC * SfC | 2856 | UCACUCAGAUAGUUGAA GCC | SSSSS S nR SSSS nR nR SSSSS S |
| WV-24090 | fU * SfU * SfA * SfC * SfU * SfC * SmAn005SfG * SfA * SmU * SfA * SmGn005SmUn005SfU * SfG * SfA * SfA * SfG * SfC * SfC | 2857 | UCACUCAGAUAGUUGAA GCC | SSSSS S nS SSSS nS nS SSSSS S |
| WV-24100 | mU * SGeon005m5Ceon005m5Ceon005mA * SG * SG * RC * ST * SG * RG * ST * ST * RA * ST * SmG * SmA * SmC * SmU * SmC | 2858 | UGCCAGGCTGGTTATGAC UC | S nX nX nX SSRSS RSSRSS SSSS |
| WV-24101 | mU * SGeon005Rm5Ceon005Rm5Ceon005RmA * SG * SG * RC * ST * SG * RG * ST * ST * RA * ST * SmG * SmA * SmC * SmU * SmC | 2859 | UGCCAGGCTGGTTATGAC UC | S nR nR nR SSRSS RSSRSS SSSS |
| WV-24102 | mU * SGeon005Sm5Ceon005Sm5Ceon005SmA * SG * SG * RC * ST * SG * RG * ST * ST * RA * ST * SmG * SmA * SmC * SmU * SmC | 2860 | UGCCAGGCTGGTTATGAC UC | S nS nS nS SSRSS RSSRSS SSSS |
| WV-24091 | fU * SfC * SfA * SfC * SfU * SfC * SmAn006fG * SfA * SmU * SfA * SmGn006mUn006fU * SfG * SfA * SfA * SfG * SfC * SfC | 2861 | UCACUCAGAUAGUUGAA GCC | SSSSS S nX SSSS nX nX SSSSS S |
| WV-24092 | fU * SfC * SfA * SfC * SfU * SfC * SmAn006RfG * SfA * SmU * SfA * SmGn006RmUn006RfU * SfG * SfA * SfA * SfG * SfC * SfC | 2862 | UCACUCAGAUAGUUGAA GCC | SSSSS S nR SSSS nR nR SSSSS S |

TABLE A1-continued

| | | | | |
|---|---|---|---|---|
| WV-24093 | fU * SfC * SfA * SfC * SfU * SfC * SmAn006SfG * SfA * SmU * SfA * SmGn006SmUn006SfU * SfG * SfA * SfA * SfG * SfC * SfC | 2863 | UCACUCAGAUAGUUGAA GCC | SSSSS S nS SSSS nS nS SSSSS S |
| WV-24103 | mU * SGeon006m5Ceon006m5Ceon006mA * SG * SG * RC * ST * SG * RG * ST * ST * RA * ST * SmG * SmA * SmC * SmU * SmC | 2864 | UGCCAGGCTGGTTATGAC UC | S nX nX nX SSRSS RSSRSS SSSS |
| WV-24104 | mU * SGeon006Rm5Ceon006Rm5Ceon006RmA * SG * SG * RC * ST * SG * RG * ST * ST * RA * ST * SmG * SmA * SmC * SmU * SmC | 2865 | UGCCAGGCTGGTTATGAC UC | S nR nR nR SSRSS RSSRSS SSSS |
| WV-24105 | mU * SGeon006Sm5Ceon006Sm5Ceon006SmA * SG * SG * RC * ST * SG * RG * ST * ST * RA * ST * SmG * SmA * SmC * SmU * SmC | 2866 | UGCCAGGCTGGTTATGAC UC | S nS nS nS SSRSS RSSRSS SSSS |
| WV-24094 | fU * SfC * SfA * SfC * SfU * SfC * SmAn007fG * SfA * SmU * SfA * SmGn007mUn007fU * SfG * SfA * SfA * SfG * SfC * SfC | 2867 | UCACUCAGAUAGUUGAA GCC | SSSSS S nX SSSS nX nX SSSSS S |
| WV-24095 | fU * SfC * SfA * SfC * SfU * SfC * SmAn007RfG * SfA * SmU * SfA * SmGn007RmUn0071RfU * SfG * SfA * SfA * SfG * SfC * SfC | 2868 | UCACUCAGAUAGUUGAA GCC | SSSSS S nR SSSS nR nR SSSSS S |
| WV-24096 | fU * SfC * SfA * SfC * SfU * SfC * SmAn007SfG * SfA * SmU * SfA * SmGn007SmUn007SfU * SfG * SfA * SfA * SfG * SfU * SfC | 2869 | UCACUCAGAUAGUUGAA GCC | SSSSS S nS SSSS nS nS SSSSS S |
| WV-24106 | mU * SGeon007Rm5Ceon007Rm5Ceon007RmA * SG * SG * RC * ST * SG * RG * ST * ST * RA * ST * SmG * SmA * SmC * SmU * SmC | 2870 | UGCCAGGCTGGTTATGAC UC | S nR nR nR SSRSS RSSRSS SSSS |
| WV-24107 | mU * SGeon007Sm5Ceon007Sm5Ceon007SmA * SG * SG * RC * ST * SG * RG * ST * ST * RA * ST * SmG * SmA * SmC * SmU * SmC | 2871 | UGCCAGGCTGGTTATGAC UC | S nS nS nS SSRSS RSSRSS SSSS |
| WV-24097 | fU * SfC * SfA * SfC * SfU * SfC * SmAn008fG * SfA * SmU * SfA * SmGn008mUn008fU * SfG * SfA * SfA * SfG * SfC * SfC | 2872 | UCACUCAGAUAGUUGAA GCC | SSSSS S nX SSSS nX nX SSSSS S |
| WV-24098 | fU * SfC * SfA * SfC * SfU * SfC * SmAn008RfG * SfA * SmU * SfA * SmGn008RmUn008RfU * SfG * SfA * SfA * SfG * SfC * SfC | 2873 | UCACUCAGAUAGUUGAA GCC | SSSSS S nR SSSS nR nR SSSSS S |
| WV-24099 | fU * SfC * SfA * SfC * SfU * SfC * SmAn008SfG * SfA * SmU * SfA * SmGn008SmUn008SfU * SfG * SfA * SfA * SfG * SfC * SfC | 2874 | UCACUCAGAUAGUUGAA GCC | SSSSS S nS SSSS nS nS SSSSS S |
| WV-24108 | mU * SGeon008m5Ceon008m5Ceon008mA * SG * SG * RC * ST * SG * RG * ST * ST * RA * ST * SmG * SmA * SmC * SmU * SmC | 2875 | UGCCAGGCTGGTTATGAC UC | S nX nX nX SSRSS RSSRSS SSSS |

TABLE A1-continued

| | | | | |
|---|---|---|---|---|
| WV-24109 | mU * SGeon008Rm5Ceon008Rm5Ceon008RmA * SG * SG * RC * ST * SG * RG * ST * ST * RA * ST * SmG * SmA * SmC * SmU * SmC | 2876 | UGCCAGGCTGGTTATGACUC | S nR nR nR SSRSS RSSRSS SSSS |
| WV-24110 | mU * SGeon008Sm5Ceon008Sm5Ceon008SmA * SG * SG * RC * ST * SG * RG * ST * ST * RA * ST * SmG * SmA * SmC * SmU * SmC | 2877 | UGCCAGGCTGGTTATGACUC | S nS nS nS SSRSS RSSRSS SSSS |
| WV-12880 | fC * SfU * SfCn001fC * SfG * SfGn001fU * SfU * SmCfU * SmG * SfA * SmAfG * SfG * SfU * SfGn001fU * SfU * SfC | 2878 | CUCCGGUUCUGAAGGUGUUC | SSnX SSnX SSOSS SOSSSnX SS |
| WV-12880 | fC * SfU * SfCn001fC * SfG * SfGn001fU * SfU * SmCfU * SmG * SfA * SmAfG * SfG * SfU * SfGn001fU * SfU * SfC | 2879 | CUCCGGUUCUGAAGGUGUUC | SSnX SSnX SSOSS SOSSSnX SS |
| WV-21219 | fGn001RfU | | GU | nR |
| WV-21226 | fCn001RfC | | CC | nR |
| WV-21252 | fGn001SfU | | GU | nS |
| WV-21253 | fCn001SfC | | CC | nS |
| WV-21258 | fGn001RmA | | GA | nR |
| WV-21374 | fC * RfU * SfCn001RfC * SfG * SfGn001RfU * SfU * SmCfU * SmG * SfA * SmAfG * SfG * SfU * SfGn001RfU * SfU * SfC | 2880 | CUCCGGUUCUGAAGGUGUUC | RSnR SSnR SSOSS SOSSSnR SS |
| WV-21375 | fC * SfU * RfCn001RfC * SfG * SfGn001RfU * SfU * SmCfU * SmG * SfA * SmAfG * SfG * SfU * SfGn001RfU * SfU * SfC | 2881 | CUCCGGUUCUGAAGGUGUUC | SRnR SSnR SSOSS SOSSSnR SS |
| WV-21376 | fC * SfU * SfCn001SfC * SfG * SfGn001RfU * SfU * SmCfU * SmG * SfA * SmAfG * SfG * SfU * SfGn001RfU * SfU * SfC | 2882 | CUCCGGUUCUGAAGGUGUUC | SSnS SSnR SSOSS SOSSSnR SS |
| WV-21377 | fC * SfU * SfCn001RfC * RfG * SfGn001RfU * SfU * SmCfU * SmG * SfA * SmAfG * SfG * SfU * SfGn001RfU * SfU * SfC | 2883 | CUCCGGUUCUGAAGGUGUUC | SSnR RSnR SSOSS SOSSSnR SS |
| WV-21378 | fC * SfU * SfCn001RfC * SfG * RfGn001RfU * SfU * SmCfU * SmG * SfA * SmAfG * SfG * SfU * SfGn001RfU * SfU * SfC | 2884 | CUCCGGUUCUGAAGGUGUUC | SSnR SSRnR SSOSS SOSSSnR SS |
| WV-21379 | fC * SfU * SfCn001RfC * SfG * SfGn001SfU * SfU * SmCfU * SmG * SfA * SmAfG * SfG * SfU * SfGn001RfU * SfU * SfC | 2885 | CUCCGGUUCUGAAGGUGUUC | SSnR SSnS SSOSS SOSSSnR SS |
| WV-21380 | fC * SfU * SfCn001RfC * SfG * SfGn001RfU * RfU * SmCfU * SmG * SfA * SmAfG * SfG * SfU * SfGn001RfU * SfU * SfC | 2886 | CUCCGGUUCUGAAGGUGUUC | SSnR SSnR RSOSSSO SS SnR SS |

TABLE A1-continued

| | | | | |
|---|---|---|---|---|
| WV-21381 | fC * SfU * SfCn001RfC * SfG * SfGn001RfU * SfU * RmCfU * SmG * SfA * SmAfG * SfG * SfU * SfGn001RfU * SfU * SfC | 2887 | CUCCGGUUCUGAAGGUGUUC | SSnR SSnR SROSSSO SS SnR SS |
| WV-21382 | fC * SfU * SfCn001RfC * SfG * SfGn001RfU * SfU * SmCfU * RmG * SfA * SmAfG * SfG * SfU * SfGn001RfU * SfU * SfC | 2888 | CUCCGGUUCUGAAGGUGUUC | SSnR SSnR SSORSSOSS SnR SS |
| WV-21383 | fC * SfU * SfCn001RfC * SfG * SfGn001RfU * SfU * SmCfU * SmG * RfA * SmAfG * SfG * SfU * SfGn001RfU * SfU * SfC | 2889 | CUCCGGUUCUGAAGGUGUUC | SSnR SSnR SSOSRSOSSSnR SS |
| WV-21384 | fC * SfU * SfCn001RfC * SfG * SfGn001RfU * SfU * SmCfU * SmG * SfA * RmAfG * SfG * SfU * SfGn001RfU * SfU * SfC | 2890 | CUCCGGUUCUGAAGGUGUUC | SSnR SSnR SSOSS ROSSSnR SS |
| WV 21385 | fC * SfU * SfCn001RfC * SfG * SfGn001RfU * SfU * SmCfU * SmG * SfA * SmAfG * RfG * SfU * SfGn001RfU * SfU * SfC | 2891 | CUCCGGUUCUGAAGGUGUUC | SSnR SSnR SSOSS SORSSnR SS |
| WV-21386 | fC * SfU * SfCn001RfC * SfG * SfGn001RfU * SfU * SmCfU * SmG * SfA * SmAfG * SfG * RfU * SfGn001RfU * SfU * SfC | 2892 | CUCCGGUUCUGAAGGUGUUC | SSnR SSnR SSOSS SOSRSnR SS |
| WV-21387 | fC * SfU * SfCn001RfC * SfG * SfGn001RfU * SfU * SmCfU * SmG * SfA * SmAfG * SfG * SfU * RfGn001RfU * SfU * SfC | 2893 | CUCCGGUUCUGAAGGUGUUC | SSnR SSnR SSOSS SOSSRnR SS |
| WV-21388 | fC * SfU * SfCn001RfC * SfG * SfGn001RfU * SfU * SmCfU * SmG * SfA * SmAfG * SfG * SfU * SfGn001SfU * SfU * SfC | 2894 | CUCCGGUUCUGAAGGUGUUC | SSnR SSnR SSOSS SOSSSnS SS |
| WV-21389 | fC * SfU * SfCn001RfC * SfG * SfGn001RfU * SfU * SmCfU * SmG * SfA * SmAfG * SfG * SfU * SfGn001RfU * RFU * SfC | 2895 | CUCCGGUUCUGAAGGUGUUC | SSnR SSnR SSOSS SOSSSnR RS |
| WV-21390 | fC * SfU * SfCn001RfC * SfG * SfGn001RfU * SfU * SmCfU * SmG * SfA * SmAfG * SfG * SfU * SfGn001RfU * SfU * RfC | 2896 | CUCCGGUUCUGAAGGUGUUC | SSnR SSnR SSOSS SOSSSnR SR |
| WV-21578 | fC * SfU * SfUn001fA * SfA * SfGn001fA * SfU * SmA * SfC * SmC * SfA * SmU * SfU * SfU * SfG * SfUn001fA * SfU * SfU | 2897 | CUUAAGAUACCAUUUGUAUU | SSnX SSnX SSSSS SSSSS nX SS |
| WV-21579 | fU * SfU * SfAn001fA * SfG * SfAn001fU * SfA * SmC * SfC * SmA * SfU * SmU * SfU * SfG * SfU * SfAn001fU * SfU * SfU | 2898 | UUAAGAUACCAUUUGUAUUU | SSnX SSnX SSSSS SSSSS nX SS |
| WV-21580 | fU * SfA * SfAn001fG * SfA * SfUn001fA * SfC * SmC * SfA * SmU * SfU * SmU * SfG * SfU * SfA * SfUn001fU * SfU * SfA | 2899 | UAAGAUACCAUUUGUAUUUA | SSnX SSnX SSSSS SSSSS nX SS |
| WV-21581 | fA * SfA * SfGn001fA * SfU * SfAn001fC * SfC * SmA * SfU * SmU * SfU * SmG * SfU * SfA * SfU * SfUn001fU * SfA * SfG | 2900 | AAGAUACCAUUUGUAUUUAG | SSnX SSnX SSSSS SSSSS nX SS |
| WV-21582 | fA * SfG * SfAn001fU * SfA * SfCn001fC * SfA * SmU * SfU * SmU * SfG * SmU * SfA * SfU * SfU * SfUn001fA * SfG * SfC | 2901 | AGAUACCAUUUGUAUUUAGC | SSnX SSnX SSSSS SSSSS nX SS |
| WV-21583 | fG * SfA * SfUn001fA * SfC * SfCn001fA * SfU * SmU * SfU * SmG * SfU * SmA * SfU * SfU * SfU * SfAn001fG * SfC * SfA | 2902 | GAUACCAUUUGUAUUUAGCA | SSnX SSnX SSSSS SSSSS nX SS |
| WV-21584 | fA * SfU * SfAn001fC * SfC * SfAn001fU * SfU * SmU * SfG * SmU * SfA * SmU * SfU * SfU * SfA * SfGn001fC * SfA * SfU | 2903 | AUACCAUUUGUAUUUAGCAU | SSnX SSnX SSSSS SSSSS nX SS |

TABLE A1-continued

| | | | | |
|---|---|---|---|---|
| WV-21585 | fU * SfA * SfCn001fC * SfA * SfUn001fU * SfU * SmG * SfU * SmA * SfU * SmU * SfU * SfA * SfG * SfCn001fA * SfU * SfG | 2904 | UACCAUUUGUAUUUAGCAUG | SSnX SSnX SSSSS SSSSS nX SS |
| WV-21586 | fA * SfC * SfCn001fA * SfU * SfUn001fU * SfG * SmU * SfA * SmU * SfU * SmU * SfA * SfG * SfC * SfAn001fU * SfG * SfU | 2905 | ACCAUUUGUAUUUAGCAUGU | SSnX SSnX SSSSS SSSSS nX SS |
| WV-21587 | fC * SfC * SfAn001fU * SfU * SfUn001fG * SfU * SmA * SfU * SmU * SfU * SmA * SfG * SfC * SfA * SfUn001fG * SfU * SfU | 2906 | CCAUUUGUAUUUAGCAUGUU | SSnX SSnX SSSSS SSSSS nX SS |
| WV-21588 | fC * SfA * SfUn001fU * SfU * SfGn001fU * SfA * SmU * SfU * SmU * SfA * SmG * SfC * SfA * SfU * SfGn001fU * SfU * SfC | 2907 | CAUUUGUAUUUAGCAUGUUC | SSnX SSnX SSSSS SSSSS nX SS |
| WV-21589 | fA * SfU * SfUn001fU * SfG * SfUn001fA * SfU * SmU * SfU * SmA * SfG * SmC * SfA * SfU * SfG * SfUn001fU * SfC * SfC | 2908 | AUUUGUAUUUAGCAUGUUCC | SSnX SSnX SSSSS SSSSS nX SS |
| WV-21590 | fU * SfU * SfUn001fG * SfU * SfAn001fU * SfU * SmU * SfA * SmG * SfC * SmA * SfU * SfG * SfU * SfUn001fC * SfC * SfC | 2909 | UUUGUAUUUAGCAUGUUCCC | SSnX SSnX SSSSS SSSSS nX SS |
| WV-21591 | fU * SfU * SfGn001fU * SfA * SfUn001fU * SfU * SmA * SfG * SmC * SfA * SmU * SfG * SfU * SfU * SfCn001fC * SfC * SfA | 2910 | UUGUAUUUAGCAUGUUCCCA | SSnX SSnX SSSSS SSSSS nX SS |
| WV-21592 | fU * SfG * SfUn001fA * SfU * SfUn001fU * SfA * SmG * SfC * SmA * SfU * SmG * SfU * SfU * SfC * SfCn001fC * SfA * SfA | 2911 | UGUAUUUAGCAUGUUCCCAA | SSnX SSnX SSSSS SSSSS nX SS |
| WV-21593 | fG * SfU * SfAn001fU * SfU * SfUn001fA * SfG * SmC * SfA * SmU * SfG * SmU * SfU * SfC * SfC * SfCn001fA * SfA * SfU | 2912 | GUAUUUAGCAUGUUCCCAAU | SSnX SSnX SSSSS SSSSS nX SS |
| WV-21594 | fU * SfA * SfUn001fU * SfU * SfAn001fG * SfC * SmA * SfU * SmG * SfU * SmU * SfC * SfC * SfC * SfAn001fA * SfU * SfU | 2913 | UAUUUAGCAUGUUCCCAAUU | SSnX SSnX SSSSS SSSSS nX SS |
| WV-21595 | fU * SfU * SfUn001fA * SfG * SfCn001fA * SfU * SmG * SfU * SmU * SfC * SmC * SfC * SfA * SfA * SfUn001fU * SfC * SfU | 2914 | UUUAGCAUGUUCCCAAUUCU | SSnX SSnX SSSSS SSSSS nX SS |
| WV-21596 | fU * SfU * SfAn001fG * SfC * SfAn001fU * SfG * SmU * SfU * SmC * SfC * SmC * SfA * SfA * SfU * SfUn001fC * SfU * SfC | 2915 | UUAGCAUGUUCCCAAUUCUC | SSnX SSnX SSSSS SSSSS nX SS |
| WV-21597 | fU * SfA * SfGn001fC * SfA * SfUn001fG * SfU * SmU * SfC * SmC * SfC * SmA * SfA * SfU * SfU * SfCn001fU * SfU * SfA | 2916 | UAGCAUGUUCCCAAUUCUCA | SSnX SSnX SSSSS SSSSS nX SS |
| WV-21598 | fA * SfG * SfCn001fA * SfU * SfGn001fU * SfG * SmC * SfC * SmC * SfA * SmA * SfU * SfU * SfC * SfUn001fC * SfA * SfG | 2917 | AGCAUGUUCCCAAUUCUCAG | SSnX SSnX SSSSS SSSSS nX SS |
| WV-21599 | fG * SfC * SfAn001fU * SfG * SfUn001fU * SfC * SmC * SfC * SmA * SfA * SmU * SfU * SfC * SfU * SfCn001fA * SfG * SfG | 2918 | GCAUGUUCCCAAUUCUCAGG | SSnX SSnX SSSSS SSSSS nX SS |
| WV-21600 | fC * SfA * SfUn001fG * SfU * SfUn001fC * SfC * SmC * SfA * SmA * SfU * SmU * SfC * SfU * SfC * SfAn001fG * SfG * SfA | 2919 | CAUGUUCCCAAUUCUCAGGA | SSnX SSnX SSSSS SSSSS nX SS |
| WV-21601 | fA * SfU * SfGn001fU * SfU * SfCn001fC * SfC * SmA * SfA * SmU * SfU * SmC * SfU * SfC * SfA * SfGn001fG * SfA * SfA | 2920 | AUGUUCCCAAUUCUCAGGAA | SSnX SSnX SSSSS SSSSS nX SS |

TABLE A1-continued

| | | | | |
|---|---|---|---|---|
| WV-21602 | fU * SfG * SfUn001fU * SfC * SfCn001fC * SfA * SmA * SfU * SmU * SfC * SmU * SfC * SfA * SfG * SfGn001fA * SfA * SfU | 2921 | UGUUCCCAAUUCUCAGGAAU | SSnX SSnX SSSSS SSSSS nX SS |
| WV-21603 | fG * SfU * SfUn001fC * SfC * SfCn001fA * SfA * SmU * SfU * SmC * SfU * SmC * SfA * SfG * SfG * SfAn001fA * SfU * SfU | 2922 | GUUCCCAAUUCUCAGGAAUU | SSnX SSnX SSSSS SSSSS nX SS |
| WV-21604 | fU * SfU * SfCn001fC * SfC * SfAn001fA * SfU * SmU * SfC * SmU * SfC * SmA * SfG * SfG * SfA * SfAn001fU * SfU * SfU | 2923 | UUCCCAAUUCUCAGGAAUUU | SSnX SSnX SSSSS SSSSS nX SS |
| WV-21605 | fU * SfC * SfCn001fC * SfA * SfAn001fU * SfU * SmC * SfU * SmC * SfA * SmG * SfG * SfA * SfA * SfUn001fU * SfU * SfG | 2924 | UCCCAAUUCUCAGGAAUUUG | SSnX SSnX SSSSS SSSSS nX SS |
| WV-21606 | fC * SfC * SfCn001fA * SfA * SfUn001fU * SfC * SmU * SfC * SmA * SfG * SmG * SfA * SfA * SfU * SfUn001fU * SfG * SfU | 2925 | CCCAAUUCUCAGGAAUUUGU | SSnX SSnX SSSSS SSSSS nX SS |
| WV-21607 | fC * SfC * SfAn001fA * SfU * SfUn001fC * SfU * SmC * SfA * SmG * SfG * SmA * SfA * SfU * SfU * SfUn001fG * SfU * SfG | 2926 | CCAAUUCUCAGGAAUUUGUG | SSnX SSnX SSSSS SSSSS nX SS |
| WV-21608 | fC * SfA * SfAn001fU * SfU * SfCn001fU * SfC * SmA * SfG * SmG * SfA * SmA * SfU * SfU * SfU * SfGn001fU * SfG * SfU | 2927 | CAAUUCUCAGGAAUUUGUGU | SSnX SSnX SSSSS SSSSS nX SS |
| WV-21609 | fA * SfA * SfUn001fU * SfC * SfUn001fC * SfA * SmG * SfG * SmA * SfA * SmU * SfU * SfU * SfG * SfUn001fG * SfU * SfC | 2928 | AAUUCUCAGGAAUUUGUGUC | SSnX SSnX SSSSS SSSSS nX SS |
| WV-21610 | fA * SfU * SfUn001fC * SfU * SfCn001fA * SfG * SmG * SfA * SmA * SfU * SmU * SfU * SfG * SfU * SfGn001fU * SfC * SfU | 2929 | AUUCUCAGGAAUUUGUGUCU | SSnX SSnX SSSSS SSSSS nX SS |
| WV-21611 | fU * SfU * SfCn001fU * SfC * SfAn001fG * SfG * SmA * SfA * SmU * SfU * SmU * SfG * SfU * SfG * SfUn001fC * SfU * SfU | 2930 | UUCUCAGGAAUUUGUGUCUU | SSnX SSnX SSSSS SSSSS nX SS |
| WV-21612 | fU * SfC * SfUn001fC * SfA * SfGn001fG * SfA * SmA * SfU * SmU * SfU * SmG * SfU * SfG * SfU * SfCn001fU * SfU * SfU | 2931 | UCUCAGGAAUUUGUGUCUUU | SSnX SSnX SSSSS SSSSS nX SS |
| WV-21613 | fC * SfU * SfCn001fA * SfG * SfGn001fA * SfA * SmU * SfU * SmU * SfG * SmU * SfG * SfU * SfC * SfUn001fU * SfU * SfC | 2932 | CUCAGGAAUUUGUGUCUUUC | SSnX SSnX SSSSS SSSSS nX SS |
| WV-21614 | fU * SfC * SfAn001fG * SfG * SfAn001fA * SfU * SmU * SfU * SmG * SfU * SmG * SfU * SfC * SfU * SfUn001fU * SfC * SfU | 2933 | UCAGGAAUUUGUGUCUUUCU | SSnX SSnX SSSSS SSSSS nX SS |
| WV-21615 | fC * SfA * SfGn001fG * SfA * SfAn001fU * SfU * SmU * SfG * SmU * SfG * SmU * SfC * SfU * SfU * SfUn001fC * SfU * SfG | 2934 | CAGGAAUUUGUGUCUUUCUG | SSnX SSnX SSSSS SSSSS nX SS |
| WV-21616 | fA * SfG * SfGn001fA * SfA * SfUn001fU * SfU * SmG * SfU * SmG * SfU * SmC * SfU * SfU * SfU * SfCn001fU * SfG * SfA | 2935 | AGGAAUUUGUGUCUUUCUGA | SSnX SSnX SSSSS SSSSS nX SS |
| WV-21617 | fG * SfG * SfAn001fA * SfU * SfUn001fU * SfG * SmU * SfG * SmU * SfC * SmU * SfU * SfU * SfC * SfUn001fG * SfA * SfG | 2936 | GGAAUUUGUGUCUUUCUGAG | SSnX SSnX SSSSS SSSSS nX SS |
| WV-21618 | fG * SfA * SfAn001fU * SfU * SfUn001fG * SfU * SmG * SfU * SmC * SfU * SmU * SfU * SfC * SfU * SfGn001fA * SfG * SfA | 2937 | GAAUUUGUGUCUUUCUGAGA | SSnX SSnX SSSSS SSSSS nX SS |

TABLE A1-continued

| | | | | |
|---|---|---|---|---|
| WV-21619 | fA * SfA * SfUn001fU * SfU * SfGn001fU * SfG * SmU * SfC * SmU * SfU * SmU * SfC * SfU * SfG * SfAn001fG * SfA * SfA | 2938 | AAUUUGUGUCUUUCUGAGAA | SSnX SSnX SSSSS SSSSS nX SS |
| WV-21620 | fA * SfU * SfUn001fU * SfG * SfU001fG * SfU * SmC * SfU * SmU * SfU * SmC * SfU * SfG * SfA * SfGn001fA * SfA * SfA | 2939 | AUUUGUGUCUUUCUGAGAAA | SSnX SSnX SSSSS SSSSS nX SS |
| WV-21621 | fU * SfU * SfUn001fG * SfU * SfGn001fU * SfC * SmU * SfU * SmU * SfC * SmU * SfG * SfA * SfG * SfAn001fA * SfA * SfC | 2940 | UUUGUGUCUUUCUGAGAAAC | SSnX SSnX SSSSS SSSSS nX SS |
| WV-21622 | fU * SfU * SfGn001fU * SfG * SfUn001fC * SfU * SmU * SfU * SmC * SfU * SmG * SfA * SfG * SfA * SfAn001fA * SfC * SfU | 2941 | UUGUGUCUUUCUGAGAAACU | SSnX SSnX SSSSS SSSSS nX SS |
| WV-21623 | fU * SfG * SfUn001fG * SfU * SfCn001fU * SfU * SmU * SfC * SmU * SfG * SmA * SfG * SfA * SfA * SfAn001fC * SfU * SfG | 2942 | UGUGUCUUUCUGAGAAACUG | SSnX SSnX SSSSS SSSSS nX SS |
| WV-21624 | fG * SfU * SfGn001fU * SfC * SfUn001fU * SfU * SmC * SfU * SmG * SfA * SmG * SfA * SfA * SfA * SfCn001fU * SfG * SfU | 2943 | GUGUCUUUCUGAGAAACUGU | SSnX SSnX SSSSS SSSSS nX SS |
| WV-21625 | fU * SfG * SfUn001fC * SfU * SfUn001fU * SfC * SmU * SfG * SmA * SfG * SmA * SfA * SfA * SfC * SfUn001fG * SfU * SfU | 2944 | UGUCUUUCUGAGAAACUGUU | SSnX SSnX SSSSS SSSSS nX SS |
| WV-21626 | fG * SfU * SfCn001fU * SfU * SfUn001fC * SfU * SmG * SfA * SmG * SfA * SmA * SfA * SfC * SfU * SfGn001fU * SfU * SfC | 2945 | GUCUUUCUGAGAAACUGUUC | SSnX SSnX SSSSS SSSSS nX SS |
| WV-21627 | fU * SfC * SfUn001fU * SfU * SfCn001fU * SfG * SmA * SfG * SmA * SfA * SmA * SfC * SfU * SfG * SfUn001fU * SfC * SfA | 2946 | UCUUUCUGAGAAACUGUUCA | SSnX SSnX SSSSS SSSSS nX SS |
| WV-21628 | fC * SfU * SfUn001fU * SfC * SfUn001fG * SfA * SmG * SfA * SmA * SfA * SmC * SfU * SfG * SfU * SfUn001fC * SfA * SfG | 2947 | CUUUCUGAGAAACUGUUCAG | SSnX SSnX SSSSS SSSSS nX SS |
| WV-21629 | fU * SfU * SfUn001fC * SfU * SfGn001fA * SfG * SmA * SfA * SmA * SfC * SmU * SfG * SfU * SfU * SfCn001A * SfG * SfC | 2948 | UUUCUGAGAAACUGUUCAGC | SSnX SSnX SSSSS SSSSS nX SS |
| WV-21630 | fU * SfU * SfCn001fU * SfG * SfAn001fG * SfA * SmA * SfA * SmC * SfU * SmG * SfU * SfU * SfC * SfAn001fG * SfC * SfU | 2949 | UUCUGAGAAACUGUUCAGCU | SSnX SSnX SSSSS SSSSS nX SS |
| WV-21631 | fU * SfC * SfUn001fG * SfA * SfGn001fA * SfA * SmA * SfC * SmU * SfG * SmU * SfU * SfC * SfA * SfGn001fC * SfU * SfU | 2950 | UCUGAGAAACUGUUCAGCUU | SSnX SSnX SSSSS SSSSS nX SS |
| WV-21632 | fC * SfU * SfGn001fA * SfG * SfAn001fA * SfA * SmC * SfU * SmG * SfU * SmU * SfC * SfA * SfG * SfCn001fU * SfU * SfC | 2951 | CUGAGAAACUGUUCAGCUUC | SSnX SSnX SSSSS SSSSS nX SS |
| WV-21633 | fU * SfG * SfAn001fG * SfA * SfAn001fA * SfC * SmU * SfG * SmU * SfU * SmC * SfA * SfG * SfC * SfUn001fU * SfC * SfU | 2952 | UGAGAAACUGUUCAGCUUCU | SSnX SSnX SSSSS SSSSS nX SS |
| WV-21634 | fG * SfA * SfGn001fA * SfA * SfAn001fC * SfU * SmG * SfU * SmU * SfC * SmA * SfG * SfC * SfU * SfUn001fC * SfU * SfG | 2953 | GAGAAACUGUUCAGCUUCUG | SSnX SSnX SSSSS SSSSS nX SS |
| WV-21635 | fA * SfG * SfAn001fA * SfA * SfCn001fU * SfG * SmU * SfU * SmC * SfA * SmG * SfC * SfU * SfU * SfCn001fU * SfG * SfU | 2954 | AGAAACUGUUCAGCUUCUGU | SSnX SSnX SSSSS SSSSS nX SS |

TABLE A1-continued

| | | | | |
|---|---|---|---|---|
| WV-21636 | fG * SfA * SfAn001fA * SfC * SfUn001fG * SfU * SmU * SfC * SmA * SfG * SmC * SfU * SfU * SfC * SfUn001fG * SfU * SfU | 2955 | GAAACUGUUCAGCUUCUGUU | SSnX SSnX SSSSS SSSSS nX SS |
| WV-21637 | fA * SfA * SfAn001fC * SfU * SfGn001fU * SfU * SmC * SfA * SmG * SfC * SmU * SfU * SfC * SfU * SfGn001fU * SfU * SfA | 2956 | AAACUGUUCAGCUUCUGUUA | SSnX SSnX SSSSS SSSSS nX SS |
| WV-21638 | fA * SfA * SfCn001fU * SfG * SfUn001fU * SfC * SmA * SfG * SmC * SfU * SmU * SfC * SfU * SfG * SfUn001fU * SfA * SfG | 2957 | AACUGUUCAGCUUCUGUUAG | SSnX SSnX SSSSS SSSSS nX SS |
| WV-21639 | fA * SfC * SfUn001fG * SfU * SfUn001fC * SfA * SmG * SfC * SmU * SfU * SmC * SfU * SfG * SfU * SfUn001fA * SfG * SfC | 2958 | ACUGUUCAGCUUCUGUUAGC | SSnX SSnX SSSSS SSSSS nX SS |
| WV-21640 | fC * SfU * SfGn001fU * SfU * SfCn001fA * SfG * SmC * SfU * SmU * SfC * SmU * SfG * SfU * SfU * SfAn001fG * SfC * SfC | 2959 | CUGUUCAGCUUCUGUUAGCC | SSnX SSnX SSSSS SSSSS nX SS |
| WV-21641 | fU * SfG * SfUn001fU * SfC * SfAn001fG * SfC * SmU * SfU * SmC * SfU * SmG * SfU * SfU * SfA * SfGn001fC * SfC * SfA | 2960 | UGUUCAGCUUCUGUUAGCCA | SSnX SSnX SSSSS SSSSS nX SS |
| WV-21642 | fG * SfU * SfUn001fC * SfA * SfGn001fC * SfU * SmU * SfC * SmU * SfG * SmU * SfU * SfA * SfG * SfCn001fC * SfA * SfC | 2961 | GUUCAGCUUCUGUUAGCCAC | SSnX SSnX SSSSS SSSSS nX SS |
| WV-21643 | fU * SfU * SfCn001fA * SfG * SfCn001fU * SfU * SmC * SfU * SmG * SfU * SmU * SfA * SfG * SfC * SfCn001A * SfC * SfU | 2962 | UUCAGCUUCUGUUAGCCACU | SSnX SSnX SSSSS SSSSS nX SS |
| WV-21644 | fU * SfC * SfAn001fG * SfC * SfUn001fU * SfC * SmU * SfG * SmU * SfU * SmA * SfG * SfC * SfC * SfAn001fC * SfG * SfG | 2963 | UCAGCUUCUGUUAGCCACUG | SSnX SSnX SSSSS SSSSS nX SS |
| WV-21645 | fC * SfA * SfGn001fC * SfU * SfUn001fC * SfU * SmG * SfU * SmU * SfA * SmG * SfC * SfC * SfA * SfCn001fU * SfG * SfA | 2964 | CAGCUUCUGUUAGCCACUGA | SSnX SSnX SSSSS SSSSS nX SS |
| WV-21646 | fA * SfG * SfCn001fU * SfU * SfCn001fU * SfG * SmU * SfU * SmA * SfG * SmC * SfC * SfA * SfC * SfUn001fG * SfA * SfU | 2965 | AGCUUCUGUUAGCCACUGAU | SSnX SSnX SSSSS SSSSS nX SS |
| WV-21647 | fG * SfC * SfUn001fU * SfC * SfUn001fG * SfU * SmU * SfA * SmG * SfC * SmC * SfA * SfC * SfU * SfGn001fA * SfU * SfU | 2966 | GCUUCUGUUAGCCACUGAUU | SSnX SSnX SSSSS SSSSS nX SS |
| WV-21648 | fC * SfU * SfUn001fC * SfU * SfGn001fU * SfU * SmA * SfG * SmC * SfC * SmA * SfC * SfU * SfG * SfAn001fU * SfU * SfA | 2967 | CUUCUGUUAGCCACUGAUUA | SSnX SSnX SSSSS SSSSS nX SS |
| WV-21649 | fU * SfU * SfCn001fU * SfG * SfUn001fU * SfA * SmG * SfC * SmC * SfA * SmC * SfU * SfG * SfA * SfUn001fU * SfA * SfA | 2968 | UUCUGUUAGCCACUGAUUAA | SSnX SSnX SSSSS SSSSS nX SS |
| WV-21650 | fU * SfC * SfUn001fG * SfU * SfUn001fA * SfG * SmC * SfC * SmA * SfC * SmU * SfG * SfA * SfU * SfUn001fA * SfA * SfA | 2969 | UCUGUUAGCCACUGAUUAAA | SSnX SSnX SSSSS SSSSS nX SS |
| WV-21651 | fC * SfU * SfGn001fU * SfU * SfAn001fG * SfC * SmC * SfA * SmC * SfU * SmG * SfA * SfU * SfU * SfAn001fA * SfA * SfU | 2970 | CUGUUAGCCACUGAUUAAAU | SSnX SSnX SSSSS SSSSS nX SS |
| WV-21652 | fU * SfG * SfUn001fU * SfA * SfGn001fC * SfC * SmA * SfC * SmU * SfG * SmA * SfU * SfU * SfA * SfAn001fA * SfU * SfA | 2971 | UGUUAGCCACUGAUUAAAUA | SSnX SSnX SSSSS SSSSS nX SS |
| WV-21653 | fG * SfU * SfUn001fA * SfG * SfCn001fC * SfA * SmC * SfU * SmG * SfA * SmU * SfU * SfA * SfA * SfAn001fU * SfA * SfU | 2972 | GUUAGCCACUGAUUAAAUAU | SSnX SSnX SSSSS SSSSS nX SS |

TABLE A1-continued

| | | | | |
|---|---|---|---|---|
| WV-21654 | fU * SfU * SfAn001fG * SfC * SfCn001fA * SfC * SmU * SfG * SmA * SfU * SmU * SfA * SfA * SfA * SfUn001fA * SfU * SfC | 2973 | UUAGCCACUGAUUAAAUAUC | SSnX SSnX SSSSS SSSSS nX SS |
| WV-21655 | fU * SfA * SfGn001fC * SfC * SfAn001fC * SfU * SmG * SfA * SmU * SfU * SmA * SfA * SfA * SfU * SfAn001fU * SfC * SfU | 2974 | UAGCCACUGAUUAAAUAUCU | SSnX SSnX SSSSS SSSSS nX SS |
| WV-21656 | fA * SfG * SfCn001fC * SfA * SfCn001fU * SfG * SmA * SfU * SmU * SfA * SmA * SfA * SfU * SfA * SfUn001fC * SfU * SfU | 2975 | AGCCACUGAUUAAAUAUCUU | SSnX SSnX SSSSS SSSSS nX SS |
| WV-21657 | fG * SfC * SfCn001fA * SfC * SfUn001fG * SfA * SmU * SfU * SmA * SfA * SmA * SfU * SfA * SfU * SfCn001fU * SfU * SfU | 2976 | GCCACUGAUUAAAUAUCUUU | SSnX SSnX SSSSS SSSSS nX SS |
| WV-21658 | fC * SfC * SfAn001fC * SfU * SfGn001fA * SfU * SmU * SfA * SmA * SfA * SmU * SfA * SfU * SfC * SfUn001fU * SfU * SfA | 2977 | CCACUGAUUAAAUAUCUUUA | SSnX SSnX SSSSS SSSSS nX SS |
| WV-21659 | fC * SfA * SfCn001fU * SfG * SfAn001fU * SfU * SmA * SfA * SmA * SfU * SmA * SfU * SfC * SfU * SfUn001fU * SfA * SfU | 2978 | CACUGAUUAAAUAUCUUUAU | SSnX SSnX SSSSS SSSSS nX SS |
| WV-21660 | fA * SfC * SfUn001fG * SfA * SfUn001fU * SfA * SmA * SfA * SmU * SfA * SmU * SfC * SfU * SfU * SfUn001fA * SfU * SfA | 2979 | ACUGAUUAAAUAUCUUUAUA | SSnX SSnX SSSSS SSSSS nX SS |
| WV-21661 | fC * SfU * SfGn001fA * SfU * SfUn001fA * SfA * SmA * SfU * SmA * SfU * SmC * SfU * SfU * SfU * SfAn001fU * SfA * SfU | 2980 | CUGAUUAAAUAUCUUUAUAU | SSnX SSnX SSSSS SSSSS nX SS |
| WV-21662 | fU * SfG * SfAn001fU * SfU * SfAn001fA * SfA * SmU * SfA * SmU * SfC * SmU * SfU * SfU * SfA * SfUn001fA * SfU * SfC | 2981 | UGAUUAAAUAUCUUUAUAUC | SSnX SSnX SSSSS SSSSS nX SS |
| WV-21663 | fG * SfA * SfUn001fU * SfA * SfAn001fA * SfU * SmA * SfU * SmC * SfU * SmU * SfU * SfA * SfU * SfAn001fU * SfC * SfA | 2982 | GAUUAAAUAUCUUUAUAUCA | SSnX SSnX SSSSS SSSSS nX SS |
| WV-21664 | fA * SfU * SfUn001fA * SfA * SfAn001fU * SfA * SmU * SfC * SmU * SfU * SmU * SfA * SfU * SfA * SfUn001fC * SfA * SfU | 2983 | AUUAAAUAUCUUUAUAUCAU | SSnX SSnX SSSSS SSSSS nX SS |
| WV-21665 | fU * SfU * SfAn001fA * SfA * SfUn001fA * SfU * SmC * SfU * SmU * SfU * SmA * SfU * SfA * SfU * SfCn001fA * SfU * SfA | 2984 | UUAAAUAUCUUUAUAUCAUA | SSnX SSnX SSSSS SSSSS nX SS |
| WV-21666 | fU * SfA * SfAn001fA * SfU * SfAn001fU * SfC * SmU * SfU * SmU * SfA * SmU * SfA * SfU * SfC * SfAn001fU * SfA * SfA | 2985 | UAAAUAUCUUUAUAUCAUAA | SSnX SSnX SSSSS SSSSS nX SS |
| WV-21667 | fA * SfA * SfAn001fU * SfA * SfUn001fC * SfU * SmU * SfU * SmA * SfU * SmA * SfU * SfC * SfA * SfUn001fA * SfA * SfU | 2986 | AAAUAUCUUUAUAUCAUAAU | SSnX SSnX SSSSS SSSSS nX SS |
| WV-21668 | fA * SfA * SfUn001fA * SfU * SfCn001fU * SfU * SmU * SfA * SmU * SfA * SmU * SfC * SfA * SfU * SfAn001fA * SfU * SfG | 2987 | AAUAUCUUUAUAUCAUAAUG | SSnX SSnX SSSSS SSSSS nX SS |
| WV-21669 | fA * SfU * SfAn001fU * SfC * SfUn001fU * SfU * SmA * SfU * SmA * SfU * SmC * SfA * SfU * SfA * SfAn001fU * SfG * SfA | 2988 | AUAUCUUUAUAUCAUAAUGA | SSnX SSnX SSSSS SSSSS nX SS |
| WV-21670 | fU * SfA * SfUn001fC * SfU * SfUn001fU * SfA * SmU * SfA * SmU * SfC * SmA * SfU * SfA * SfA * SfUn001fG * SfA * SfA | 2989 | UAUCUUUAUAUCAUAAUGAA | SSnX SSnX SSSSS SSSSS nX SS |
| WV-21671 | fA * SfU * SfCn001fU * SfU * SfUn001fA * SfU * SmA * SfU * SmC * SfA * SmU * SfA * SfA * SfU * SfUn001fA * SfA * SfA | 2990 | AUCUUUAUAUCAUAAUGAAA | SSnX SSnX SSSSS SSSSS nX SS |

TABLE A1-continued

| | | | | |
|---|---|---|---|---|
| WV-21672 | fU * SfC * SfUn001fU * SfU * SfAn001fU * SfA * SmU * SfC * SmA * SfU * SmA * SfA * SfU * SfG * SfAn001fA * SfA * SfA | 2991 | UCUUUAUAUCAUAAUGAAAA | SSnX SSnX SSSSS SSSSS nX SS |
| WV-21673 | fC * SfU * SfUn001fU * SfA * SfUn001fA * SfU * SmC * SfA * SmU * SfA * SmA * SfU * SfG * SfA * SfAn001fA * SfA * SfC | 2992 | CUUUAUAUCAUAAUGAAAAC | SSnX SSnX SSSSS SSSSS nX SS |
| WV-21723 | fC * SfU * SfGn001fA * SfA * SfUn001fU * SfA * SmU * SfU * SmU * SfC * SmU * SfU * SfC * SfC * SfCn001fC * SfA * SfG | 2993 | CUGAAUUAUUUCUUCCCCAG | SSnX SSnX SSSSS SSSSS nX SS |
| WV-21724 | fU * SfG * SfAn001fA * SfU * SfUn001fA * SfU * SmU * SfU * SmC * SfU * SmU * SfC * SfC * SfC * SfCn001fA * SfG * SfU | 2994 | UGAAUUAUUUCUUCCCCAGU | SSnX SSnX SSSSS SSSSS nX SS |
| WV-21725 | fG * SfA * SfAn001fU * SfU * SfAn001fU * SfU * SmU * SfC * SmU * SfU * SmC * SfC * SfC * SfC * SfAn001fG * SfU * SfU | 2995 | GAAUUAUUUCUUCCCCAGUU | SSnX SSnX SSSSS SSSSS nX SS |
| WV-21726 | fA * SfA * SfUn001fU * SfA * SfUn001fU * SfU * SmC * SfU * SmU * SfC * SmC * SfU * SfC * SfA * SfGn001fU * SfU * SfG | 2996 | AAUUAUUUCUUCCCCAGUUG | SSnX SSnX SSSSS SSSSS nX SS |
| WV-21727 | fA * SfU * SfUn001fA * SfU * SfUn001fU * SfC * SmU * SfU * SmC * SfC * SmC * SfC * SfA * SfG * SfUn001fU * SfG * SfC | 2997 | AUUAUUUCUUCCCCAGUUGC | SSnX SSnX SSSSS SSSSS nX SS |
| WV-21728 | fU * SfU * SfAn001fU * SfU * SfUn001fC * SfU * SmU * SfC * SmC * SfC * SmC * SfA * SfG * SfU * SfUn001fG * SfC * SfA | 2998 | UUAUUUCUUCCCCAGUUGCA | SSnX SSnX SSSSS SSSSS nX SS |
| WV-21729 | fU * SfA * SfUn001fU * SfU * SfCn001fU * SfU * SmC * SfC * SmC * SfC * SmA * SfG * SfU * SfU * SfGn001fC * SfA * SfU | 2999 | UAUUUCUUCCCCAGUUGCAU | SSnX SSnX SSSSS SSSSS nX SS |
| WV-21730 | fA * SfU * SfUn001fU * SfC * SfUn001fU * SfC * SmC * SfC * SmC * SfA * SmG * SfU * SfU * SfG * SfCn001fA * SfU * SfU | 3000 | AUUUCUUCCCCAGUUGCAUU | SSnX SSnX SSSSS SSSSS nX SS |
| WV-21731 | fU * SfU * SfUn001fC * SfU * SfUn001fC * SfC * SmC * SfC * SmA * SfG * SmU * SfU * SfG * SfC * SfAn001fU * SfU * SfC | 3001 | UUUCUUCCCCAGUUGCAUUC | SSnX SSnX SSSSS SSSSS nX SS |
| WV-21732 | fU * SfU * SfCn001fU * SfU * SfCn001fC * SfU * SmC * SfA * SmG * SfU * SmU * SfG * SfC * SfA * SfUn001fU * SfC * SfA | 3002 | UUCUUCCCCAGUUGCAUUCA | SSnX SSnX SSSSS SSSSS nX SS |
| WV-21733 | fU * SfC * SfUn001fU * SfC * SfCn001fC * SfC * SmA * SfG * SmU * SfU * SmG * SfC * SfA * SfU * SfUn001fC * SfA * SfA | 3003 | UCUUCCCCAGUUGCAUUCAA | SSnX SSnX SSSSS SSSSS nX SS |
| WV-21734 | fC * SfU * SfUn001fC * SfC * SfCn001fC * SfA * SmG * SfU * SmU * SfG * SmC * SfA * SfU * SfU * SfCn001fA * SfA * SfU | 3004 | CUUCCCCAGUUGCAUUCAAU | SSnX SSnX SSSSS SSSSS nX SS |
| WV-21735 | fU * SfU * SfCn001fC * SfC * SfCn001fA * SfG * SmU * SfU * SmG * SfC * SmA * SfU * SfU * SfC * SfAn001fA * SfU * SfG | 3005 | UUCCCCAGUUGCAUUCAAUG | SSnX SSnX SSSSS SSSSS nX SS |
| WV-21736 | fU * SfC * SfCn001fC * SfC * SfAn001fG * SfU * SmU * SfG * SmC * SfA * SmU * SfU * SfC * SfA * SfAn001fU * SfG * SfU | 3006 | UCCCCAGUUGCAUUCAAUGU | SSnX SSnX SSSSS SSSSS nX SS |
| WV-21737 | fC * SfC * SfCn001fC * SfA * SfGn001fU * SfU * SmG * SfC * SmA * SfU * SmU * SfC * SfA * SfA * SfUn001fG * SfU * SfU | 3007 | CCCCAGUUGCAUUCAAUGUU | SSnX SSnX SSSSS SSSSS nX SS |

TABLE A1-continued

| | | | | |
|---|---|---|---|---|
| WV-21738 | fC * SfC * SfCn001fA * SfG * SfUn001fU * SfG * SmC * SfA * SmU * SfU * SmC * SfA * SfA * SfU * SfUn001fU * SfU * SfC | 3008 | CCCAGUUGCAUUCAAUGUUC | SSnX SSnX SSSSS SSSSS nX SS |
| WV-21739 | fC * SfC * SfAn001fG * SfU * SfUn001fG * SfC * SmA * SfU * SmU * SfC * SmA * SfA * SfU * SfG * SfUn001fU * SfC * SfU | 3009 | CCAGUUGCAUUCAAUGUUCU | SSnX SSnX SSSSS SSSSS nX SS |
| WV-21740 | fC * SfA * SfGn001fU * SfU * SfGn001fC * SfA * SmU * SfU * SmC * SfA * SmA * SfU * SfG * SfU * SfUn001fC * SfU * SfG | 3010 | CAGUUGCAUUCAAUGUUCUG | SSnX SSnX SSSSS SSSSS nX SS |
| WV-21741 | fA * SfG * SfUn001fU * SfG * SfCn001fA * SfU * SmU * SfC * SmA * SfA * SmU * SfG * SfU * SfU * SfCn001fU * SfG * SfA | 3011 | AGUUGCAUUCAAUGUUCUGA | SSnX SSnX SSSSS SSSSS nX SS |
| WV-21742 | fG * SfU * SfUn001fG * SfC * SfAn001fU * SfU * SmC * SfA * SmA * SfU * SmG * SfU * SfU * SfC * SfUn001fG * SfA * SfC | 3012 | GUUGCAUUCAAUGUUCUGAC | SSnX SSnX SSSSS SSSSS nX SS |
| WV-21743 | fU * SfU * SfUn001fC * SfA * SfUn001fU * SfC * SmA * SfA * SmU * SfG * SmU * SfU * SfC * SfU * SfGn001fA * SfC * SfA | 3013 | UUGCAUUCAAUGUUCUGACA | SSnX SSnX SSSSS SSSSS nX SS |
| WV-21744 | fU * SfG * SfCn001fA * SfU * SfUn001fC * SfA * SmA * SfU * SmG * SfU * SmU * SfC * SfU * SfG * SfAn001fC * SfA * SfA | 3014 | UGCAUUCAAUGUUCUGACAA | SSnX SSnX SSSSS SSSSS nX SS |
| WV-21745 | fG * SfC * SfAn001fU * SfU * SfCn001fA * SfA * SmU * SfG * SmU * SfU * SmC * SfU * SfG * SfA * SfCn001fA * SfA * SfC | 3015 | GCAUUCAAUGUUCUGACAAC | SSnX SSnX SSSSS SSSSS nX SS |
| WV-21746 | fC * SfA * SfUn001fU * SfC * SfAn001fA * SfU * SmG * SfU * SmU * SfC * SmU * SfG * SfA * SfC * SfAn001fA * SfC * SfA | 3016 | CAUUCAAUGUUCUGACAACA | SSnX SSnX SSSSS SSSSS nX SS |
| WV-21747 | fA * SfU * SfUn001fC * SfA * SfAn001fU * SfG * SmU * SfU * SmC * SfU * SmG * SfA * SfA * SfA * SfAn001fC * SfA * SfG | 3017 | AUUCAAUGUUCUGACAACAG | SSnX SSnX SSSSS SSSSS nX SS |
| WV-21748 | fU * SfU * SfCn001fA * SfA * SfUn001fG * SfU * SmU * SfC * SmU * SfG * SmA * SfC * SfA * SfA * SfCn001fA * SfG * SfU | 3018 | UUCAAUGUUCUGACAACAGU | SSnX SSnX SSSSS SSSSS nX SS |
| WV-21749 | fU * SfC * SfAn001fA * SfU * SfGn001fU * SfU * SmC * SfU * SmG * SfA * SmC * SfA * SfA * SfC * SfAn001fG * SfU * SfU | 3019 | UCAAUGUUCUGACAACAGUU | SSnX SSnX SSSSS SSSSS nX SS |
| WV-21750 | fC * SfA * SfAn001fU * SfG * SfUn001fU * SfC * SmU * SfG * SmA * SfC * SmA * SfA * SfC * SfA * SfGn001fU * SfU * SfU | 3020 | CAAUGUUCUGACAACAGUUU | SSnX SSnX SSSSS SSSSS nX SS |
| WV-21751 | fA * SfA * SfUn001fG * SfU * SfUn001fC * SfU * SmG * SfA * SmC * SfA * SmA * SfC * SfA * SfG * SfUn001fU * SfU * SfG | 3021 | AAUGUUCUGACAACAGUUUG | SSnX SSnX SSSSS SSSSS nX SS |
| WV-21752 | fA * SfU * SfGn001fU * SfU * SfCn001fU * SfG * SmA * SfC * SmA * SfA * SmC * SfA * SfG * SfU * SfUn001fU * SfG * SfC | 3022 | AUGUUCUGACAACAGUUUGC | SSnX SSnX SSSSS SSSSS nX SS |
| WV-21753 | fU * SfG * SfUn001fU * SfC * SfUn001fG * SfA * SmC * SfA * SmA * SfC * SmA * SfG * SfU * SfU * SfUn001fG * SfC * SfC | 3023 | UGUUCUGACAACAGUUUGCC | SSnX SSnX SSSSS SSSSS nX SS |
| WV-21754 | fG * SfU * SfUn001fC * SfU * SfGn001fA * SfC * SmA * SfA * SmC * SfA * SmG * SfU * SfU * SfU * SfGn001fC * SfC * SfG | 3024 | GUUCUGACAACAGUUUGCCG | SSnX SSnX SSSSS SSSSS nX SS |
| WV-21755 | fU * SfU * SfCn001fU * SfG * SfAn001fC * SfA * SmA * SfC * SmA * SfG * SmU * SfU * SfU * SfG * SfCn001fC * SfG * SfC | 3025 | UUCUGACAACAGUUUGCCGC | SSnX SSnX SSSSS SSSSS nX SS |

TABLE A1-continued

| | | | | |
|---|---|---|---|---|
| WV-21756 | fU * SfC * SfUn001fG * SfA * SfCn0001fA * SfA * SmC * SfA * SmG * SfU * SmU * SfU * SfG * SfC * SfCn001fG * SfC * SfU | 3026 | UCUGACAACAGUUUGCCGCU | SSnX SSnX SSSSS SSSSS nX SS |
| WV-21757 | fC * SfU * SfGn001fA * SfC * SfAn001fA * SfC * SmA * SfG * SmU * SfU * SmU * SfG * SfC * SfC * SfGn001fC * SfU * SfG | 3027 | CUGACAACAGUUUGCCGCUG | SSnX SSnX SSSSS SSSSS nX SS |
| WV-21758 | fU * SfG * SfAn001fC * SfA * SfAn001fC * SfA * SmG * SfU * SmU * SfU * SmG * SfC * SfC * SfG * SfCn001fU * SfG * SfC | 3028 | UGACAACAGUUUGCCGCUGC | SSnX SSnX SSSSS SSSSS nX SS |
| WV-21759 | fG * SfA * SfCn001fA * SfA * SfCn001fA * SfG * SmU * SfU * SmU * SfG * SmC * SfC * SfG * SfC * SfUn001fG * SfC * SfC | 3029 | GACAACAGUUUGCCGCUGCC | SSnX SSnX SSSSS SSSSS nX SS |
| WV-21760 | fA * SfC * SfAn001fA * SfC * SfAn001fG * SfU * SmU * SfU * SmG * SfC * SmC * SfG * SfC * SfU * SfGn001fC * SfC * SfC | 3030 | ACAACAGUUUGCCGCUGCCC | SSnX SSnX SSSSS SSSSS nX SS |
| WV-21761 | fC * SfA * SfAn001fC * SfA * SfGn001fU * SfU * SmU * SfG * SmC * SfC * SmG * SfC * SfU * SfG * SfCn001fC * SfC * SfA | 3031 | CAACAGUUUGCCGCUGCCCA | SSnX SSnX SSSSS SSSSS nX SS |
| WV-21762 | fA * SfA * SfCn001fA * SfG * SfUn001fU * SfU * SmG * SfC * SmC * SfG * SmC * SfU * SfG * SfC * SfUn001fC * SfA * SfA | 3032 | AACAGUUUGCCGCUGCCCAA | SSnX SSnX SSSSS SSSSS nX SS |
| WV-21763 | fA * SfC * SfAn001fG * SfU * SfUn001fU * SfG * SmC * SfC * SmG * SfC * SmU * SfG * SfC * SfC * SfCn001fA * SfA * SfU | 3033 | ACAGUUUGCCGCUGCCCAAU | SSnX SSnX SSSSS SSSSS nX SS |
| WV-21764 | fC * SfA * SfGn001fU * SfU * SfUn001fG * SfC * SmC * SfG * SmC * SfU * SmG * SfC * SfC * SfC * SfAn001fA * SfU * SfG | 3034 | CAGUUUGCCGCUGCCCAAUG | SSnX SSnX SSSSS SSSSS nX SS |
| WV-21765 | fA * SfG * SfUn001fU * SfU * SfGn001fC * SfC * SmG * SfC * SmU * SfG * SmC * SfC * SfC * SfA * SfAn001fU * SfG * SfC | 3035 | AGUUUGCCGCUGCCCAAUGC | SSnX SSnX SSSSS SSSSS nX SS |
| WV-21766 | fG * SfU * SfUn001fU * SfG * SfCn001fC * SfG * SmC * SfU * SmG * SfC * SmC * SfC * SfA * SfA * SfUn001fG * SfC * SfC | 3036 | GUUUGCCGCUGCCCAAUGCC | SSnX SSnX SSSSS SSSSS nX SS |
| WV-21767 | fU * SfU * SfUn001fG * SfC * SfCn001fG * SfC * SmU * SfG * SmC * SfC * SmC * SfA * SfA * SfU * SfGn001fC * SfC * SfA | 3037 | UUUGCCGCUGCCCAAUGCCA | SSnX SSnX SSSSS SSSSS nX SS |
| WV-21768 | fU * SfU * SfGn001fC * SfC * SfGn001fC * SfU * SmG * SfC * SmC * SfC * SmA * SfA * SfU * SfG * SfCn001fC * SfA * SfU | 3038 | UUGCCGCUGCCCAAUGCCAU | SSnX SSnX SSSSS SSSSS nX SS |
| WV-21769 | fU * SfG * SfCn001fC * SfG * SfCn001fU * SfG * SmC * SfC * SmC * SfA * SmA * SfU * SfG * SfC * SfCn001fA * SfU * SfC | 3039 | UGCCGCUGCCCAAUGCCAUC | SSnX SSnX SSSSS SSSSS nX SS |
| WV-21770 | fG * SfC * SfCn001fG * SfC * SfUn001fG * SfC * SmC * SfC * SmA * SfA * SmU * SfG * SfC * SfC * SfAn001fU * SfC * SfC | 3040 | GCCGCUGCCCAAUGCCAUCC | SSnX SSnX SSSSS SSSSS nX SS |
| WV-21771 | fC * SfC * SfGn001fC * SfU * SfGn001fC * SfC * SmC * SfA * SmA * SfU * SmG * SfC * SfC * SfA * SfUn001fC * SfC * SfU | 3041 | CCGCUGCCCAAUGCCAUCCU | SSnX SSnX SSSSS SSSSS nX SS |
| WV-21772 | fA * SfU * SfUn001fU * SfU * SfGn001fG * SfG * SmC * SfA * SmG * SfC * SmG * SfG * SfU * SfA * SfAn001fU * SfG * SfA | 3042 | AUUUUGGGCAGCGGUAAUGA | SSnX SSnX SSSSS SSSSS nX SS |
| WV-21773 | fU * SfU * SfUn001fU * SfG * SfGn001fG * SfC * SmA * SfG * SmC * SfG * SmG * SfU * SfA * SfA * SfUn001fG * SfA * SfG | 3043 | UUUUGGGCAGCGGUAAUGAG | SSnX SSnX SSSSS SSSSS nX SS |

TABLE A1-continued

| | | | | |
|---|---|---|---|---|
| WV-21774 | fU * SfU * SfUn001fG * SfG * SfGn001fC * SfA * SmG * SfC * SmG * SfG * SmU * SfA * SfA * SfU * SfGn001fA * SfG * SfU | 3044 | UUUGGGCAGCGGUAAUGAGU | SSnX SSnX SSSSS SSSSS nX SS |
| WV-21775 | fU * SfU * SfGn001fG * SfG * SfCn001fA * SfG * SmC * SfG * SmG * SfU * SmA * SfA * SfU * SfG * SfAn001fG * SfU * SfU | 3045 | UUGGGCAGCGGUAAUGAGUU | SSnX SSnX SSSSS SSSSS nX SS |
| WV-21776 | fU * SfG * SfGn001fG * SfC * SfAn001fG * SfC * SmG * SfG * SmU * SfA * SmA * SfU * SfG * SfA * SfGn00fU * SfU * SfC | 3046 | UGGGCAGCGGUAAUGAGUUC | SSnX SSnX SSSSS SSSSS nX SS |
| WV-21777 | fG * SfG * SfGn001fC * SfA * SfGn001fC * SfG * SmG * SfU * SmA * SfA * SmU * SfG * SfA * SfG * SfUn001fU * SfC * SfU | 3047 | GGGCAGCGGUAAUGAGUUCU | SSnX SSnX SSSSS SSSSS nX SS |
| WV-21778 | fG * SfG * SfCn001fA * SfG * SfCn001fG * SfG * SmU * SfA * SmA * SfU * SmG * SfA * SfG * SfU * SfUn001fC * SfU * SfU | 3048 | GGCAGCGGUAAUGAGUUCUU | SSnX SSnX SSSSS SSSSS nX SS |
| WV-21779 | fG * SfC * SfAn001fG * SfC * SfGn001fG * SfU * SmA * SfA * SmU * SfG * SmA * SfG * SfU * SfU * SfCn001fU * SfU * SfC | 3049 | GCAGCGGUAAUGAGUUCUUC | SSnX SSnX SSSSS SSSSS nX SS |
| WV-21780 | fC * SfA * SfGn001fC * SfG * SfGn001fU * SfA * SmA * SfU * SmG * SfA * SmG * SfU * SfU * SfC * SfUn001fU * SfC * SfC | 3050 | CAGCGGUAAUGAGUUCUUCC | SSnX SSnX SSSSS SSSSS nX SS |
| WV-21781 | fA * SfG * SfCn001fG * SfG * SfUn001fA * SfA * SmU * SfG * SmA * SfG * SmU * SfU * SfC * SfU * SfUn001fC * SfC * SfA | 3051 | AGCGGUAAUGAGUUCUUCCA | SSnX SSnX SSSSS SSSSS nX SS |
| WV-21782 | fG * SfC * SfGn001fG * SfU * SfAn001fA * SfU * SmG * SfA * SmG * SfU * SmU * SfC * SfU * SfU * SfCn001fC * SfA * SfA | 3052 | GCGGUAAUGAGUUCUUCCAA | SSnX SSnX SSSSS SSSSS nX SS |
| WV-21783 | fC * SfG * SfGn001fU * SfA * SfAn001fU * SfG * SmA * SfG * SmU * SfU * SmC * SfU * SfU * SfC * SfCn001fA * SfA * SfC | 3053 | CGGUAAUGAGUUCUUCCAAC | SSnX SSnX SSSSS SSSSS nX SS |
| WV-21784 | fG * SfG * SfUn001fA * SfA * SfUn001fG * SfA * SmG * SfU * SmU * SfC * SmU * SfU * SfC * SfC * SfAn001fA * SfC * SfU | 3054 | GGUAAUGAGUUCUUCCAACU | SSnX SSnX SSSSS SSSSS nX SS |
| WV-21785 | fG * SfU * SfAn001fA * SfU * SfGn001fA * SfG * SmU * SfU * SmC * SfU * SmU * SfC * SfC * SfA * SfAn001fC * SfU * SfG | 3055 | GUAAUGAGUUCUUCCAACUG | SSnX SSnX SSSSS SSSSS nX SS |
| WV-21786 | fU * SfA * SfAn001fU * SfG * SfAn001fG * SfU * SmU * SfC * SmU * SfU * SmC * SfC * SfA * SfA * SfCn001fU * SfG * SfG | 3056 | UAAUGAGUUCUUCCAACUGG | SSnX SSnX SSSSS SSSSS nX SS |
| WV-21787 | fA * SfA * SfUn001fG * SfA * SfGn001fU * SfU * SmC * SfU * SmU * SfC * SmC * SfA * SfA * SfC * SfUn001fG * SfG * SfG | 3057 | AAUGAGUUCUUCCAACUGGG | SSnX SSnX SSSSS SSSSS nX SS |
| WV-21788 | fA * SfU * SfGn001fA * SfG * SfUn001fU * SfC * SmU * SfU * SmC * SfC * SmA * SfA * SfC * SfU * SfGn001fG * SfG * SfG | 3058 | AUGAGUUCUUCCAACUGGGG | SSnX SSnX SSSSS SSSSS nX SS |
| WV-21789 | fU * SfG * SfAn001fG * SfU * SfUn001fC * SfU * SmU * SfC * SmC * SfA * SmA * SfC * SfU * SfG * SfGn001fG * SfG * SfA | 3059 | UGAGUUCUUCCAACUGGGGA | SSnX SSnX SSSSS SSSSS nX SS |
| WV-21790 | fG * SfA * SfGn001fU * SfU * SfCn001fU * SfU * SmC * SfC * SmA * SfA * SmC * SfU * SfG * SfG * SfGn001fG * SfA * SfC | 3060 | GAGUUCUUCCAACUGGGGAC | SSnX SSnX SSSSS SSSSS nX SS |

TABLE A1-continued

| | | | | |
|---|---|---|---|---|
| WV-21791 | fA * SfG * SfUn001fU * SfC * SfUn001fU * SfC * SmC * SfA * SmA * SfC * SmU * SfG * SfG * SfG * SfGn001fA * SfC * SfG | 3061 | AGUUCUUCCAACUGGGGACG | SSnX SSnX SSSSS SSSSS nX SS |
| WV-21792 | fG * SfU * SfUn001fC * SfU * SfUn001fC * SfC * SmA * SfA * SmC * SfU * SmG * SfG * SfG * SfG * SfAn001fC * SfG * SfC | 3062 | GUUCUUCCAACUGGGGACGC | SSnX SSnX SSSSS SSSSS nX SS |
| WV-21793 | fU * SfU * SfCn001fU * SfU * SfCn001fC * SfA * SmA * SfC * SmU * SfG * SmG * SfG * SfG * SfA * SfCn001fG * SfC * SfC | 3063 | UUCUUCCAACUGGGGACGCC | SSnX SSnX SSSSS SSSSS nX SS |
| WV-21794 | fU * SfC * SfUn001fU * SfC * SfCn001fA * SfA * SmC * SfU * SmG * SfG * SmG * SfG * SfA * SfC * SfGn001fC * SfC * SfU | 3064 | UCUUCCAACUGGGGACGCCU | SSnX SSnX SSSSS SSSSS nX SS |
| WV-21795 | fC * SfU * SfUn001fC * SfC * SfAn001fA * SfC * SmU * SfG * SmG * SfG * SmG * SfA * SfC * SfG * SfCn001fC * SfU * SfC | 3065 | CUUCCAACUGGGGACGCCUC | SSnX SSnX SSSSS SSSSS nX SS |
| WV-21796 | fU * SfU * SfCn001fC * SfA * SfAn001fC * SfU * SmG * SfG * SmG * SfG * SmA * SfC * SfG * SfC * SfCn001fU * SfC * SfU | 3066 | UUCCAACUGGGGACGCCUCU | SSnX SSnX SSSSS SSSSS nX SS |
| WV-21797 | fU * SfC * SfCn001fA * SfA * SfCn001fU * SfG * SmG * SfG * SmG * SfA * SmC * SfG * SfC * SfC * SfUn001fC * SfU * SfG | 3067 | UCCAACUGGGGACGCCUCUG | SSnX SSnX SSSSS SSSSS nX SS |
| WV-21798 | fC * SfC * SfAn001fA * SfC * SfUn001fG * SfG * SmG * SfG * SmA * SfC * SmG * SfC * SfC * SfU * SfCn001fU * SfG * SfU | 3068 | CCAACUGGGGACGCCUCUGU | SSnX SSnX SSSSS SSSSS nX SS |
| WV-21799 | fC * SfA * SfAn001fC * SfU * SfGn001fG * SfG * SmG * SfA * SmC * SfG * SmC * SfC * SfU * SfC * SfUn001fG * SfU * SfU | 3069 | CAACUGGGGACGCCUCUGUU | SSnX SSnX SSSSS SSSSS nX SS |
| WV-21800 | fA * SfA * SfCn001fU * SfG * SfGn001fG * SfG * SmA * SfC * SmG * SfC * SmC * SfU * SfC * SfU * SfGn001fU * SfU * SfC | 3070 | AACUGGGGACGCCUCUGUUC | SSnX SSnX SSSSS SSSSS nX SS |
| WV-21801 | fA * SfC * SfUn001fG * SfG * SfGn001fG * SfA * SmC * SfG * SmC * SfC * SmU * SfC * SfU * SfG * SfUn001fU * SfC * SfC | 3071 | ACUGGGGACGCCUCUGUUCC | SSnX SSnX SSSSS SSSSS nX SS |
| WV-21802 | fC * SfU * SfGn001fG * SfG * SfGn001fA * SfC * SmG * SfC * SmC * SfU * SmC * SfU * SfG * SfU * SfUn001fC * SfC * SfA | 3072 | CUGGGGACGCCUCUGUUCCA | SSnX SSnX SSSSS SSSSS nX SS |
| WV-21803 | fU * SfG * SfGn001fG * SfG * SfAn001fC * SfG * SmC * SfC * SmU * SfC * SmU * SfG * SfU * SfU * SfCn001fC * SfA * SfA | 3073 | UGGGGACGCCUCUGUUCCAA | SSnX SSnX SSSSS SSSSS nX SS |
| WV-21804 | fG * SfG * SfGn001fG * SfA * SfCn001fG * SfC * SmC * SfU * SmC * SfU * SmG * SfU * SfU * SfC * SfCn001fA * SfA * SfA | 3074 | GGGGACGCCUCUGUUCCAAA | SSnX SSnX SSSSS SSSSS nX SS |
| WV-21805 | fG * SfG * SfGn001fA * SfC * SfGn001fC * SfC * SmU * SfC * SmU * SfG * SmU * SfU * SfC * SfC * SfAn001fA * SfA * SfU | 3075 | GGGACGCCUCUGUUCCAAAU | SSnX SSnX SSSSS SSSSS nX SS |
| WV-21806 | fG * SfG * SfAn001fC * SfG * SfCn001fC * SfU * SmC * SfU * SmG * SfU * SmU * SfC * SfC * SfA * SfAn001fA * SfU * SfC | 3076 | GGACGCCUCUGUUCCAAAUC | SSnX SSnX SSSSS SSSSS nX SS |
| WV-21807 | fG * SfA * SfCn001fG * SfC * SfCn001fU * SfC * SmU * SfG * SmU * SfU * SmC * SfC * SfA * SfA * SfAn001fU * SfC * SfC | 3077 | GACGCCUCUGUUCCAAAUCC | SSnX SSnX SSSSS SSSSS nX SS |
| WV-21808 | fA * SfC * SfGn001fC * SfC * SfUn001fC * SfU * SmG * SfU * SmU * SfC * SmC * SfA * SfA * SfA * SfUn001fC * SfC * SfU | 3078 | ACGCCUCUGUUCCAAAUCCU | SSnX SSnX SSSSS SSSSS nX SS |

TABLE A1-continued

| | | | | |
|---|---|---|---|---|
| WV-21809 | fC * SfG * SfCn001fC * SfU * SfCn001fU * SfG * SmU * SfU * SmC * SfC * SmA * SfA * SfA * SfU * SfCn001fC * SfU * SfG | 3079 | CGCCUCUGUUCCAAAUCCUG | SSnX SSnX SSSSS SSSSS nX SS |
| WV-21810 | fG * SfC * SfCn001fU * SfC * SfUn001fG * SfU * SmU * SfC * SmC * SfA * SmA * SfA * SfU * SfC * SfCn001fU * SfG * SfC | 3080 | GCCUCUGUUCCAAAUCCUGC | SSnX SSnX SSSSS SSSSS nX SS |
| WV-21811 | fC * SfC * SfUn001fC * SfU * SfGn001fU * SfU * SmC * SfC * SmA * SfA * SmA * SfU * SfC * SfC * SfUn001fG * SfC * SfA | 3081 | CCUCUGUUCCAAAUCCUGCA | SSnX SSnX SSSSS SSSSS nX SS |
| WV-21812 | fC * SfU * SfCn001fU * SfG * SfUn001fU * SfC * SmC * SfA * SmA * SfA * SmU * SfC * SfC * SfU * SfGn001fC * SfA * SfU | 3082 | CUCUGUUCCAAAUCCUGCAU | SSnX SSnX SSSSS SSSSS nX SS |
| WV-21813 | fU * SfC * SfUn001fG * SfU * SfUn001fC * SfC * SmA * SfA * SmA * SfU * SmC * SfC * SfU * SfG * SfCn001fA * SfU * SfU | 3083 | UCUGUUCCAAAUCCUGCAUU | SSnX SSnX SSSSS SSSSS nX SS |
| WV-21814 | fC * SfU * SfGn001fU * SfU * SfCn001fC * SfA * SmA * SfA * SmU * SfC * SmC * SfU * SfG * SfC * SfAn001fU * SfU * SfG | 3084 | CUGUUCCAAAUCCUGCAUUG | SSnX SSnX SSSSS SSSSS nX SS |
| WV-21815 | fU * SfG * SfUn001fU * SfC * SfCn001fA * SfA * SmA * SfU * SmC * SfC * SmU * SfG * SfC * SfA * SfUn001fU * SfG * SfU | 3085 | UGUUCCAAAUCCUGCAUUGU | SSnX SSnX SSSSS SSSSS nX SS |
| WV-21816 | fG * SfU * SfUn001fC * SfC * SfAn001fA * SfA * SmU * SfC * SmC * SfU * SmG * SfC * SfA * SfU * SfUn001fG * SfU * SfU | 3086 | GUUCCAAAUCCUGCAUUGUU | SSnX SSnX SSSSS SSSSS nX SS |
| WV-21817 | fU * SfU * SfCn001fC * SfA * SfAn001fA * SfU * SmC * SfC * SmU * SfG * SmC * SfA * SfU * SfU * SfGn001fU * SfU * SfG | 3087 | UUCCAAAUCCUGCAUUGUUG | SSnX SSnX SSSSS SSSSS nX SS |
| WV-21818 | fU * SfC * SfCn001fA * SfA * SfAn001fU * SfC * SmC * SfU * SmG * SfC * SmA * SfU * SfU * SfG * SfUn001fU * SfG * SfC | 3088 | UCCAAAUCCUGCAUUGUUGC | SSnX SSnX SSSSS SSSSS nX SS |
| WV-22753 | fU * SfC * SfAn001RfC * SfU * SfCn001RmA * SfG * SfA * SmU * SfA * SmG * SmU * SfU * SfG * SfA * SfAn001RfG * SfC * SfC | 3089 | UCACUCAGAUAGUUGAAGCC | SSnR SSnR SSSSS SSSSS nR SS |
| WV-23576 | L009n001L009n001L009n001L009fU * SfC * SfA * SfC * SfU * SfC * SmAfG * SfA * SmU * SfA * SmGmUfU * SfG * SfA * SfA * SfG * SfC * SfC | 3090 | UCACUCAGAUAGUUGAAGCC | nX nX nX OSSSSS SOSS SSOOSSSSS S |
| WV-23577 | L009n001L009n001L009n001fU * SfC * SfA * SfC * SfU * SfC * SmAfG * SfA * SmU * SfA * SmGmUfU * SfG * SfA * SfA * SfG * SfC * SfC | 3091 | UCACUCAGAUAGUUGAAGCC | nX nX nX SSSSS SOSS SSOOSSSSS S |
| WV-23578 | L009n001L009n001L009n001L009fU * SfC * SfAn001fC * SfU * SfCn001mAfG * SfA * SmU * SfA * SmGmUfU * SfG * SfA * SfAn001fG * SfC * SfC | 3092 | UCACUCAGAUAGUUGAAGCC | nX nX nX OSSnX SSnX OSSSSOOSSSnX SS |
| WV-23579 | L009n001L009n001L009n001fU * SfC * SfAn001fC * SfU * SfCn001mAfG * SfA * SmU * SfA * SmGmUfU * SfG * SfA * SfAn001fG * SfC * SfC | 3093 | UCACUCAGAUAGUUGAAGCC | nX nX nX SSnX SSnX OSSSSOOSSSnX SS |
| WV-23936 | L010n001L010n001L010n001L009fU * SfC * SfA * SfC * SfU * SfC * SmAfG * SfA * SmU * SfA * SmGmUfU * SfG * SfA * SfA * SfG * SfC * SfC | 3094 | UCACUCAGAUAGUUGAAGCC | nX nX nX OSSSSS SOSS SSOOSSSSS S |

TABLE A1-continued

| | | | | |
|---|---|---|---|---|
| WV-23937 | L010n001L010n001L010n001fU * SfC * SfA * SfC * SfU * SfC * SmAfG * SfA * SmU * SfA * SmGmUfU * SfG * SfA * SfA * SfG * SfC * SfC | 3095 | UCACUCAGAUAGUUGAAGCC | nX nX nX SSSSS SOSS SSOOSSSSS S |
| WV-23938 | L010n001L010n001L010n001L009fU * SfC * SfAn001fC * SfU * SfCn001mAfG * SfA * SmU * SfA * SmGmUfU * SfG * SfA * SfAn001fG * SfC * SfC | 3096 | UCACUCAGAUAGUUGAAGCC | nX nX nX OSSnX SSnX OSSSSOOSSSnX SS |
| WV-23939 | L010n001L010n001L010n001fU * SfC * SfAn001fC * SfU * SfCn001mAfG * SfA * SmU * SfA * SmGmUfU * SfG * SfA * SfAn001fG * SfC * SfC | 3097 | UCACUCAGAUAGUUGAAGCC | nX nX nX SSnX SSnX OSSSSO OSSSnX SS |
| WV-XBD108 | mU * SGeon009m5Ceon009m5Ceon009mA * SG * SG * RC * ST * SG * RG * ST * ST * RA * ST * SmG * SmA * SmC * SmU * SmC | 3098 | UGCCAGGCTGGTTATGACUC | S nX nX nX SSRSS RSSRSS SSSS |
| WV-XBD 109 | mU * SGeon009Rm5Ceon009Rm5Ceon009RmA * SG * SG * RC * ST * SG * RG * ST * ST * RA * ST * SmG * SmA * SmC * SmU * SmC | 3099 | UGCCAGGCTGGTTATGACUC | S nR nR nR SSRSS RSSRSS SSSS |
| WV-XBD 110 | mU * SGeon009Sm5Ceon009Sm5Ceon009SmA * SG * SG * RC * ST * SG * RG * ST * ST * RA * ST * SmG * SmA * SmC * SmU * SmC | 3100 | UGCCAGGCTGGTTATGACUC | S nS nS nS SSRSS RSSRSS SSSS |
| WV-XKCD108 | mU * SGeon010m5Ceon010m5Ceon010mA * SG * SG * RC * ST * SG * RG * ST * ST * RA * ST * SmG * SmA * SmC * SmU * SmC | 3101 | UGCCAGGCTGGTTATGACUC | S nX nX nX SSRSS RSSRSS SSSS |
| WV-XKCD 109 | mU * SGeon010Rm5Ceon010Rm5Ceon010RmA * SG * SG * RC * ST * SG * RG * ST * ST * RA * ST * SmG * SmA * SmC * SmU * SmC | 3102 | UGCCAGGCTGGTTATGACUC | S nR nR nR SSRSS RSSRSS SSSS |
| WV-XKCD 110 | mU * SGeon010Sm5Ceon010Sm5Ceon010SmA * SG * SG * RC * ST * SG * RG * ST * ST * RA * ST * SmG * SmA * SmC * SmU * SmC | 3103 | UGCCAGGCTGGTTATGACUC | S nS nS nS SSRSS RSSRSS SSSS |
| WV-3519 | Mod032fU * fC * fA * fA * fG * fG * mAfA * mGfA * mUfG * mGfC * fA * fU * fU * fU * fC * fU | 3104 | UCAAGGAAGA UGGCAUUUCU | O XXXXX XOXOX OXO XXXXX X |
| WV-3518 | Mod031fU * fC * fA * fA * fG * fG * mAfA * mGfA * mUfG * mGfC * fA * fu * fU * fU * fC * fU | 3105 | UCAAGGAAGA UGGCAUUUCU | O XXXXX XOXOX OXO XXXXX X |
| WV-3517 | Mod030fU * fC * fA * fA * fG * fG * mAfA * mGfA * mUfG * mGfC * fA * fU * fU * fU * fC * fU | 3106 | UCAAGGAAGA UGGCAUUUCU | O XXXXX XOXOX OXO XXXXX X |
| WV-3516 | fU * fC * fA * fA * fG * fG * mAfA * mGfA * mUfG * mGfC * fA * fU * fU * fU * fC * fU | 3107 | UCAAGGAAGA UGGCAUUUCU | XXXXX XOXOX OXO XXXXX X |
| WV-3515 | fU * SfC * SfA * SfA * SfG * SfG * SmAfA * SmGmAfU * SmGmGfC * SfAfU * SfU * SfU * SfC * SfU | 3108 | UCAAGGAAGA UGGCAUUUCU | SSSSS SOSOO SOOSOSSSS |

TABLE A1-continued

| | | | | |
|---|---|---|---|---|
| WV-3514 | fU * SfC * SfA * SfA * SfG * SfG * SmAfA * SmGfAfU * SmGmGfC * SfAfU * SfU * SfU * SfC * SfU | 3109 | UCAAGGAAGA UGGCAUUUCU | SSSSS SOSOO SOOSOSSSS |
| WV-3513 | fU * SfC * SfA * SfA * SfG * SfG * SmAfA * SmGmAfU * SmGmGfC * SmAfU * SfU * SfU * SfC * SfU | 3110 | UCAAGGAAGA UGGCAUUUCU | SSSSS SOSOO SOOSOSSSS |
| WV-3512 | fU * SfC * SfA * SfA * SfG * SfG * SmAfA * SmGfAU * SmGmGfC * SmAfU * SfU * SfU * SfC * SfU | 3111 | UCAAGGAAGA UGGCAUUUCU | SSSSS SOSOO SOOSOSSSS |
| WV-3511 | fU * SfC * SfA * SfA * SfG * SfG * SmAfA * SmGmAfU * SmGmGfC * SmA * SfU * SfU * SfU * SfC * SfU | 3112 | UCAAGGAAGA UGGCAUUUCU | SSSSS SOSOO SOO SSSSS S |
| WV-3510 | fU * SfC * SfA * SfA * SfG * SfG * SmAfA * SmGfAfU * SmGmGfC * SmA * SfU * SfU * SfU * SfC * SfU | 3113 | UCAAGGAAGA UGGCAUUUCU | SSSSS SOSOO SOO SSSSS S |
| WV-3509 | fU * SfC * SfA * SfA * SfG * SfG * SmAfA * SmGmA * SfU * SmGmGfC * SfAfU * SfU * SfU * SfC * SfU | 3114 | UCAAGGAAGA UGGCAUUUCU | SSSSS SOSOS SOOSOSSSS |
| WV-3508 | fU * SfC * SfA * SfA * SfG * SfG * SmAfA * SmGfA * SfU * SmGmGfC * SfAfU * SfU * SfU * SfC * SfU | 3115 | UCAAGGAAGA UGGCAUUUCU | SSSSS SOSOS SOOSOSSSS |
| WV-3507 | fU * SfC * SfA * SfA * SfG * SfG * SmAfA * SmGmAfU * SmGmGfC * SfA * SfU * SfU * SfU * SfC * SfU | 3116 | UCAAGGAAGA UGGCAUUUCU | SSSSS SOSOO SOO SSSSS S |
| WV-27250 | fU * SfC * SfA * SfC * SfU * SfC * SmAn011fG * SfA * SmU * SfA * SmGn011mUn011fU * SfG * SfA * SfA * SfG * SfC * SfC | 3117 | UCACUCAGAUA GUUGAAGCC | SSSSS SnXSSSS nXnX SSSSS S |
| WV-27249 | fU * SfC * SfA * SfC * SfU * SfC * SmAn010fG * SfA * SmU * SfA * SmGn010mUn010fU * SfG * SfA * SfA * SfG * SfC * SfC | 3118 | UCACUCAGAUA GUUGAAGCC | SSSSS SnXSSSSnXnX SSSSS S |
| WV-24086 | fU * SfC * SfA * SfA * SfG * SfG * SmAfA * SmGmA * SfU * SmGmGfC * SfA * SfU * SfU * SfU * SfC * SfG | 3119 | UCAAGGAAGA UGGCAUUUCG | SSSSS SOSOS SOO SSSSS S |
| WV-24085 | fG * SfC * SfA * SfA * SfG * SfG * SmAfA * SmGmA * SfU * SmGmGfC * SfA * SfU * SfU * SfU * SfC * SfU | 3120 | GCAAGGAAGAU GGCAUUUCU | SSSSS SOSOS SOO SSSSS S |
| WV-22919 | fU * SfG * SfA * SfA * SfG * SfG * SmAfA * SmGmA * SfU * SmGmG * SfC * SfA * SfU * SfU * SfU * SfC * SfU | 3121 | UCAAGGAAGA UGGCAUUUCU | SSSSS SOSOS SO SSSSS SS |
| WV-22918 | fU * SfC * SfA * SfA * SfG * SfG * SmAfA * SmGmA * SfU * SmG * SmGfC * SfA * SfU * SfU * SfU * SfC * SfU | 3122 | UCAAGGAAGA UGGCAUUUCU | SSSSS SOSOS SSO SSSSS S |
| WV-22765 | fU * SfC * SfA * SfA * SfG * SfG * SmAfA * SmGmA * SfU * SmG | 3123 | UCAAGGAAGA UG | SSSSS SOSOS S |
| WV-22764 | fU * SfC * SfA * SfA * SfG * SfG * SmAfA * SmGmA * SfU * SmGmGfC * SfA | 3124 | UCAAGGAAGA UGGCA | SSSSS SOSOS SOOS |
| WV-22763 | fU * SfC * SfA * SfA * SfG * SfG * SmAfA * SmGmA * SfU * SmGmGfC * SfA * SfU | 3125 | UCAAGGAAGA UGGCAU | SSSSS SOSOS SOOSS |

TABLE A1-continued

| | | | | |
|---|---|---|---|---|
| WV-22762 | fU * SfC * SfA * SfA * SfG * SfG * SmAfA * SmGmA * SfU * SmGmGfC * SfA * SfU * SfU | 3126 | UCAAGGAAGA UGGCAUU | SSSSS SOSOS SOOSSS |
| WV-22752 | fU * SfC * SfA * SfC * SfU * SfC * SmA * SfG * SfA * SmU * SfA * SmG * SmU * SfU * SfG * SfA * SfA * SfG * SfC * SfC | 3127 | UCACUCAGAUA GUUGAAGCC | SSSSS SSSSS SSSSS SSSS |
| WV-22751 | fU * SfC * SfA * SfC * SfU * SfC * SmA * SfG * SfA * SmU * SfA * SmGmUfU * SfG * SfA * SfA * SfG * SfC * SfC | 3128 | UCACUCAGAUA GUUGAAGCC | SSSSS SSSSS SOO SSSSS S |
| WV-22750 | fU * SfC * SfA * SfC * SfU * SfC * SmAfG * SfA * SmU * SfA * SmG * SmUfU * SfG * SfA * SfA * SfG * SfC * SfC | 3129 | UCACUCAGAUA GUUGAAGCC | SSSSS SO SSSSS O SSSSS S |
| WV-22749 | fU * SfC * SfA * SfC * SfU * SfC * SmAfG * SfA * SmU * SfA * SmGmU * SfU * SfG * SfA * SfA * SfG * SfC * SfC | 3130 | UCACUCAGAUA GUUGAAGCC | SSSSS SOSSSSO SSSSS SS |
| WV-21502 | fA * SfU * SfC * SfA * SfU * SfU * SfU * SfU * SmU * SfU * SmC * SfU * SmC * SfA * SfU * SfA * SfC * SfC * SfU * SfU | 3131 | AUCAUUUUUU CUCAUACCUU | SSSSS SSSSS SSSSS SSSS |
| WV-21501 | fU * SfA * SfU * SfC * SfA * SfU * SfU * SfU * SmU * SfU * SmU * SfC * SmU * SfC * SfA * SfU * SfA * SfC * SfC * SfU | 3132 | UAUCAUUUUU UCUCAUACCU | SSSSS SSSSS SSSSS SSSS |
| WV-21500 | fU * SfU * SfA * SfU * SfC * SfA * SfU * SfU * SmU * SfU * SmU * SfU * SmC * SfU * SfC * SfA * SfU * SfA * SfC * SfC | 3133 | UUAUCAUUUUU UCUCAUACC | SSSSS SSSSS SSSSS SSSS |
| WV-21499 | fU * SfU * SfU * SfA * SfU * SfC * SfA * SfU * SmU * SfU * SmU * SfU * SmU * SfC * SfU * SfC * SfA * SfU * SfA * SfC | 3134 | UUUAUCAUUUU UUCUCAUAC | SSSSS SSSSS SSSSS SSSS |
| WV-21498 | fU * SfU * SfU * SfU * SfA * SfU * SfC * SfA * SmU * SfU * SmU * SfU * SmU * SfU * SfC * SfU * SfC * SfA * SfU * SfA | 3135 | UUUUAUCAUUUU UUCUCAUA | SSSSS SSSSS SSSSS SSSS |
| WV-21497 | fC * SfU * SfU * SfU * SfU * SfA * SfU * SfC * SmA * SfU * SmU * SfU * SmU * SfU * SfU * SfC * SfU * SfC * SfA * SfU | 3136 | CUUUUAUCAUUU UUUCUCAU | SSSSS SSSSS SSSSS SSSS |
| WV-21496 | fA * SfC * SfU * SfU * SfU * SfU * SfA * SfU * SmC * SfA * SmU * SfU * SmU * SfU * SfU * SfU * SfC * SfU * SfC * SfA | 3137 | ACUUUUAUCAUU UUUUCUCA | SSSSS SSSSS SSSSS SSSS |
| WV-21495 | fA * SfA * SfC * SfU * SfU * SfU * SfU * SfA * SmU * SfC * SmA * SfU * SmU * SfU * SfU * SfU * SfU * SfC * SfU * SfC | 3138 | AACUUUUAUCAU UUUUUCUC | SSSSS SSSSS SSSSS SSSS |
| WV-21494 | fC * SfA * SfA * SfC * SfU * SfU * SfU * SfU * SmA * SfU * SmC * SfA * SmU * SfU * SfU * SfU * SfU * SfU * SfC * SfU | 3139 | CAACUUUUAUCAU UUUUUCU | SSSSS SSSSS SSSSS SSSS |
| WV-21493 | fC * SfC * SfA * SfA * SfC * SfU * SfU * SfU * SmU * SfA * SmU * SfC * SmA * SfU * SfU * SfU * SfU * SfU * SfU * SfU | 3140 | CCAACUUUUAU CAUUUUUUC | SSSSS SSSSS SSSSS SSSS |
| WV-21492 | fG * SfC * SfC * SfA * SfA * SfC * SfU * SfU * SmU * SfU * SmA * SfU * SmC * SfA * SfU * SfU * SfU * SfU * SfU * SfU | 3141 | GCCAACUUUUA UCAUUUUUU | SSSSS SSSSS SSSSS SSSS |
| WV-21491 | fU * SfG * SfC * SfC * SfA * SfA * SfC * SfU * SmU * SfU * SmU * SfA * SmU * SfC * SfA * SfU * SfU * SfU * SfU * SfU | 3142 | UGCCAACUUUU AUCAUUUUU | SSSSS SSSSS SSSSS SSSS |
| WV-21490 | fC * SfU * SfG * SfC * SfC * SfA * SfA * SfC * SmU * SfU * SmU * SfU * SmA * SfU * SfC * SfA * SfU * SfU * SfU * SfU | 3143 | CUGCCAACUUUU AUCAUUUU | SSSSS SSSSS SSSSS SSSS |

TABLE A1-continued

| | | | | |
|---|---|---|---|---|
| WV-21489 | fU * SfC * SfU * SfG * SfC * SfC * SfA * SfA * SmC * SfU * SmU * SfU * SmU * SfA * SfU * SfC * SfA * SfU * SfU * SfU | 3144 | UCUGCCAACUUUUAUCAUUU | SSSSS SSSSS SSSSS SSSS |
| WV-21488 | fU * SfU * SfC * SfU * SfG * SfC * SfC * SfA * SmA * SfC * SmU * SfU * SmU * SfU * SfA * SfU * SfC * SfA * SfU * SfU | 3145 | UUCUGCCAACUUUUAUCAUU | SSSSS SSSSS SSSSS SSSS |
| WV-21487 | fC * SfU * SfU * SfC * SfU * SfG * SfC * SfC * SmA * SfA * SmC * SfU * SmU * SfU * SfU * SfA * SfU * SfC * SfA * SfU | 3146 | CUUCUGCCAACUUUUAUCAU | SSSSS SSSSS SSSSS SSSS |
| WV-21373 | fC * SfU * SfCfC * SfG * SfGfU * SfU * SmCfU * SmG * SfA * SmAfG * SfG * SfU * SfGfU * SfU * SfC | 3147 | CUCCGGUUCUGAAGGUGUUC | SSOSS OSSOS SSOSS SOSS |

In Table A1 (including Table A1.1., Table A1.2, Table A1.3, etc.):

Spaces in Table A1 are utilized for formatting and readability, e.g., OXXXXX XXXXX XXXXX XXXX illustrates the same stereochemistry as OXXXXXXXXXXXXXXX; *S and *S both indicate phosphorothioate internucleotidic linkage wherein the linkage phosphorus has Sp configuration; etc.

All oligonucleotides listed in Tables A1 are single-stranded. As described in the present application, they may be used as a single strand, or as a strand to form complexes with one or more other strands.

Some sequences, due to their length, are divided into multiple lines.

ID: Identification number for an oligonucleotide.

WV-8806, WV-13405, WV-13406 and WV-13407 are fully PMO(morpholino oligonucleotides; [all PMO] in Table).

Abbreviations in Tables:

m5Ceo: 5-Methyl 2'-Methoxyethyl C ( 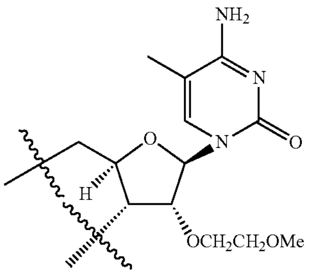 );

5MS: 5'-(S)—$CH_3$ modification of sugar moieties;

5MSfC: 2'-F-5'-(S)-methyl C (in oligonucleotides,

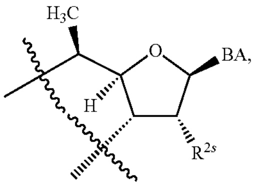

wherein in BA is nucleobase C and $R^{2s}$ is —F, and the 5' and 3' positions independently connect to —OH, internucleotidic linkages, linkers/linkages-H, linkers/linkages-Mod, etc. Nucleoside form is

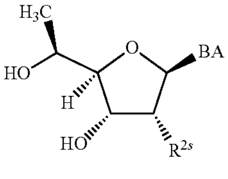

wherein in BA is nucleobase C and $R^{2s}$ is —F);

C6: C6 amino linker (L001, —NH—$(CH_2)_6$— wherein —NH— is connected to Mod (e.g., through —C(O)— in Mod) or —H, and —$(CH_2)_6$— is connected to the 5'-end (or 3'-end if indicated) of oligonucleotide chain through, e.g., phosphodiester (—O—P(O)(OH)—O—. May exist as a salt form. May be illustrated in the Tables as O or PO), phosphorothioate (—O—P(O)(SH)—O—. May exist as a salt form. May be illustrated in the Tables as * if the phosphorothioate not chirally controlled; *S, S, or Sp, if chirally controlled and has an Sp configuration, and *R, R, or Rp, if chirally controlled and has an Rp configuration), or phosphorodithioate (—O—P(S)(SH)—O—. May exist as a salt form. May be illustrated in the Tables as PS2 or : or D) linkage. May also be referred to as C6 linker or C6 amine linker);

: or D: Phosphodithioate (Phosphorodithioate), represented by D or a colon (:);

n001: non-negatively charged linkage

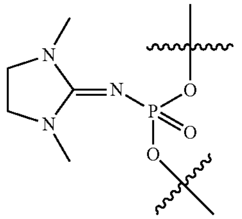

(which is stereorandom unless otherwise indicated (e.g., as n001R, or n001S));

n002: non-negatively charged linkage

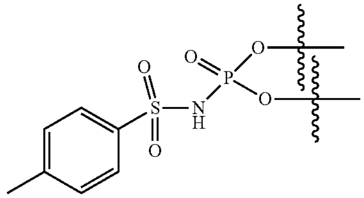

(which is stereorandom unless otherwise indicated (e.g., as n002R, or n002S));

n003: non-negatively charged linkage

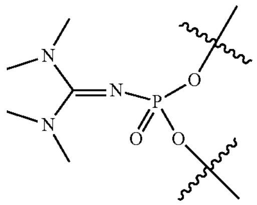

(which is stereorandom unless otherwise indicated (e.g., as n003R, or n003S));

n004: non-negatively charged linkage

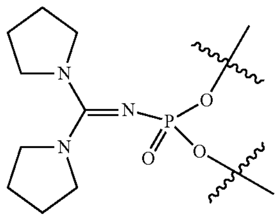

(which is stereorandom unless otherwise indicated (e.g., as n004R, or n004S);

n005: non-negatively charged linkage

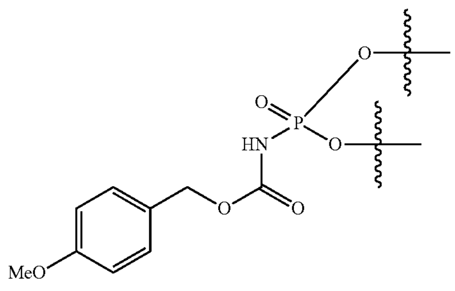

(which is stereorandom unless otherwise indicated (e.g., as n005R, or n005S));

n006: non-negatively charged linkage

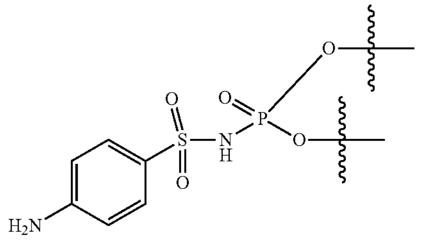

(which is stereorandom unless otherwise indicated (e.g., as n006R, or n006S));

n007: non-negatively charged linkage

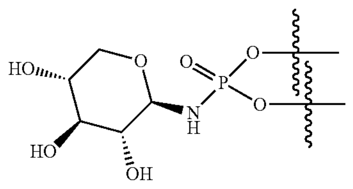

(which is stereorandom at linkage phosphorus unless otherwise indicated (e.g., as n007R, or n007S));

n008: non-negatively charged linkage

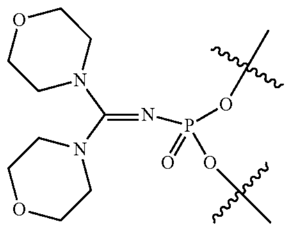

(which is stereorandom unless otherwise indicated (e.g., as n008R, or n008S));

n009: non-negatively charged linkage

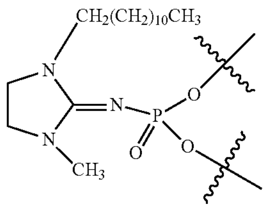

(which is stereorandom unless otherwise indicated (e.g., as n009R, or n009S));

n010: non-negatively charged linkage

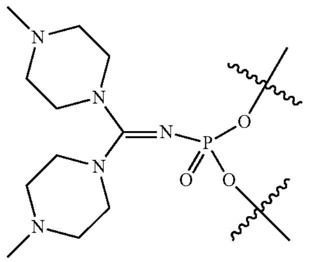

(which is stereorandom unless otherwise indicated (e.g., as n010R, or n010S));

n001R: n001 being chirally controlled and having the Rp configuration;

n002R: n002 being chirally controlled and having the Rp configuration;

n003R: n003 being chirally controlled and having the Rp configuration;

n004R: n004 being chirally controlled and having the Rp configuration;

n005R: n005 being chirally controlled and having the Rp configuration;

n006R: n006 being chirally controlled and having the Rp configuration;

n007R: n007 being chirally controlled and having the Rp configuration;

n008R: n008 being chirally controlled and having the Rp configuration;

n009R: n009 being chirally controlled and having the Rp configuration;

n010R: n010 being chirally controlled and having the Rp configuration;

n001S: n001 being chirally controlled and having the Sp configuration;

n002S: n002 being chirally controlled and having the Sp configuration;

n003S: n003 being chirally controlled and having the Sp configuration;

n004S: n004 being chirally controlled and having the Sp configuration;

n005S: n005 being chirally controlled and having the Sp configuration;

n006S: n006 being chirally controlled and having the Sp configuration;

n007S: n007 being chirally controlled and having the Sp configuration;

n008S: n008 being chirally controlled and having the Sp configuration;

n009S: n009 being chirally controlled and having the Sp configuration;

n010S: n010 being chirally controlled and having the Sp configuration;

nO, nX: in Linkage/Stereochemistry, nO or nX indicates a stereorandom n001;

nR: in Linkage/Stereochemistry, nR indicates a linkage, e.g., n001, n002, n003, n004, n005, n006, n007, n008, n009, etc., being chirally controlled and having the Rp configuration (e.g., for n001, n001R in Description);

nS: in Linkage/Stereochemistry, nS indicates a linkage, e.g., n001, n002, n003, n004, n005, n006, n007, n008, n009, etc., being chirally controlled and having the Sp configuration (e.g., for n001, n001R in Description);

BrfU: a nucleoside unit wherein the nucleobase is BrU

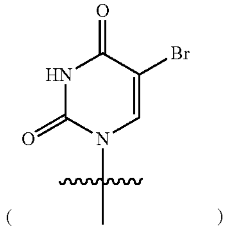 [SMILES: *n1cc(Br)c(=O)[nH]c1=O]

and wherein the sugar has a 2'-F (f) modification

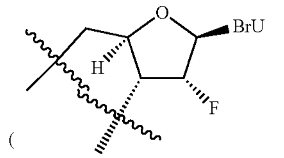;

BrmU: a nucleoside unit wherein the nucleobase is BrU

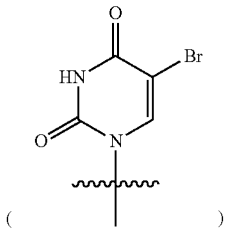 [SMILES: *n1cc(Br)c(=O)[nH]c1=O]

and wherein the sugar has a 2'-OMe (m) modification

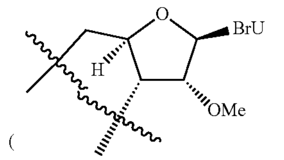;

BrdU: a nucleoside unit wherein the nucleobase is BrU

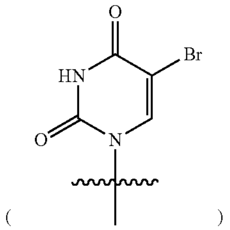 [SMILES: *n1cc(Br)c(=O)[nH]c1=O]

and wherein the sugar is 2-deoxyribose (as widely found in natural DNA; 2'-deoxy (d))

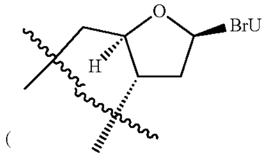;

L004: linker having the structure of —$NH(CH_2)_4CH(CH_2OH)CH_2$—, wherein —NH— is connected to Mod (e.g., through —C(O)— in Mod) or —H, and the —$CH_2$— connecting site is connected to a linkage, e.g., phosphodiester (—O—P(O)(OH)—O—. May exist as a salt form. May be illustrated in the Tables as O or PO), phosphorothioate (—O—P(O)(SH)—O—. May exist as a salt form. May be illustrated in the Tables as * if the phosphorothioate not chirally controlled; *S, S, or Sp, if chirally controlled and has an Sp configuration, and *R, R, or Rp, if chirally controlled and has an Rp configuration), or phosphorodithioate (—O—P(S)(SH)—O—. May exist as a salt form. May be illustrated in the Tables as PS2 or : or D) linkage, at the 5'- or 3'-end of an oligonucleotide chain as indicated. For example, an asterisk immediately preceding a L004 (e.g., *L004) indicates that the linkage is a phosphorothioate linkage, and the absence of the indication of any other linkage immediately preceding L004 indicates that the linkage is a phosphodiester linkage. For example, in WV-9858, which terminates in fUL004, the linker L004 is connected (via the —$CH_2$— site) to the phosphodiester linkage at the 3' position at the 3'-terminal sugar (which is 2'-F and connected to the nucleobase U), and the L004 linker is connected via —NH— to —H;

similarly, in WV-10886, WV-10887, and WV-10888, the L004 linker is connected (via the —$CH_2$— site) to the phosphodiester linkage at the 3' position of the 3'-terminal sugar, and the L004 is connected via —NH— to Mod012 (WV-10886), Mod085 (WV-10887) or Mod086 (WV-10888);

L005: linker having the structure of —$NH(CH_2)_5C(O)N(CH_2CH_2OH)\ CH_2CH_2$—, wherein —NH— is connected to Mod (e.g., through —C(O)— in Mod) or —H, and the —$CH_2$— connecting site is connected to a linkage, e.g., phosphodiester (—O—P(O)(OH)—O—. May exist as a salt form. May be illustrated in the Tables as O or PO), phosphorothioate (—O—P(O)(SH)—O—. May exist as a salt form. May be illustrated in the Tables as * if the phosphorothioate not chirally controlled; *S, S, or Sp, if chirally controlled and has an Sp configuration, and *R, R, or Rp, if chirally controlled and has an Rp configuration), or phosphorodithioate (—O—P(S)(SH)—O—. May exist as a salt form. May be illustrated in the Tables as PS2 or : or D) linkage, at the 5'- or 3'-end of an oligonucleotide chain as indicated. For example, an asterisk immediately preceding a L005 (e.g., *L005) indicates that the linkage is a phosphorothioate linkage, and the absence of the indication of any other linkage immediately preceding L005 indicates that the linkage is a phosphodiester linkage. For example, in WV-12571, L005 is connected to —H (no Mod following L005; via the —NH— site) and the phosphodiester linkage at the 3' position of the 3'-terminal sugar (via the —$CH_2$— site); and in WV-12572, L005 is connected to Mod020 (via the —NH— site) and the phosphodiester linkage at the 3' position of the 3'-terminal sugar (via the —$CH_2$— site);

L001L005: linker having the structure of —$NH(CH_2)_5C(O)N(CH_2CH_2$—O—P(O)(OH)—O—$(CH_2)_6NH$—)$CH_2CH_2$—, wherein each of the two —NH— is independently connected to Mod (e.g., through —C(O)—) or —H, and the —$CH_2$— connecting site is connected to a linkage, e.g., phosphodiester (—O—P(O)(OH)—O—. May exist as a salt form. May be illustrated in the Tables as O or PO), phosphorothioate (—O—P(O)(SH)—O—. May exist as a salt form. May be illustrated in the Tables as * if the phosphorothioate not chirally controlled; *S, S, or Sp, if chirally controlled and has an Sp configuration, and *R, R, or Rp, if chirally controlled and has an Rp configuration), or phosphorodithioate (—O—P(S)(SH)—O—. May exist as a salt form. May be illustrated in the Tables as PS2 or: or D) linkage at the 5'- or 3'-end of an oligonucleotide chain as indicated.

eo: 2'-MOE (2'-$OCH_2CH_2OCH_3$) modification on the preceding nucleoside (e.g., Aeo (

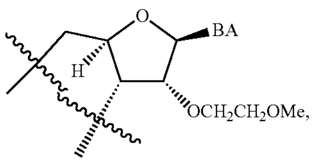

wherein BA is nucleobase A));

F, f: 2'-F modification on the following nucleoside (e.g., fA (

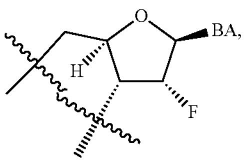

wherein BA is nucleobase A)), m: 2'-OMe modification on the following nucleoside (e.g., mA (

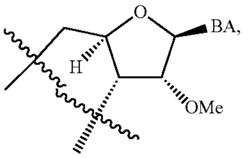

wherein BA is nucleobase A));

r: 2'-OH on the following nucleoside (e.g., rA (

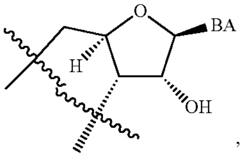

, wherein BA is nucleobase A, as existed in natural RNA));

L012: internucleotidic linkage having the structure of —O—P(O)[$O(CH_2)_2O(CH_2)_2O(CH_2)_2OH$]—O—. May be illustrated as OO in the Tables;

*, PS: Phosphorothioate;

PS2,: D: phosphorodithioate (e.g., WV-3078, wherein a colon (:) indicates a phosphorodithioate);

*R, R, Rp: Phosphorothioate in Rp conformation;

*S, S, Sp: Phosphorothioate in Sp conformation;

X: Phosphorothioate stereorandom;

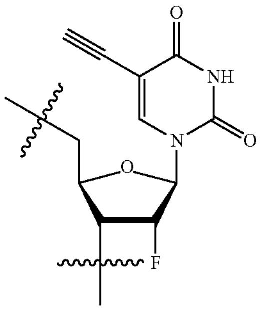

Acet5fU

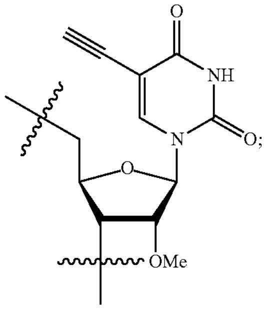

Acet5mU

NA: Not Applicable;

O, PO: phosphodiester (phosphate). When no internucleotidic linkage is specified between two nucleoside units, the internucleotidic linkage is a phosphodiester linkage (natural phosphate linkage).

When used to indicate linkage between Mod and a linker, e.g., L001, O may indicate —C(O)— (connecting Mod and L001, for example:

Mod013L001fU*SfC*SfA*SfA*SfG*SfG*SmAfA*SmGmA*SfU*SmGmGfC*SfA*SfU*SfU*SfU*SfC*SfU (SEQ ID NO: 3148) (Description), OOSSSSSSOSOSSOOSSSSSS (Linkage/Stereochemistry). Note the second O in OOSSSSSSOSOSSOOSSSSSS (Linkage/Stereochemistry) represents phosphodiester linkage connecting L001 and the 5'-O— of the 5'-terminal sugar of the oligonucleotide chain (see illustrations below. Alternatively, the 5'-O— may be considered part of the phosphodiester linkage (or another type of linkage such as a phosphorothioate linkage), in which case the phosphodiester linkage (or another type of linkage such as phosphorothioate linkage) is connected to the 5' position of the 5'-terminal sugar of the oligonucleotide chain). In some instances, "O" for —C(O)— (connecting Mod and L001) is omitted (e.g., for Mod013L001fU*SfC*SfA*SfA*SfG*SfG*SmAfA*SmGmA*SfU*SmGmGfC*SfA*SfU*SfU*SfU*SfC*SfU (SEQ ID NO: 3148), "Linkage/Stereochemistry" OSSSSSSOSOSSOOSSSSSS);

Various Mods:

Mod001 (with —C(O)— connecting to, e.g., —NH— of a linker such as L001):

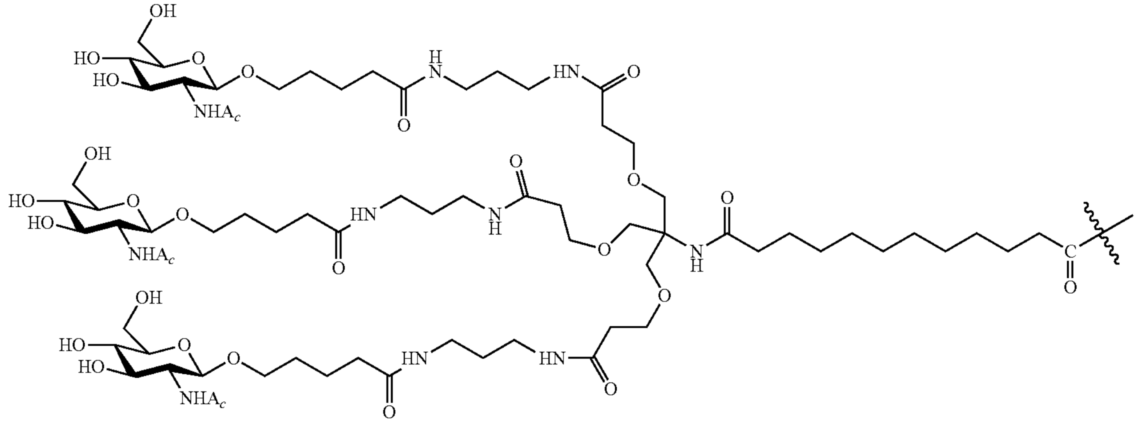

Lauric (in Mod013), Myristic (in Mod014), Palmitic (in Mod005), Stearic (in Mod015), Oleic (in Mod016), Linoleic (in Mod017), alpha-Linoleinc (in Mod018), gamma-Linolenic (in Mod019), DHA (in Mod006), Turbinaric (in Mod020), Dilinoleic (in Mod021), TriGlcNAc (in Mod024), TrialphaMannose (in Mod026), MonoSulfonamide (in Mod 027), TriSulfonamide (in Mod029), Lauric (in Mod030), Myristic (in Mod031), Palmitic (in Mod032), and Stearic (in Mod033): Lauric acid (for Mod013), Myristic acid (for Mod014), Palmitic acid (for Mod005), Stearic acid (for Mod015), Oleic acid (for Mod016), Linoleic acid (for Mod017), alpha-Linolenic acid (for Mod018), gamma-Linolenic acid (for Mod019), docosahexaenoic acid (for Mod006), Turbinaric acid (for Mod020), alcohol for Dilinoleyl (for Mod021), acid for TriGlcNAc (for Mod024), acid for TrialphaMannose (for Mod026), acid for MonoSulfonamide (for Mod 027), acid for TriSulfonamide (for Mod029), Lauryl alcohol (for Mod030), Myristyl alcohol (for Mod031), Palmityl alcohol (for Mod032), and Stearyl alcohol (for Mod033), respectively, conjugated to oligonucleotide chains, e.g., through an amide group, a linker (e.g., C6 amino linker, (L001)), and/or a linkage group (e.g., phosphodiester linkage (PO), phosphorothioate linkage (PS), etc.): e.g., Mod013 (Lauric acid with C6 amino linker and PO or PS), Mod014 (Myristic acid with C6 amino linker and PO or PS), Mod005 (Palmitic acid with C6 amino linker and PO or PS), Mod015 (Stearic acid with C6 amino linker and PO or PS), Mod016 (Oleic acid with C6 amino linker and PO or PS), Mod017 (Linoleic acid with C6 amino linker and PO or PS), Mod018 (alpha-Linolenic acid with C6 amino linker and PO or PS), Mod019 (gamma-Linolenic acid with C6 amino linker and PO or PS), Mod006 (DHA with C6 amino linker and PO or PS), Mod020 (Turbinaric acid with C6 amino linker and PO or PS), Mod021 (alcohol (see below) with PO or PS), Mod024 (acid (see below) with C6 amino linker and PO or PS), Mod026 (acid (see below) with C6 amino linker and PO or PS), Mod027 (acid (see below) with C6 amino linker and PO or PS), Mod029 (acid (see below) with C6 amino linker and PO or PS), Mod030 (Lauryl alcohol with PO or PS), Mod031 (Myristyl alcohol with PO or PS), Mod032 (Palmityl alcohol with PO or PS), and Mod033 (Stearyl alcohol with PO or PS), with PO or PS for each oligonucleotide indicated in Table A1. For example, WV-3557 Stearyl alcohol conjugated to oligonucleotide chain of WV-3473 via PS:

Mod033*fU*SfC*SfA*SfA*SfG*SfG*SmAfA*SmGmA*SfU*SmGmGfC*SfA*SfU*SfU*SfU*SfC*SfU (SEQ ID NO: 3149) (Description), XSSSSSSOSOSSOOSSSSSS (Stereochemistry); and WV-4106 Stearic acid conjugated to oligonucleotide chain of WV-3473 via amide group, C6, and PS:

Mod015L001*fU*SfC*SfA*SfA*SfG*SfG*SmAfA*SmGmA*SfU*SmGmGfC*SfA*SfU*SfU*SfU*Sf C*SfU (SEQ ID NO: 3150) (Description), XSSSSSSOSOSSOOSSSSSS (Stereochemistry). Certain moieties for conjugation, and example reagents (many of which were previously known and are commercially available or can be readily prepared using known technologies in accordance with the present disclosure, e.g., Lauric acid (for Mod013), Myristic acid (for Mod014), Palmitic acid (for Mod005), Stearic acid (for Mod015), Oleic acid (for Mod016), Linoleic acid (for Mod017), alpha-Linolenic acid (for Mod018), gamma-Linolenic acid (for Mod019), docosahexaenoic acid (for Mod006), Turbinaric acid (for Mod020), alcohol for Dilinoleyl (for Mod021), Lauryl alcohol (for Mod030), Myristyl alcohol (for Mod031), Palmityl alcohol (for Mod032), Stearyl alcohol (for Mod033), etc.) are listed below. Certain example moieties (e.g., lipid moieties, targeting moiety, etc.) and/or example preparation reagents (e.g., acids, alcohols, etc.) for conjugation to oligonucleotide chains include the below with a non-limiting example of a linker:

Mod005 (with —C(O)— connecting to, e.g., —NH— of a linker such as L001) and Palmitic acid:

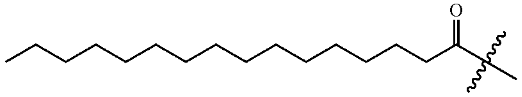

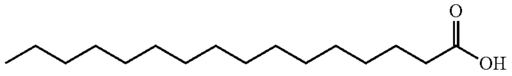

Mod005L001 (with PO or PS connecting to 5'-O— of an oligonucleotide chain):

Mod009 (with —C(O)— connecting to, e.g., —NH— of a linker such as L001):

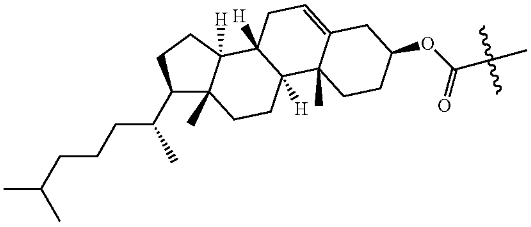 [SMILES: *C(=O)O[C@H]1CC[C@@]2(C)C(=CC[C@H]3[C@@H]4CC[C@H]([C@H](C)CCCC(C)C)[C@@]4(C)CC[C@@H]32)C1]

Mod012 (with —C(O)— connecting to, e.g., NH— of a linker such as L001):

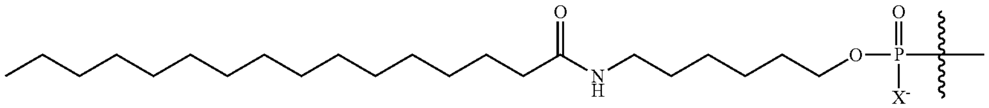

X = O or S

Mod006 (with —C(O)— connecting to, e.g., —NH— of a linker such as L001) and DHA:

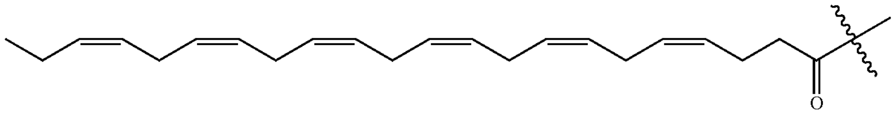

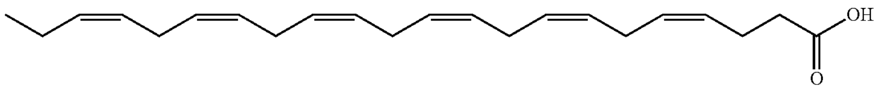

Mod006L001 (with PO or PS connecting to 5'-O— of an oligonucleotide chain):

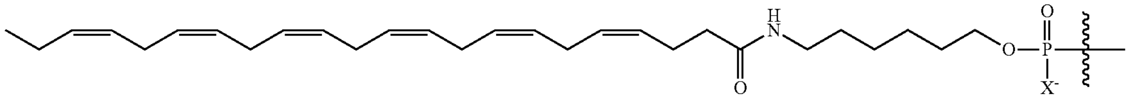

X = O or S

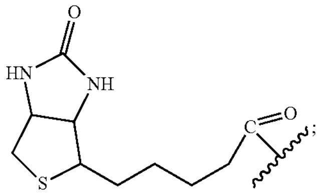 [SMILES: *C(=O)CCCCC1SCC2NC(=O)NC21]

Mod013 (with —C(O)— connecting to, e.g., —NH— of a linker such as L001) and Lauric acid:

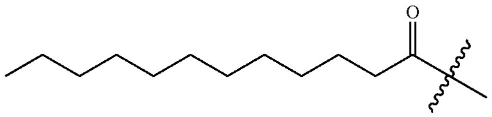

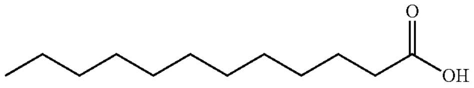

Mod013L001 (with PO or PS connecting to 5'-O— of an oligonucleotide chain):

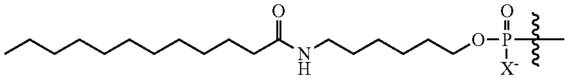

X = O or S

Mod014 (with —C(O)— connecting to, e.g., —NH— of a linker such as L001) and Myristic acid:

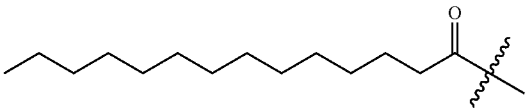

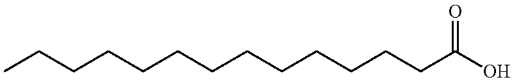

Mod014L001 (with PO or PS connecting to 5'-O— of an oligonucleotide chain):

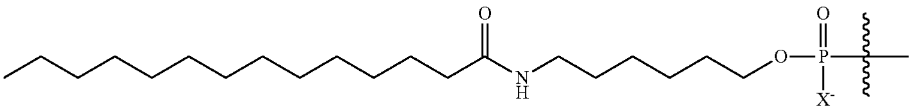

X = O or S

Mod015 (with —C(O)— connecting to, e.g., —NH— of a linker such as L001) and Stearic acid:

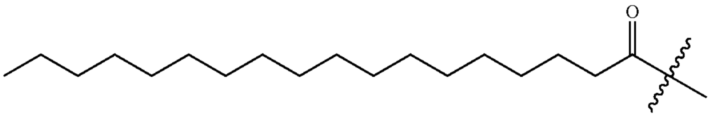

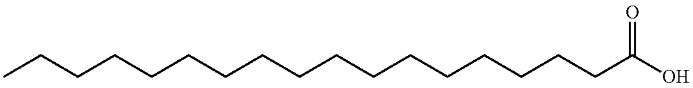

Mod015L001 (with PO or PS connecting to 5'-O— of an oligonucleotide chain):

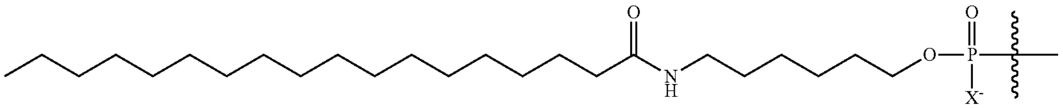

X = O or S

Mod016 (with —C(O)— connecting to, e.g., —NH— of a linker such as L001) and Oleic acid:

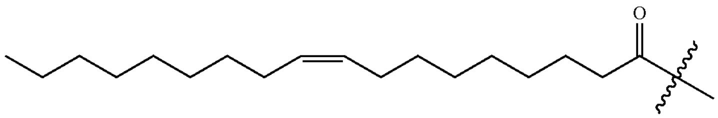

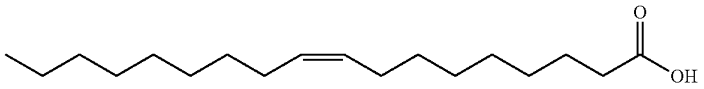

Mod016L001 (with PO or PS connecting to 5'-O— of an oligonucleotide chain):

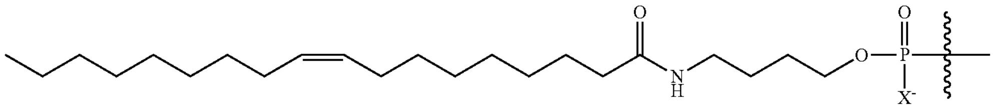

X = O or S

Mod017 (with —C(O)— connecting to, e.g., —NH— of a linker such as L001) and Linoleic acid:

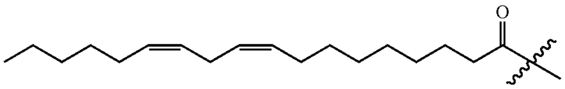

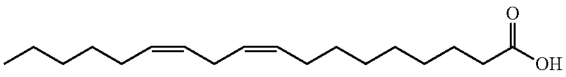

Mod 017L001 (with PO or PS connecting to 5'-O— of an oligonucleotide chain):

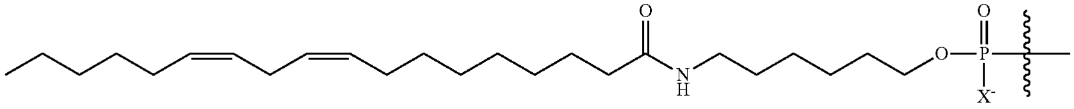

X = O or S

Mod018 (with —C(O)— connecting to, e.g., —NH— of a linker such as L001) and alpha-Linolenic acid:

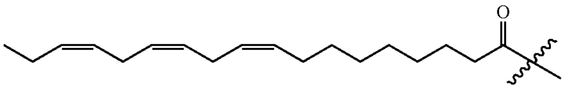

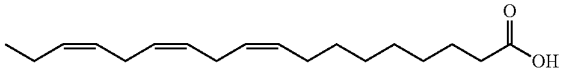

Mod018L001 (with PO or PS connecting to 5'-O— of an oligonucleotide chain):

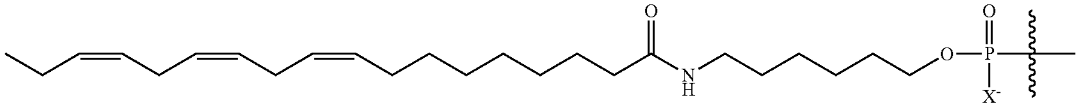
X = O or S
Mod019 (with —C(O)— connecting to, e.g., —NH— of a linker such as L001) and gamma-Linolenic acid:
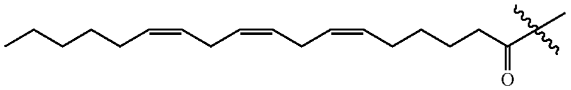
-continued
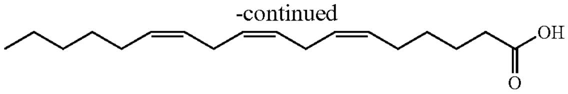
Mod019L001 (with PO or PS connecting to 5'-O— of an oligonucleotide chain):
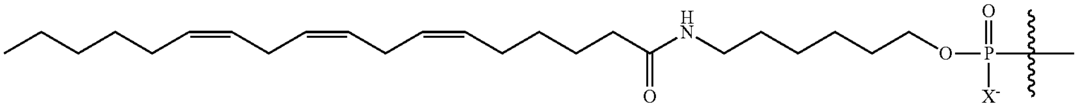
X = O or S
Mod020 (with —C(O)— connecting to, e.g., —NH— of a linker such as L001) and Turbinaric acid:
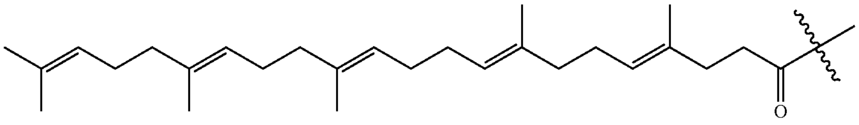
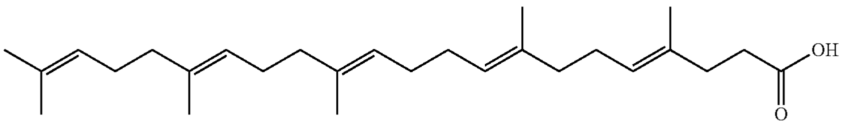
Mod020L001 (with PO or PS connecting to 5'-O— of an oligonucleotide chain):
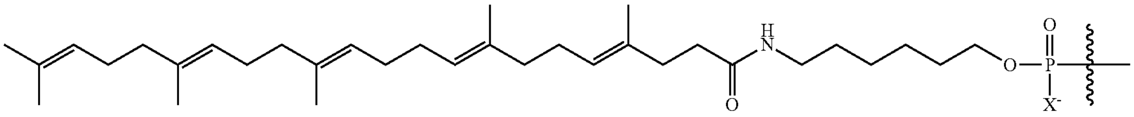
X = O or S Mod021 (with PO or PS connecting to 5'-O— of an oligonucleotide chain) and alcohol:
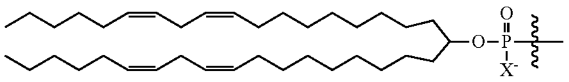
-continued
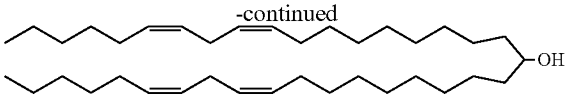
X = O or S
Mod024 (with —C(O)— connecting to, e.g., —NH— of a linker such as L001) and acid:
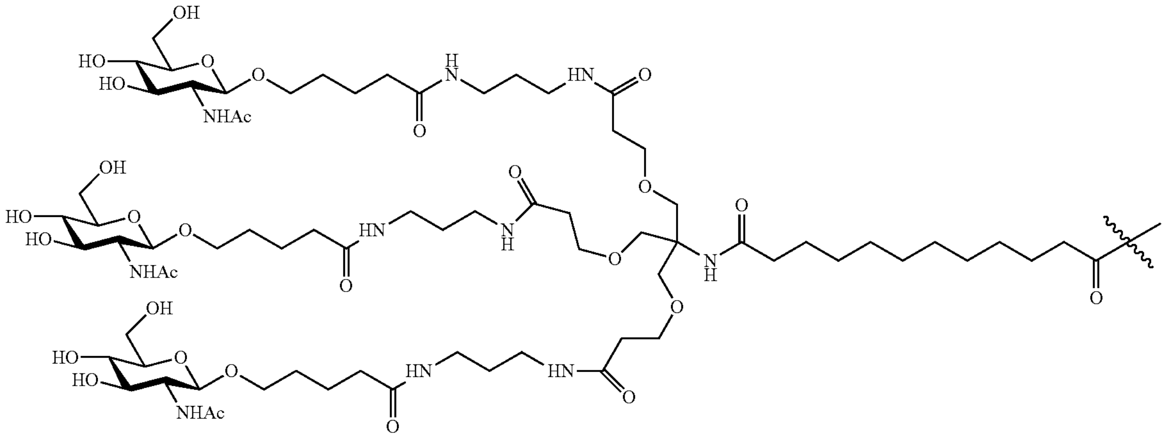
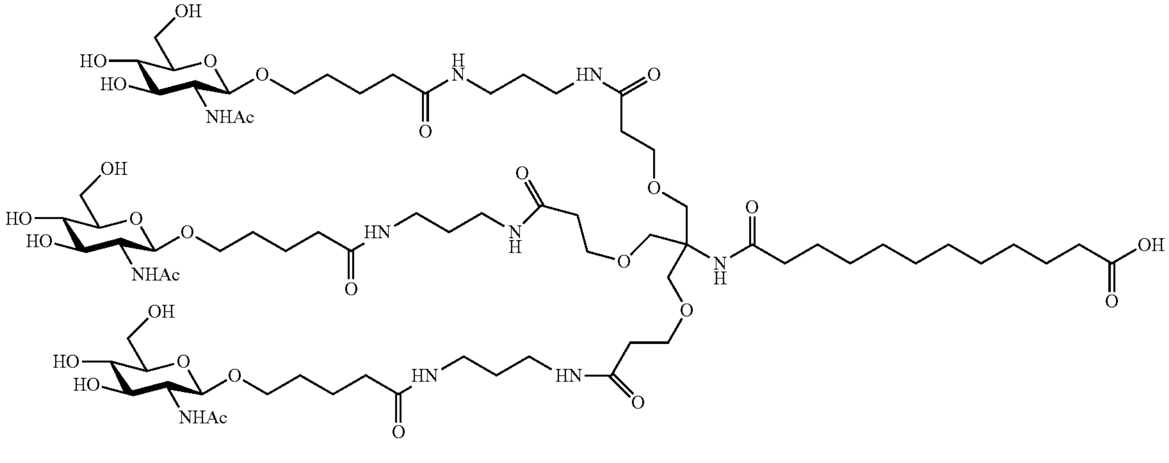

Mod024L001 (with PO or PS connecting to 5'-O— of an oligonucleotide chain):
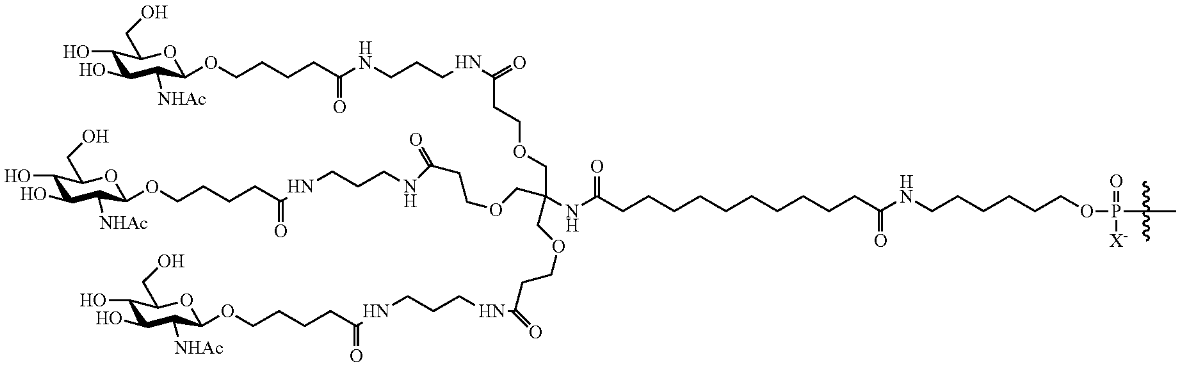
X = O or S
Mod026 (with —C(O)— connecting to, e.g., —NH— of a linker such as L001) and acid:
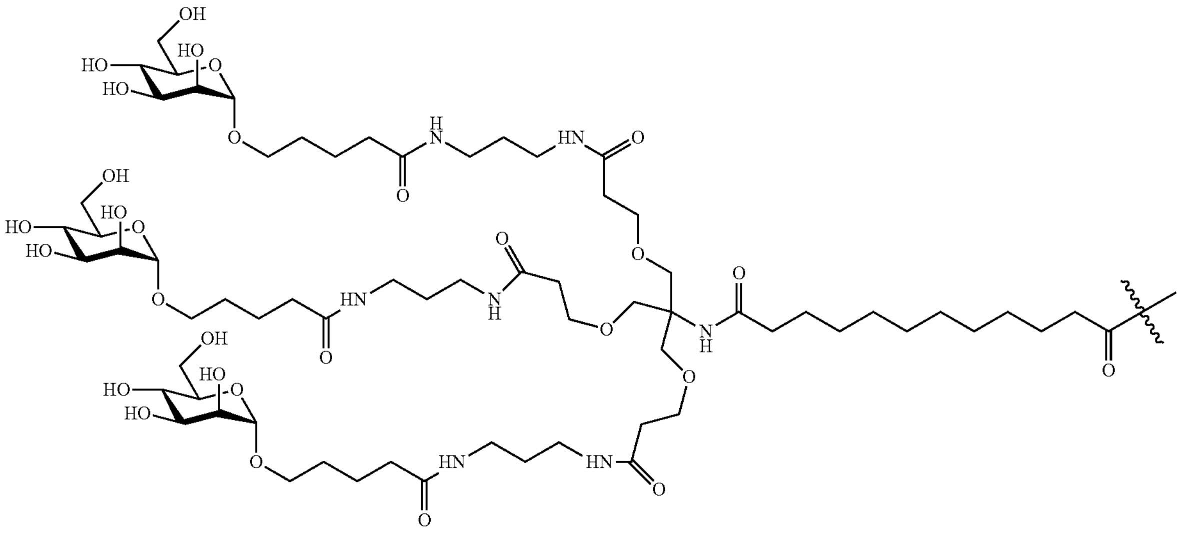
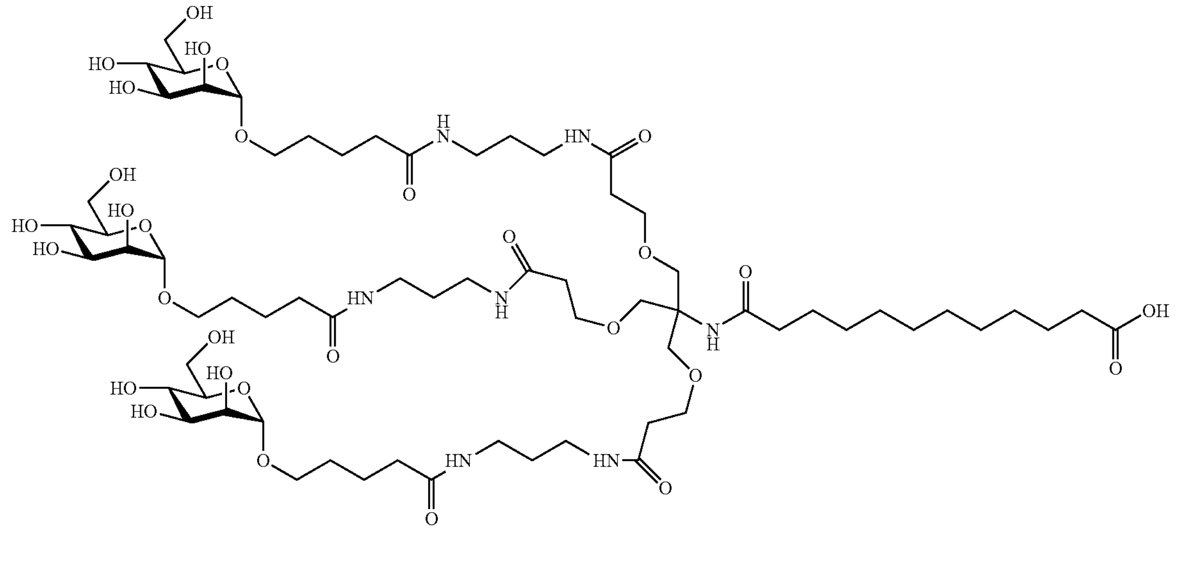

Mod026L001 (with PO or PS connecting to 5'-O— of an oligonucleotide chain):
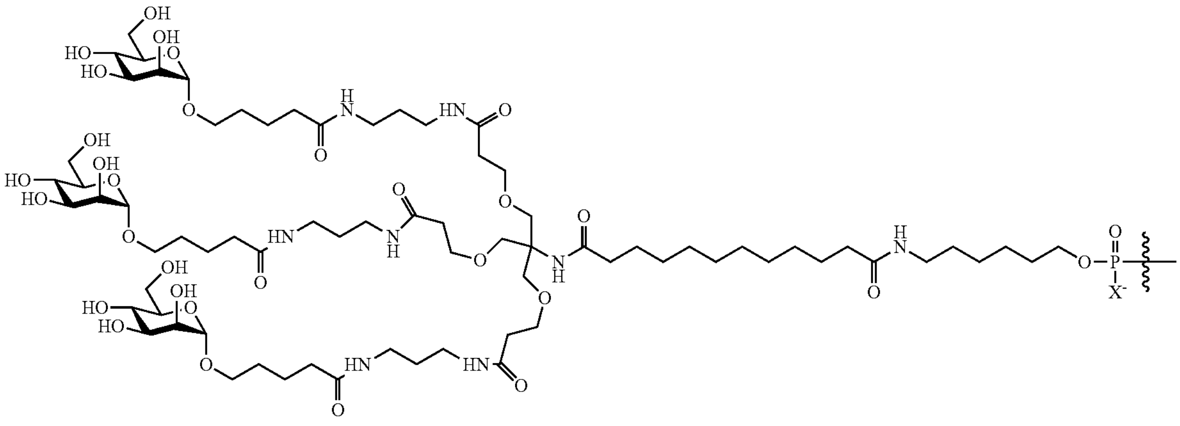
X = O or S
Mod027 (with —C(O)— connecting to, e.g., —NH— of a linker such as L001) and acid:
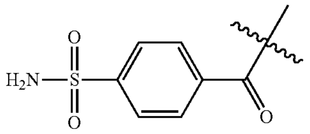
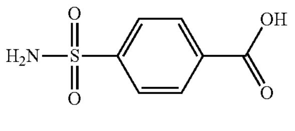
Mod027L001 (with PO or PS connecting to 5'-O— of an oligonucleotide chain):
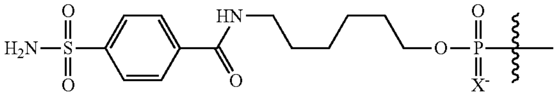
X = O or S
Mod028 (with —C(O)— connecting to, e.g., —NH— of a linker such as L001):
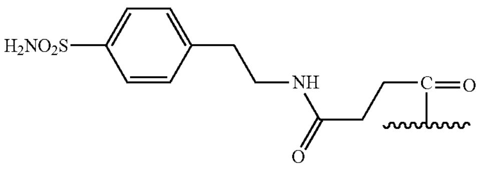 [SMILES: *C(=O)CCC(=O)NCCc1ccc(S(N)(=O)=O)cc1]

Mod029 (with —C(O)— connecting to, e.g., —NH— of a linker such as L001) and acid:
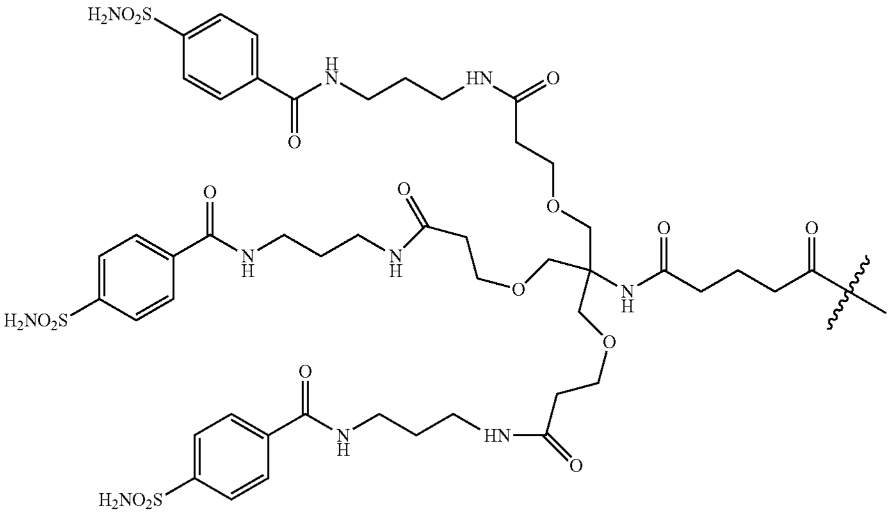
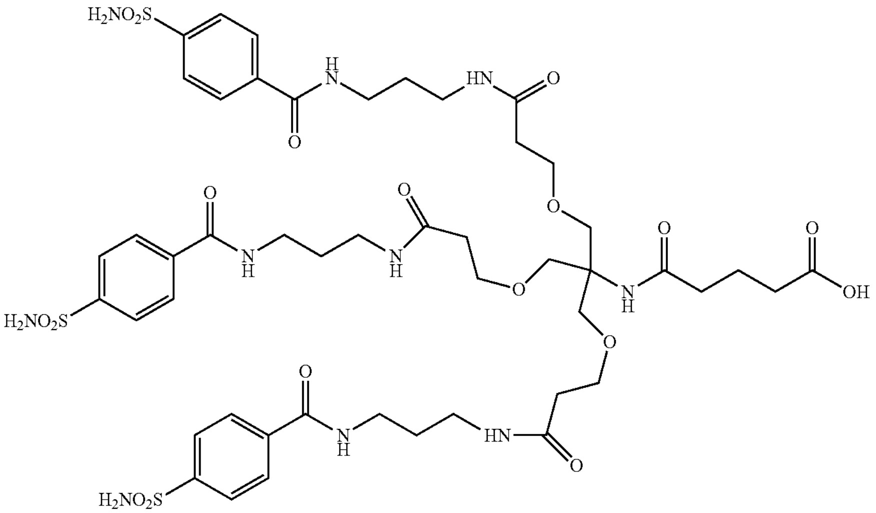

Mod029L001 (with PO or PS connecting to 5'-O— of an oligonucleotide chain):

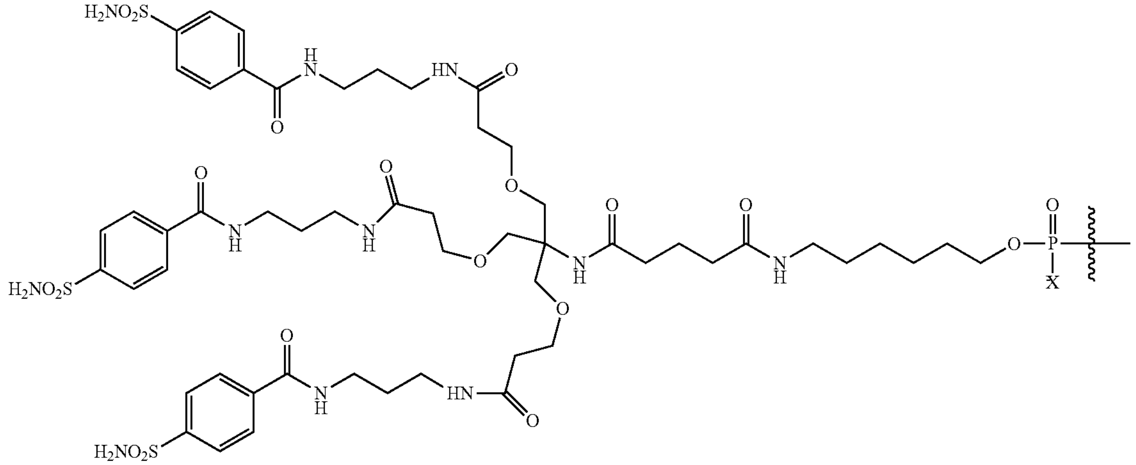

X = O or S

Mod030 (with PO or PS connecting to 5'-O— of an oligonucleotide chain) and Lauryl alcohol:

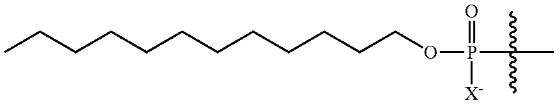

-continued

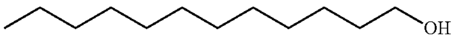

X = O or S

Mod031 (with PO or PS connecting to 5'-O— of an oligonucleotide chain) and Myristyl alcohol:

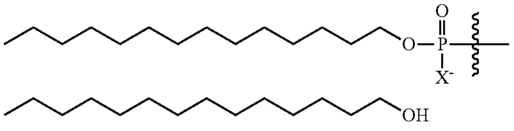

X = O or S

Mod032 (with PO or PS connecting to 5'-O— of an oligonucleotide chain) and Palmityl alcohol:

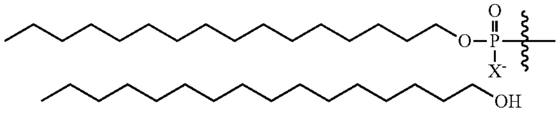

X = O or S

Mod033 (with PO or PS connecting to 5'-O— of an oligonucleotide chain) and Stearyl alcohol:

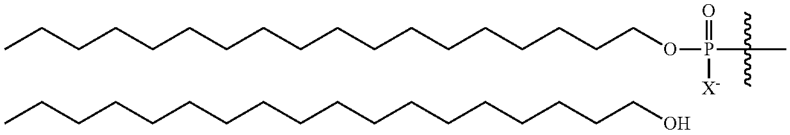

X = O or S

Mod053 (with —C(O)— connecting to, e.g., —NH— of a linker such as L001):

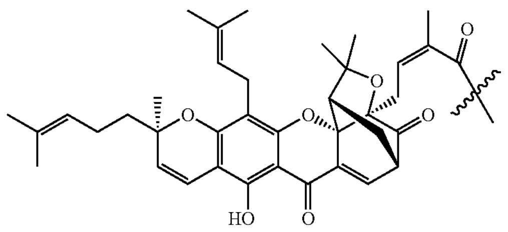 [SMILES: *C(=O)/C(C)=C\C[C@@]12OC(C)(C)[C@@H]3C[C@@H](C=C4C(=O)c5c(O)c6c(c(CC=C(C)C)c5O[C@]431)O[C@](C)(CCC=C(C)C)C=C6)C2=O]

Mod070 (with —C(O)— connecting to, e.g., —NH— of a linker such as L001):

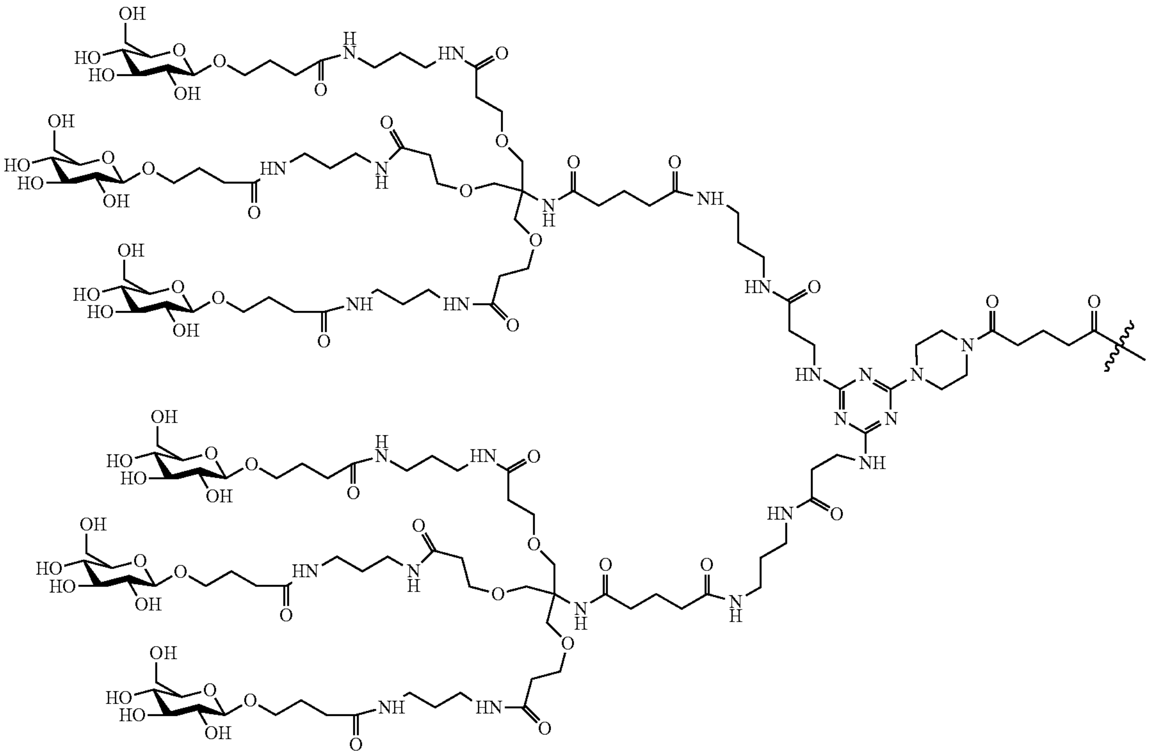
Mod071 (with —C(O)— connecting to, e.g., —NH— of a linker such as L001):
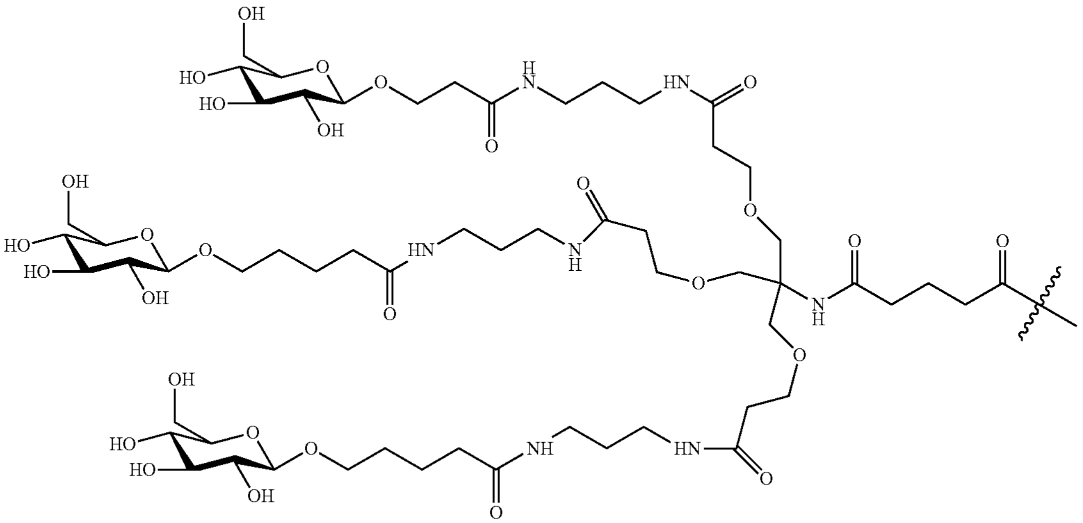
Mod086 (with —C(O)— connecting to, e.g., —NH— of a linker such as L001):

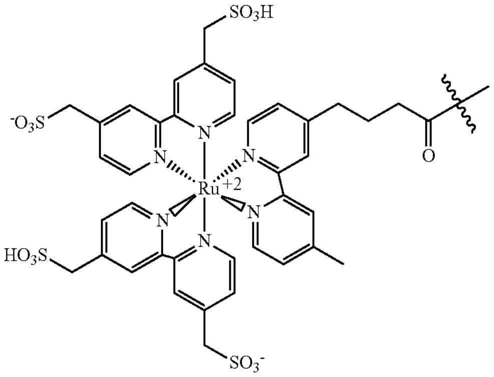
Mod092 (with —C(O)— connecting to, e.g., —NH— of a linker such as L001):
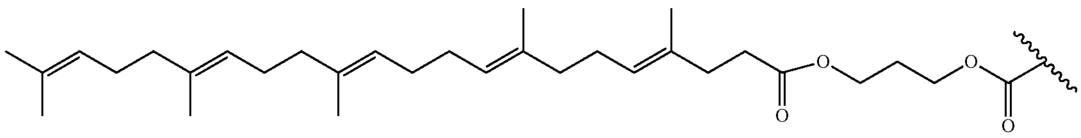 [SMILES: *C(=O)OCCCOC(=O)CC/C(C)=C/CC/C(C)=C/CC/C=C(\C)CC/C=C(\C)CCC=C(C)C]
Mod093 (with —C(O)— connecting to, e.g., —NH— of a linker such as L001):
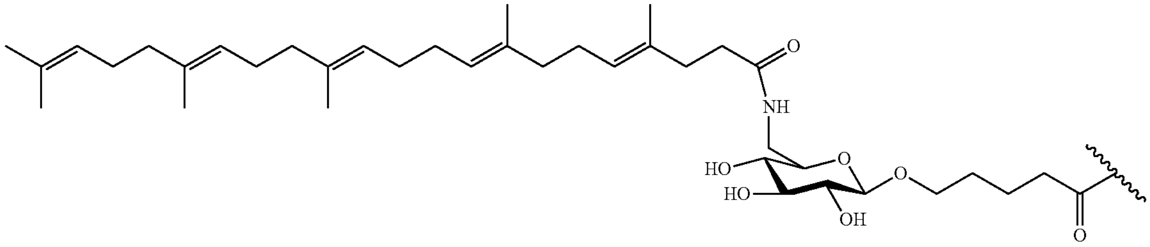
Mod007 (with —C(O)— connecting to, e.g., —NH— of a linker such as L001):

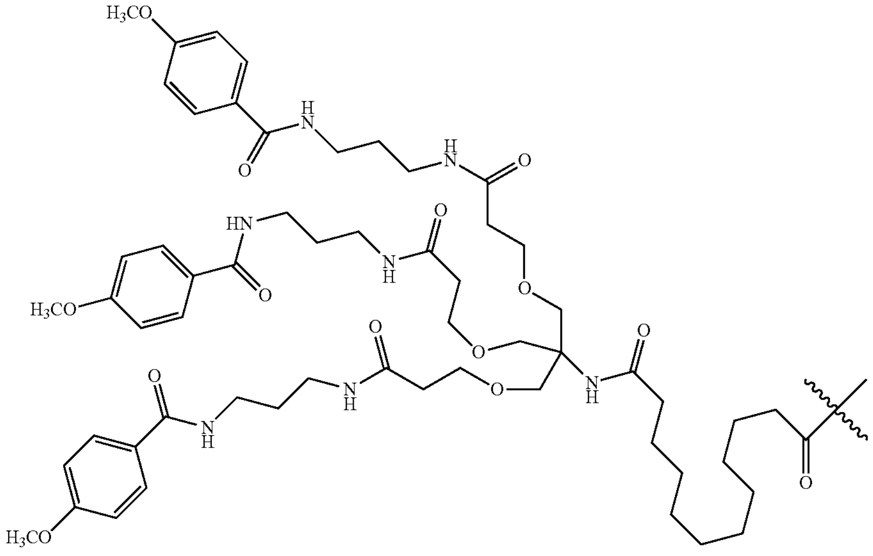 [SMILES: *C(=O)CCCCCCCCCCC(=O)NC(COCCC(=O)NCCCNC(=O)c1ccc(OC)cc1)(COCCC(=O)NCCCNC(=O)c1ccc(OC)cc1)COCCC(=O)NCCCNC(=O)c1ccc(OC)cc1]
Mod050 (with —C(O)— connecting to, e.g., —NH— of a linker such as L001):
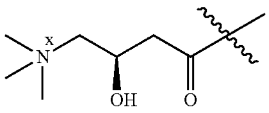
Mod043 (with —C(O)— connecting to, e.g., —NH— of a linker such as L001):
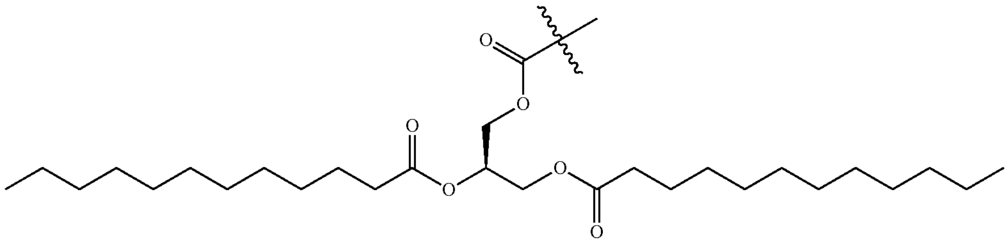 [SMILES: *C(=O)OC[C@@H](COC(=O)CCCCCCCCCCC)OC(=O)CCCCCCCCCCC]
Mod057 (with —C(O)— connecting to, e.g., —NH— of a linker such as L001):

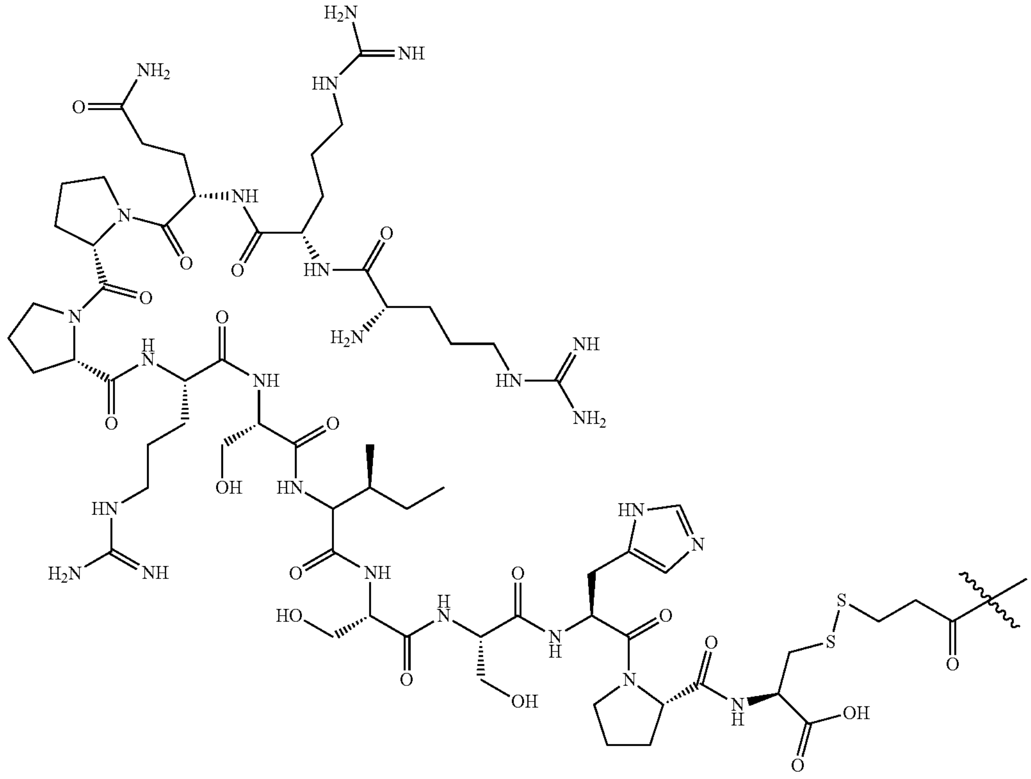 [SMILES: *C(=O)CCSSC[C@H](NC(=O)[C@@H]1CCCN1C(=O)[C@H](Cc1cnc[nH]1)NC(=O)[C@H](CO)NC(=O)[C@H](CO)NC(=O)C(NC(=O)[C@H](CO)NC(=O)[C@H](CCCNC(=N)N)NC(=O)[C@@H]1CCCN1C(=O)[C@@H]1CCCN1C(=O)[C@H](CCC(N)=O)NC(=O)[C@H](CCCNC(=N)N)NC(=O)[C@@H](N)CCCNC(=N)N)[C@@H](C)CC)C(=O)O]
Mod058 (with —C(O)— connecting to, e.g., —NH— of a linker such as L001):
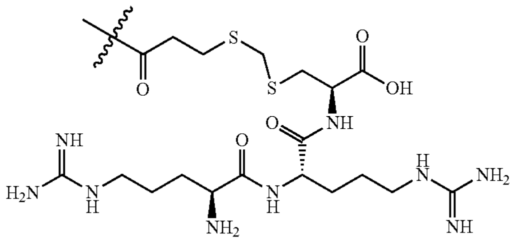 [SMILES: *C(=O)CCSCSC[C@H](NC(=O)[C@H](CCCNC(=N)N)NC(=O)[C@@H](N)CCCNC(=N)N)C(=O)O]
Mod059 (with —C(O)— connecting to, e.g., —NH— of a linker such as L001):

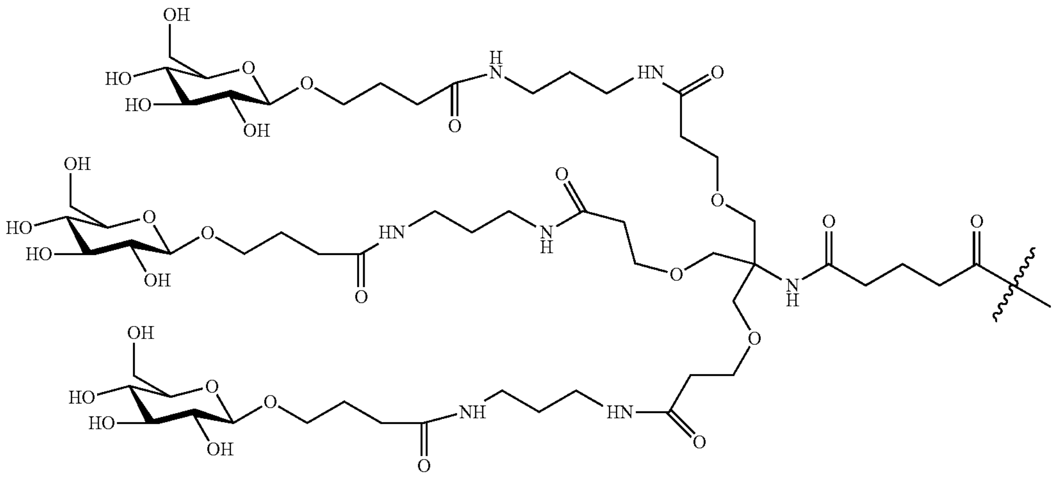
Mod066 (with —C(O)— connecting to, e.g., —NH— of a linker such as L001):
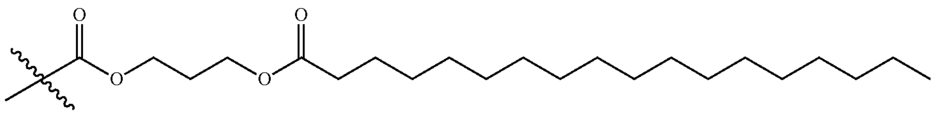 [SMILES: *C(=O)OCCCOC(=O)CCCCCCCCCCCCCCCCC]
Mod074 (with —C(O)— connecting to, e.g., —NH— of a linker such as L001):

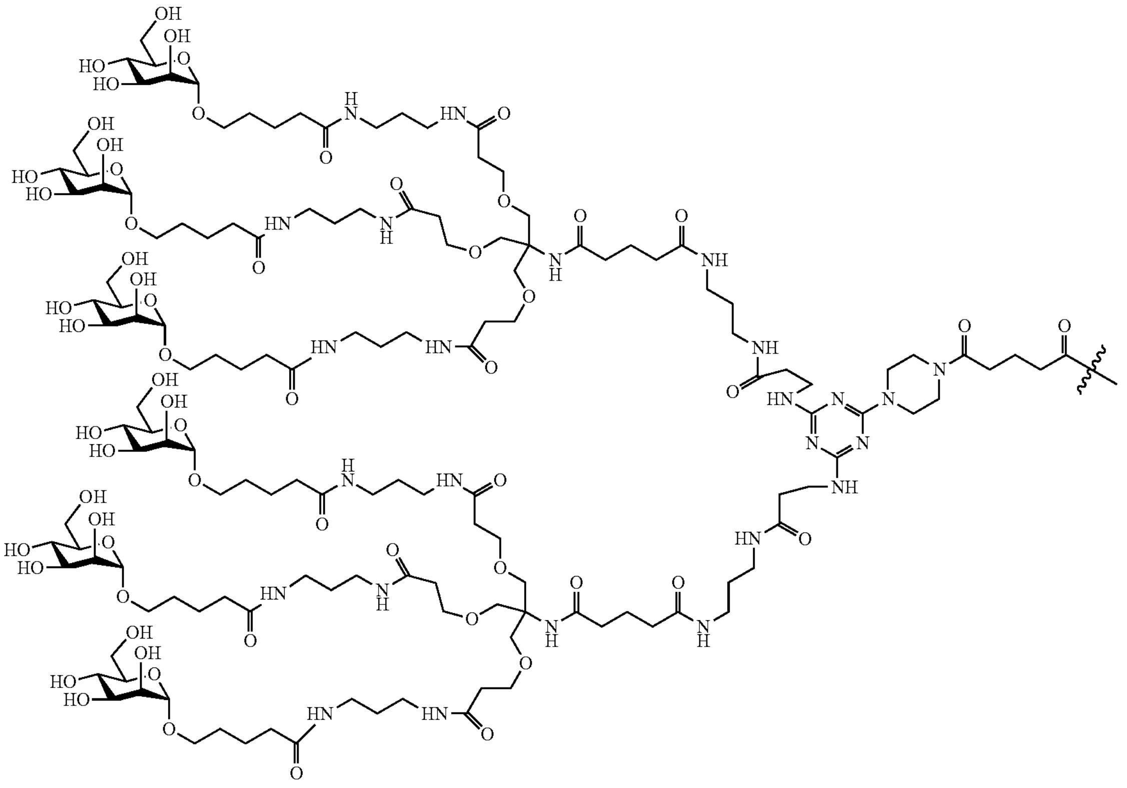
Mod085 (with —C(O)— connecting to, e.g., —NH— of a linker such as L001):
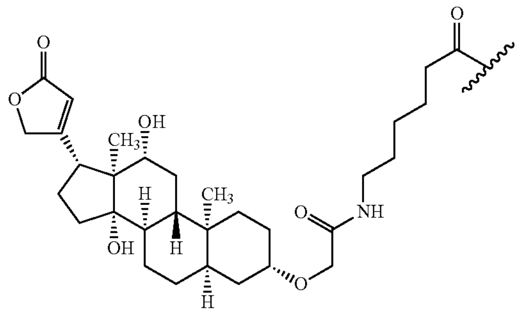
Mod091L001 (with PO or PS connecting to 5'-O— of an oligonucleotide chain):
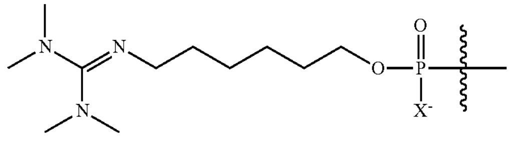
X = O or S
(e.g., in WV-11114, X=O(PO) and connecting to 5'-O— of the oligonucleotide chain)
Mod097 (with —C(O)— connecting to, e.g., —NH— of a linker such as L001):
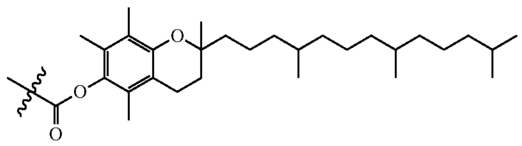 [SMILES: *C(=O)Oc1c(C)c(C)c2c(c1C)CCC(C)(CCCC(C)CCCC(C)CCCC(C)C)O2]
Mod098 (with —C(O)— connecting to, e.g., —NH— of a linker such as L001):
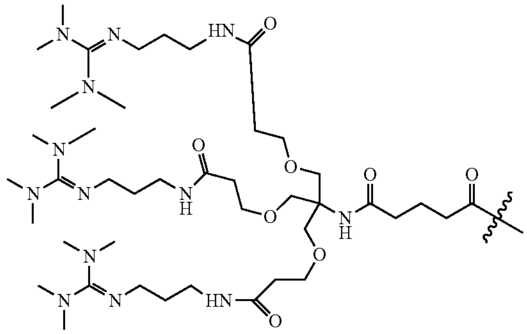 [SMILES: *C(=O)CCCC(=O)NC(COCCC(=O)NCCCN=C(N(C)C)N(C)C)(COCCC(=O)NCCCN=C(N(C)C)N(C)C)COCCC(=O)NCCCN=C(N(C)C)N(C)C]
Mod099 (with —C(O)— connecting to, e.g., —NH— of a linker such as L001):

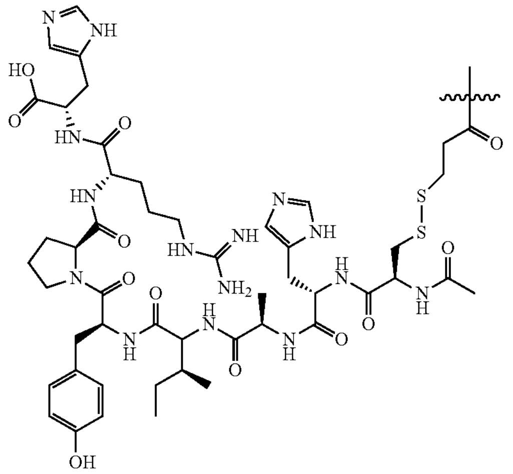 [SMILES: *C(=O)CCSSC[C@@H](NC(C)=O)C(=O)N[C@@H](Cc1cnc[nH]1)C(=O)N[C@H](C)C(=O)NC(C(=O)N[C@@H](Cc1ccc(O)cc1)C(=O)N1CCC[C@H]1C(=O)N[C@@H](CCCNC(=N)N)C(=O)N[C@@H](Cc1cnc[nH]1)C(=O)O)[C@@H](C)CC]
Mod100 (with —C(O)— connecting to, e.g., —NH— of a linker such as L001):
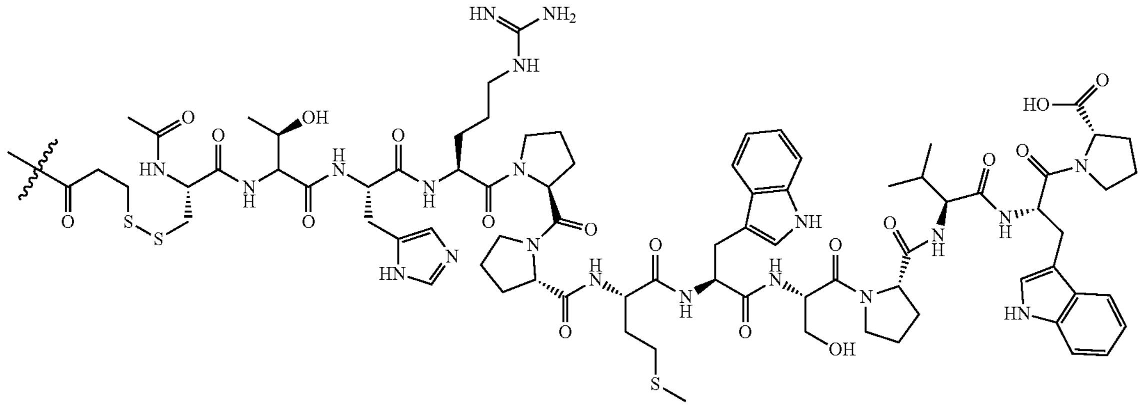 [SMILES: *C(=O)CCSSC[C@H](NC(C)=O)C(=O)NC(C(=O)N[C@@H](Cc1cnc[nH]1)C(=O)N[C@@H](CCCNC(=N)N)C(=O)N1CCC[C@H]1C(=O)N1CCC[C@H]1C(=O)N[C@@H](CCSC)C(=O)N[C@@H](Cc1c[nH]c2ccccc12)C(=O)N[C@@H](CO)C(=O)N1CCC[C@H]1C(=O)N[C@H](C(=O)N[C@@H](Cc1c[nH]c2ccccc12)C(=O)N1CCC[C@H]1C(=O)O)C(C)C)[C@@H](C)O]
Mod102 (with —C(O)— connecting to, e.g., —NH— of a linker such as L001):
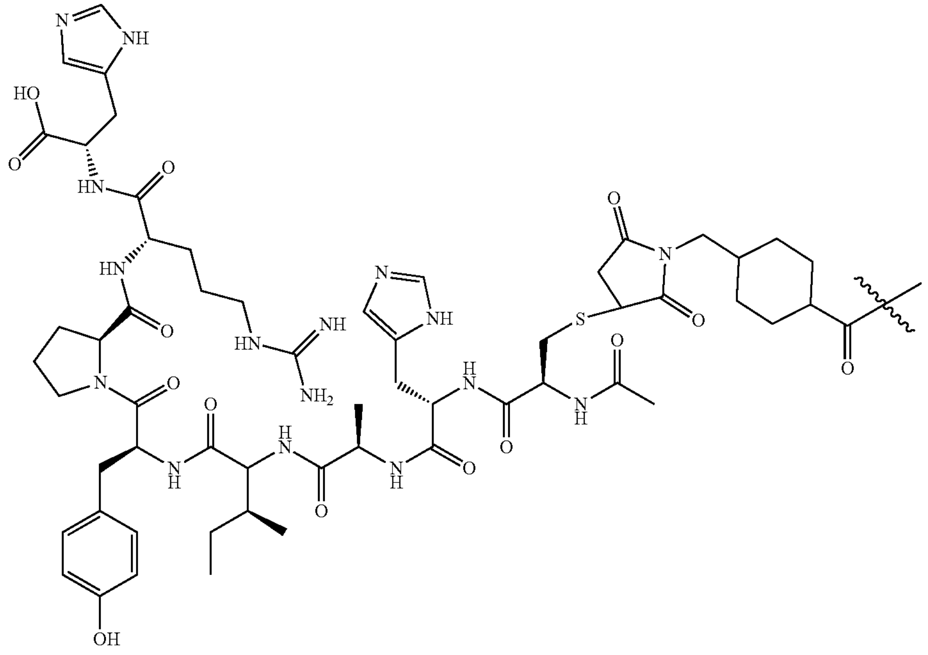 [SMILES: *C(=O)C1CCC(CN2C(=O)CC(SC[C@@H](NC(C)=O)C(=O)N[C@@H](Cc3cnc[nH]3)C(=O)N[C@H](C)C(=O)NC(C(=O)N[C@@H](Cc3ccc(O)cc3)C(=O)N3CCC[C@H]3C(=O)N[C@@H](CCCNC(=N)N)C(=O)N[C@@H](Cc3cnc[nH]3)C(=O)O)[C@@H](C)CC)C2=O)CC1]

Mod103 (with —C(O)— connecting to, e.g., —NH— of a linker such as L001):
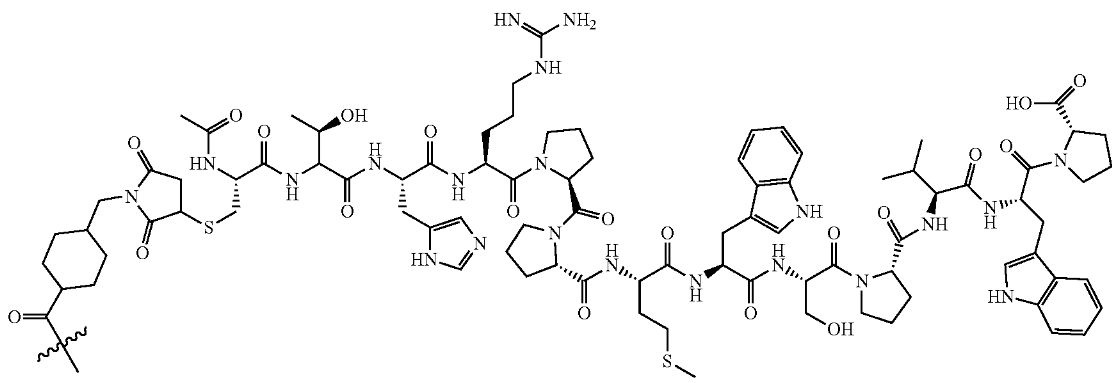 [SMILES: *C(=O)C1CCC(CN2C(=O)CC(SC[C@H](NC(C)=O)C(=O)NC(C(=O)N[C@@H](Cc3cnc[nH]3)C(=O)N[C@@H](CCCNC(=N)N)C(=O)N3CCC[C@H]3C(=O)N3CCC[C@H]3C(=O)N[C@@H](CCSC)C(=O)N[C@@H](Cc3c[nH]c4ccccc34)C(=O)N[C@@H](CO)C(=O)N3CCC[C@H]3C(=O)N[C@H](C(=O)N[C@@H](Cc3c[nH]c4ccccc34)C(=O)N3CCC[C@H]3C(=O)O)C(C)C)[C@@H](C)O)C2=O)CC1]
Mod104 (with —C(O)— connecting to, e.g., —NH— of a linker such as L001):
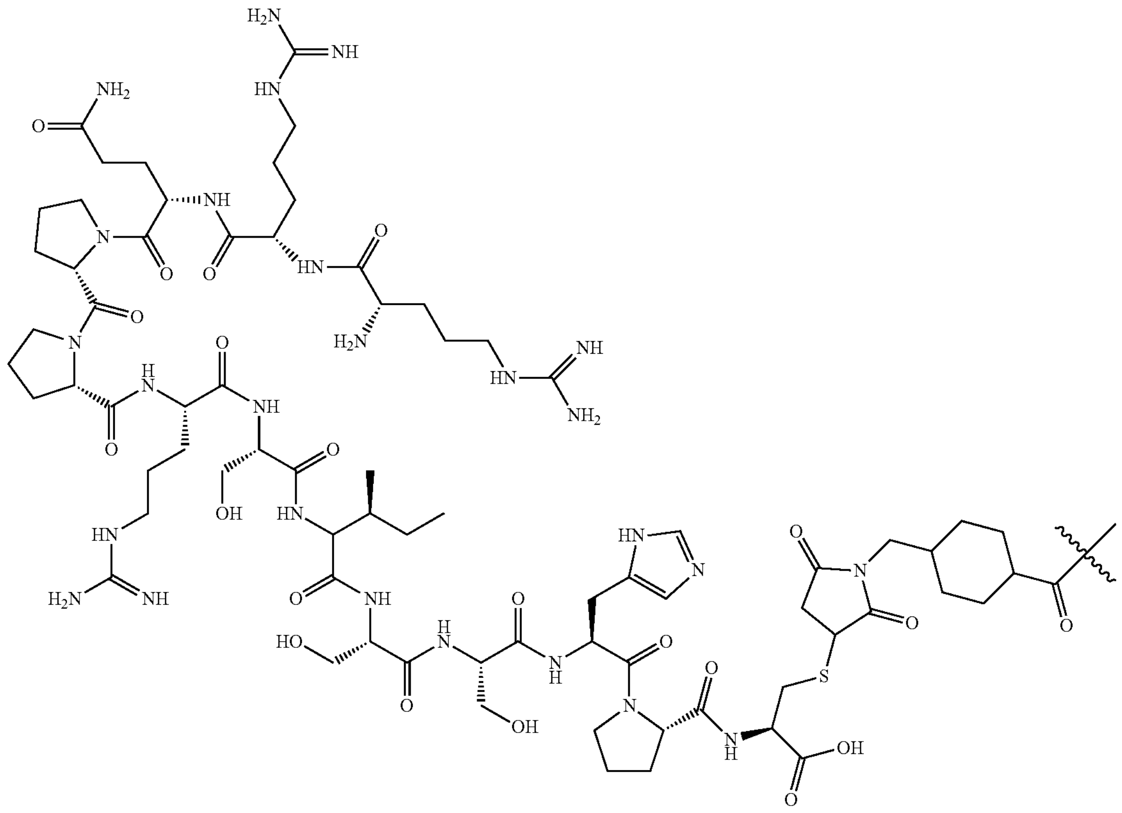 [SMILES: *C(=O)C1CCC(CN2C(=O)CC(SC[C@H](NC(=O)[C@@H]3CCCN3C(=O)[C@H](Cc3cnc[nH]3)NC(=O)[C@H](CO)NC(=O)[C@H](CO)NC(=O)C(NC(=O)[C@H](CO)NC(=O)[C@H](CCCNC(=N)N)NC(=O)[C@@H]3CCCN3C(=O)[C@@H]3CCCN3C(=O)[C@H](CCC(N)=O)NC(=O)[C@H](CCCNC(=N)N)NC(=O)[C@@H](N)CCCNC(=N)N)[C@@H](C)CC)C(=O)O)C2=O)CC1]
Mod105 (with —C(O)— connecting to, e.g., —NH— of a linker such as L001):

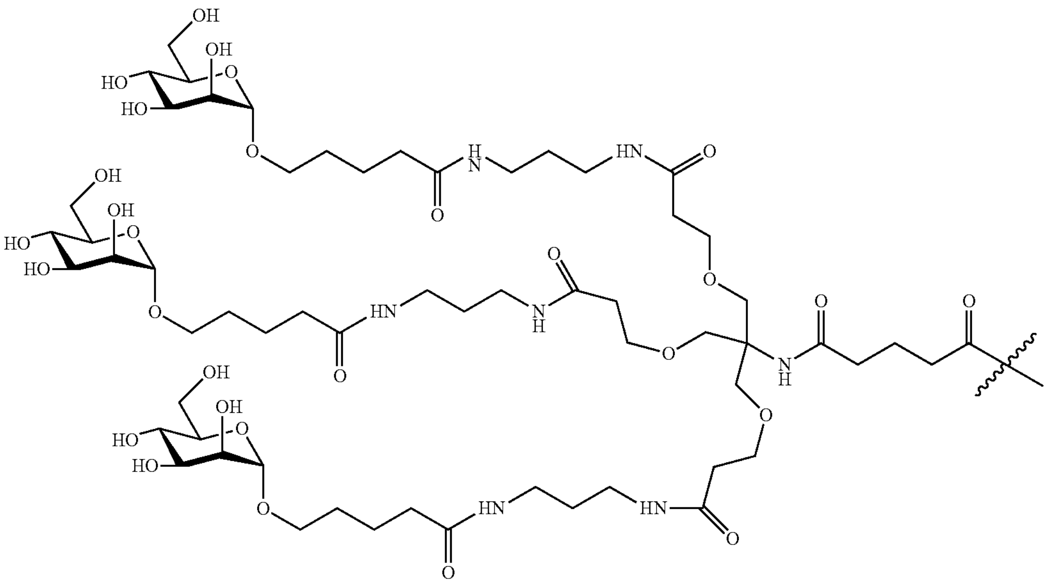
Mod106 (with PO or PS connecting to 5'-O— of an oligonucleotide chain):
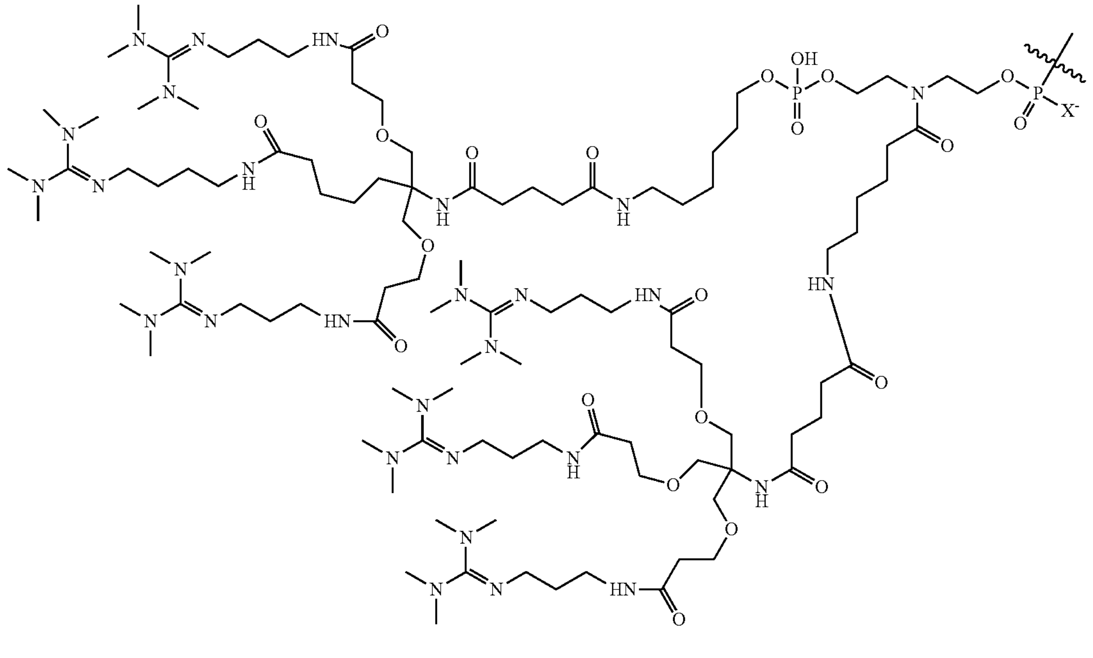
X = O or S
(e.g., in WV-15844, X=O(PO) and connecting to 5'-O— of the oligonucleotide chain)
Mod107 (with PO or PS connecting to 5'-O— of an oligonucleotide chain):

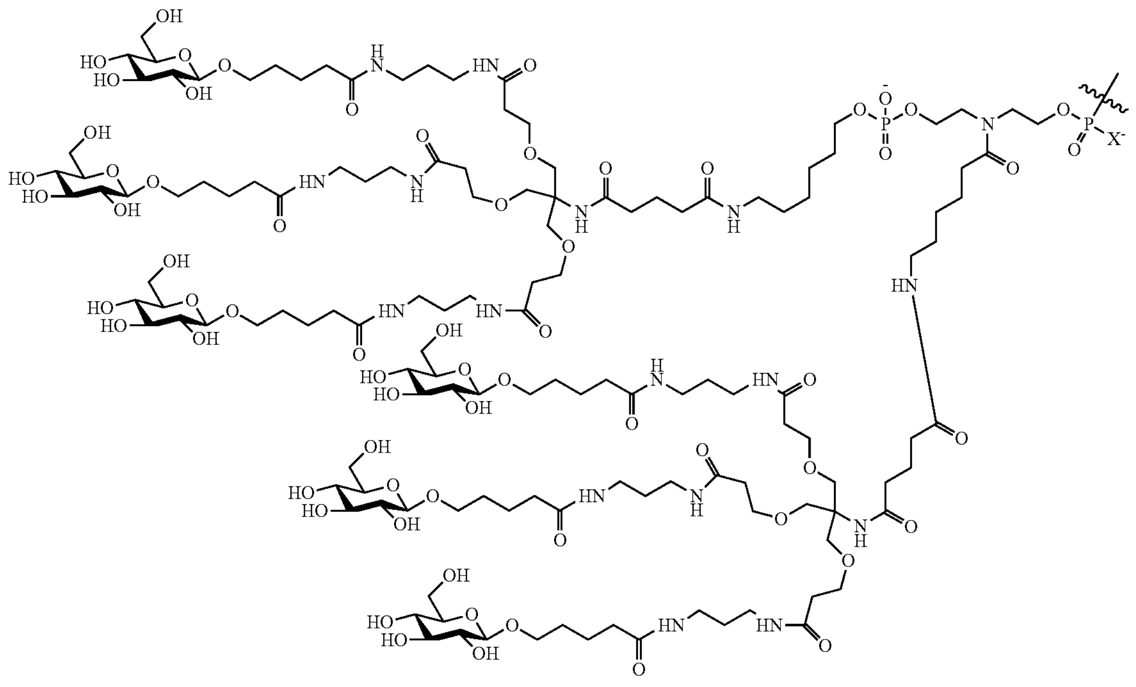
X = O or S
(e.g., in WV-15845 and WV-16011, X=O(PO) and connecting to 5'-O— of the oligonucleotide chain)
Mod108 (with —C(O)— connecting to, e.g., —NH— of a linker such as L001):
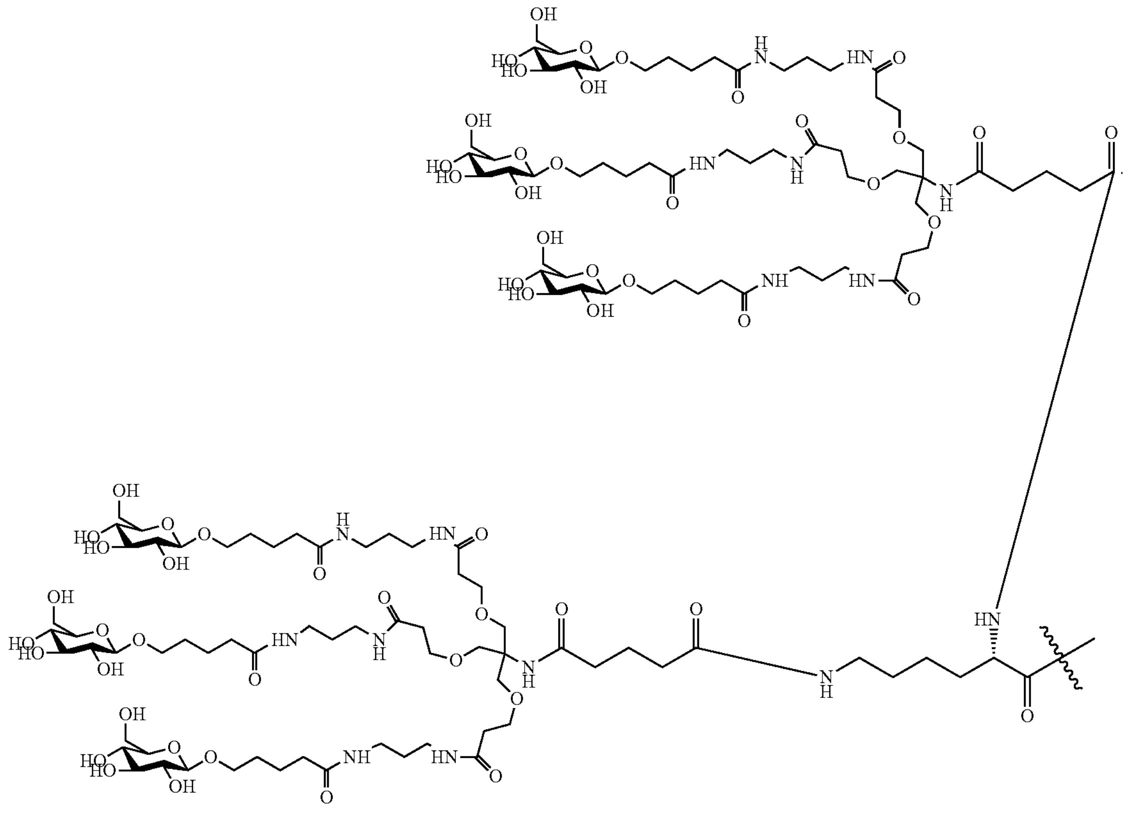

Mod109:
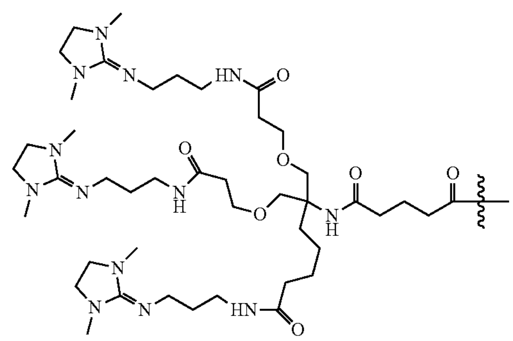 [SMILES: *C(=O)CCCC(=O)NC(CCCCC(=O)NCCCN=C1N(C)CCN1C)(COCCC(=O)NCCCN=C1N(C)CCN1C)COCCC(=O)NCCCN=C1N(C)CCN1C]
Mod109L001 (with PO or PS connecting to 5'-O— of an oligonucleotide chain):
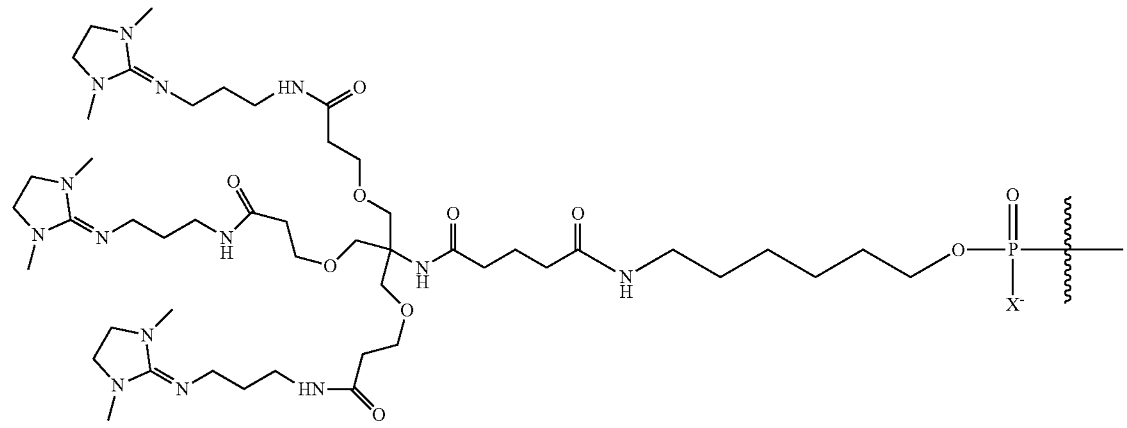
X = O or S
(e.g., in WV-19792, X=O)
Mod110:
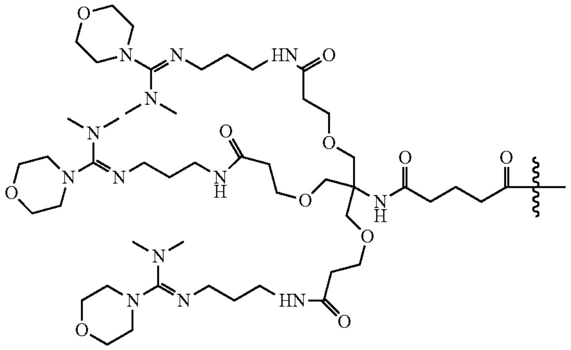 [SMILES: *C(=O)CCCC(=O)NC(COCCC(=O)NCCC/N=C(\N(C)C)N1CCOCC1)(COCCC(=O)NCCC/N=C(\N(C)C)N1CCOCC1)COCCC(=O)NCCC/N=C(\N(C)C)N1CCOCC1]
Mod110L001 (with PO or PS connecting to 5'-O— of an oligonucleotide chain):

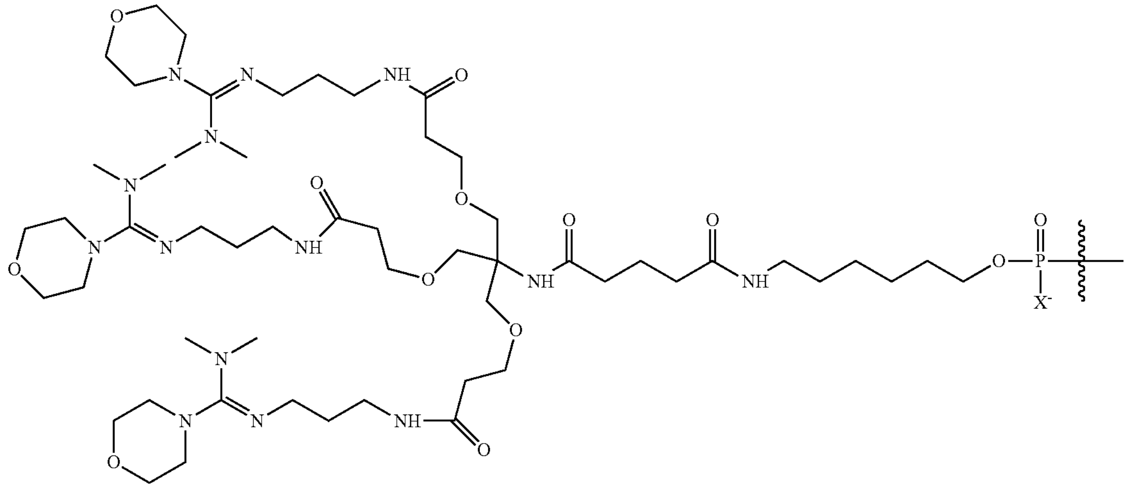
X = O or S
(e.g., in WV-19793, X=O)
Mod111:
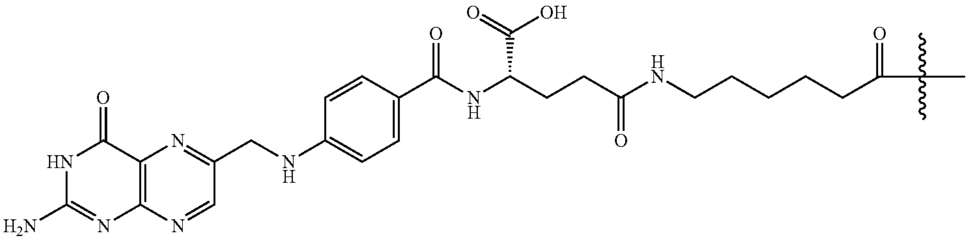 [SMILES: *C(=O)CCCCCNC(=O)CC[C@H](NC(=O)c1ccc(NCc2cnc3nc(N)[nH]c(=O)c3n2)cc1)C(=O)O]
Mod111L001 (with PO or PS connecting to 5'-O— of an oligonucleotide chain):
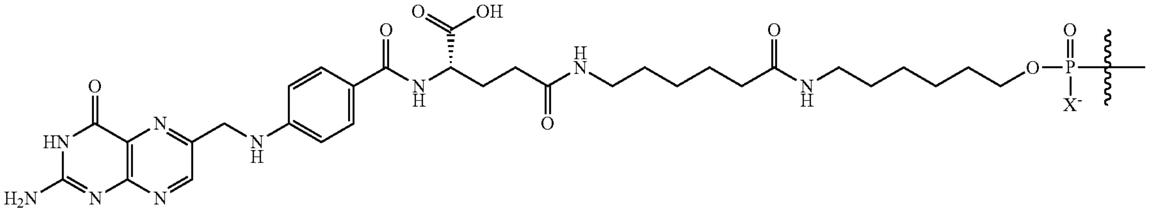
X = O or S
(e.g., in WV-19794, X = 0)
Mod 112:
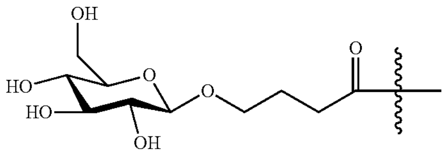

Mod112L001 (with PO or PS connecting to 5'-O— of an oligonucleotide chain):
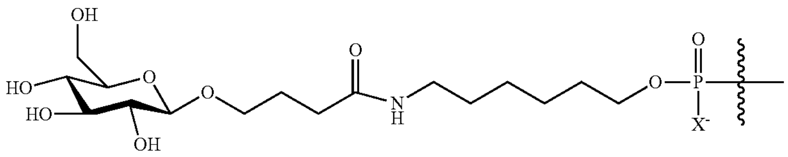
X = O or S
(e.g., in WV-19795, X = 0)
Mod113:
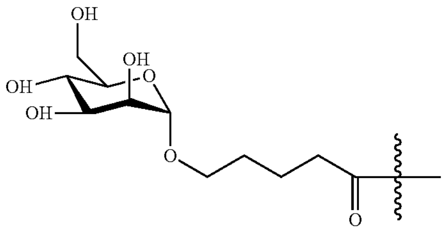
Mod113L001 (with PO or PS connecting to 5'-O— of an oligonucleotide chain):
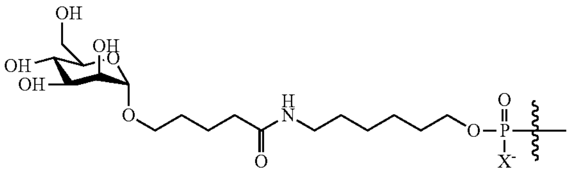
X = O or S
(e.g., in WV-19796, X = 0)
Mod114:
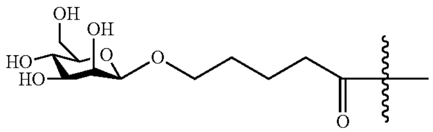
Mod114L001 (with PO or PS connecting to 5'-O— of an oligonucleotide chain):
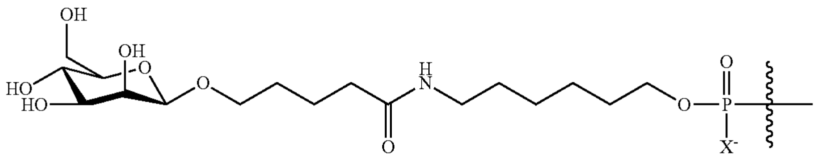
X = O or S
(e.g., in WV-19797, X = O)

Mod115:
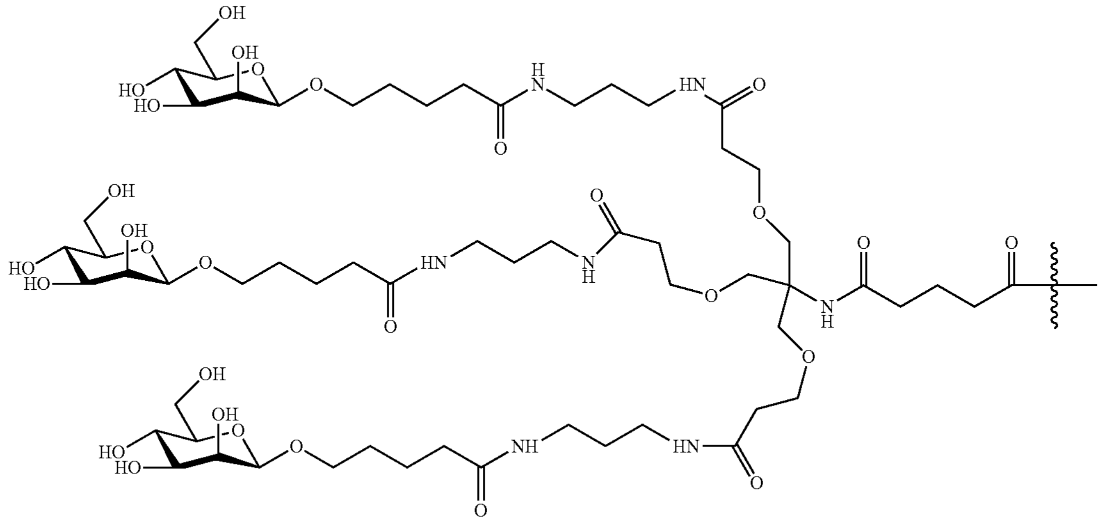
Mod115L001 (with PO or PS connecting to 5'-O— of an oligonucleotide chain):
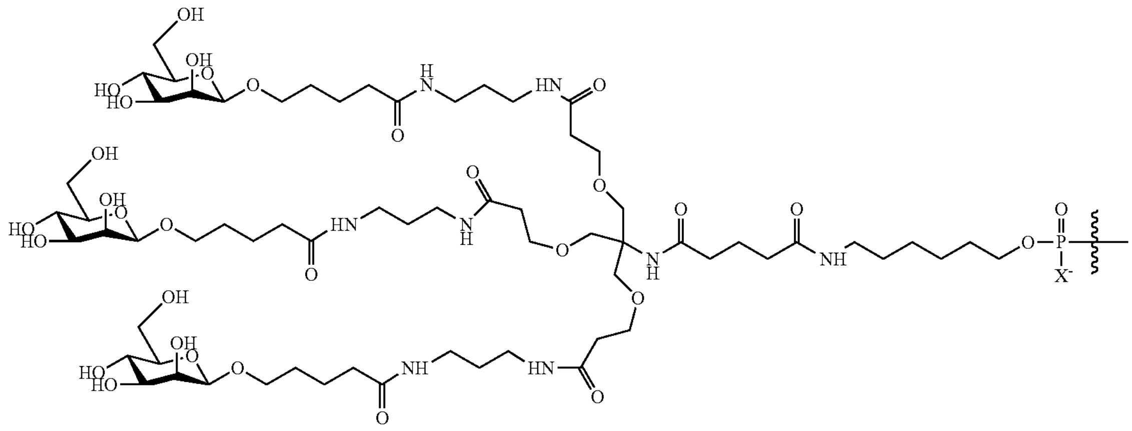
X = O or S
(e.g., in WV-19798, X = O)

Mod118:
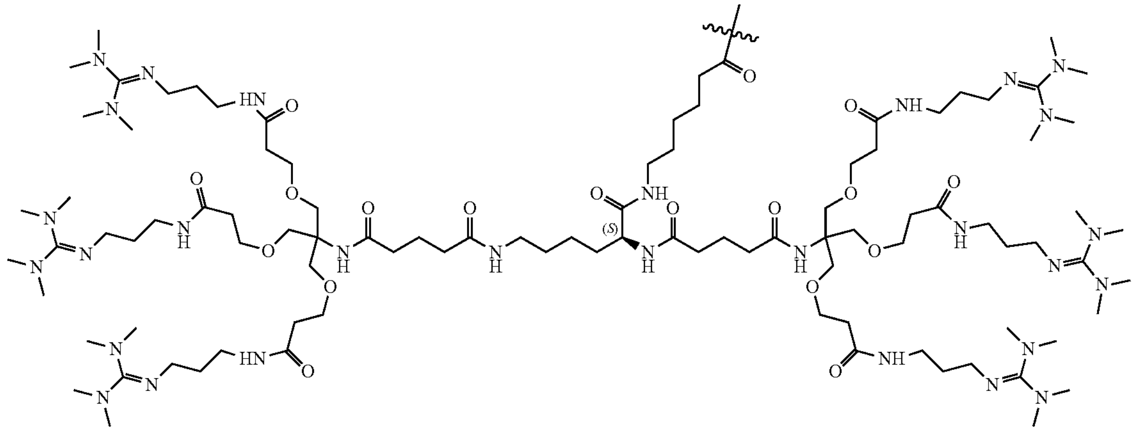
Mod118L001 (with PO or PS connecting to 5'-O— of an oligonucleotide chain):
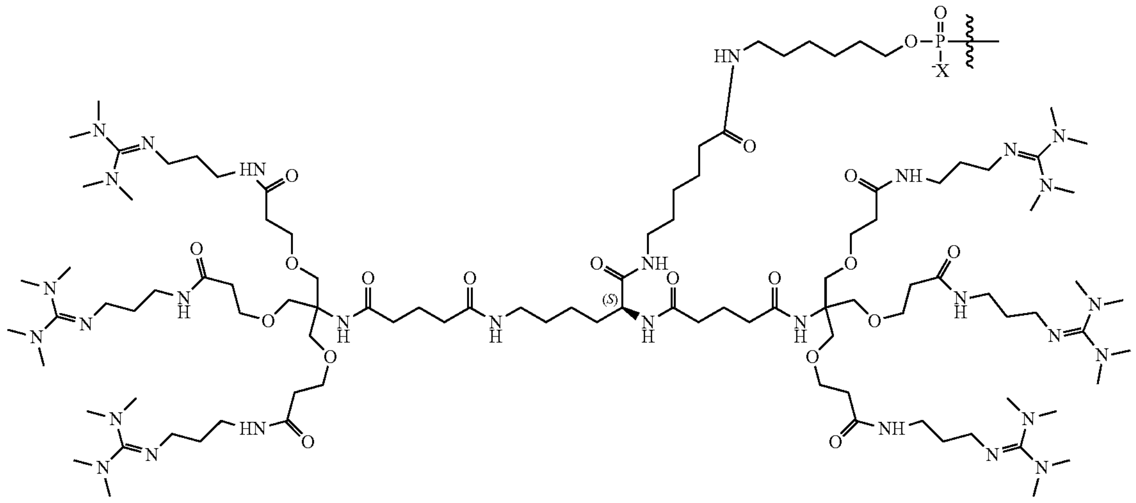
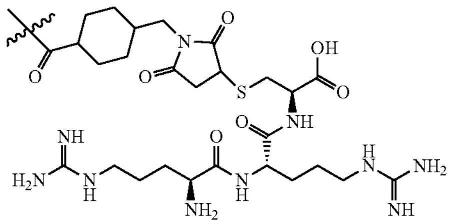
X=O or S
Mod119:
Mod119L001 (with PO or PS connecting to 5'-O— of an oligonucleotide chain):

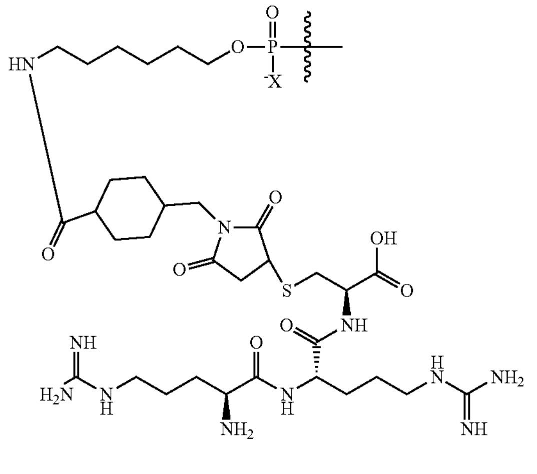
X = O or S
Mod120:
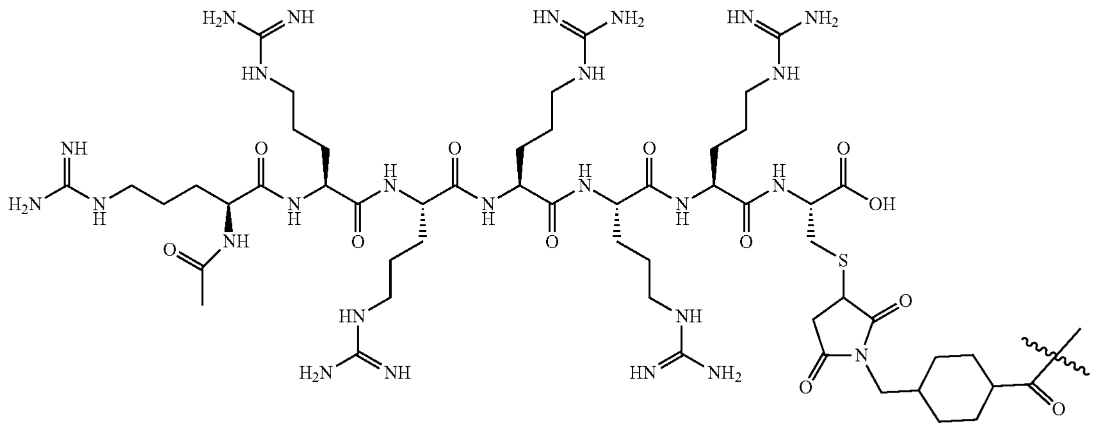 [SMILES: *C(=O)C1CCC(CN2C(=O)CC(SC[C@H](NC(=O)[C@H](CCCNC(=N)N)NC(=O)[C@H](CCCNC(=N)N)NC(=O)[C@H](CCCNC(=N)N)NC(=O)[C@H](CCCNC(=N)N)NC(=O)[C@H](CCCNC(=N)N)NC(=O)[C@H](CCCNC(=N)N)NC(C)=O)C(=O)O)C2=O)CC1]
Mod120L001 (with PO or PS connecting to 5'-O— of an oligonucleotide chain):
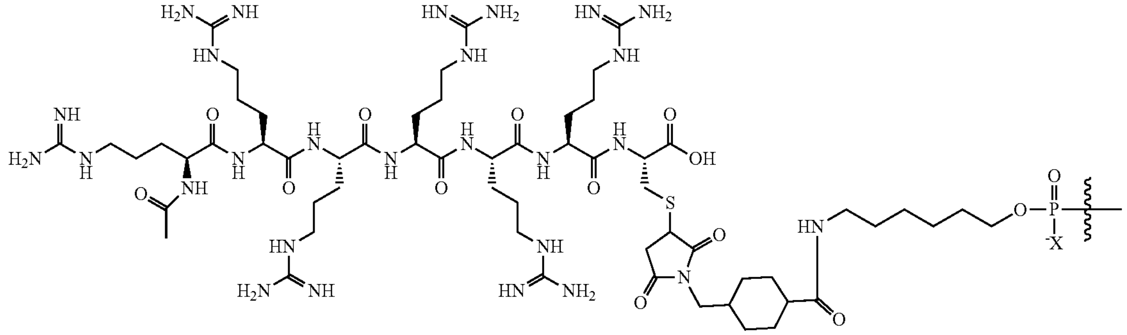
X = O or S
L009n001L009n001L009n001L009: connected to the 5'-position of the 5' terminal sugar of an oligonucleotide chain (e.g., for WV-23576 and WV-23578, sugar of fU) through a phosphodiester:

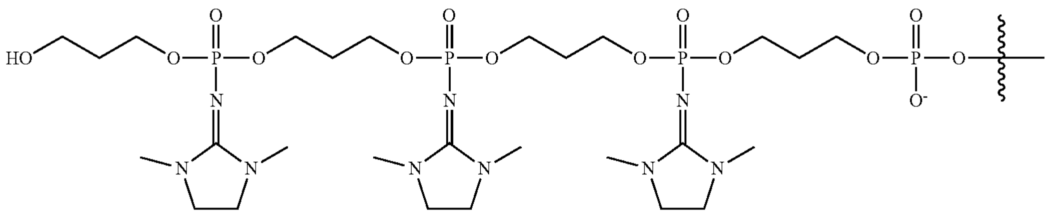 [SMILES: *OP(=O)([O-])OCCCOP(=O)(N=C1N(C)CCN1C)OCCCOP(=O)(N=C1N(C)CCN1C)OCCCOP(=O)(N=C1N(C)CCN1C)OCCCO]

L009n001L009n001L009n001: connected to the 5'-position of the 5' terminal sugar of an oligonucleotide chain (e.g., for WV-23577 and WV-23579, sugar of fU) through n001:

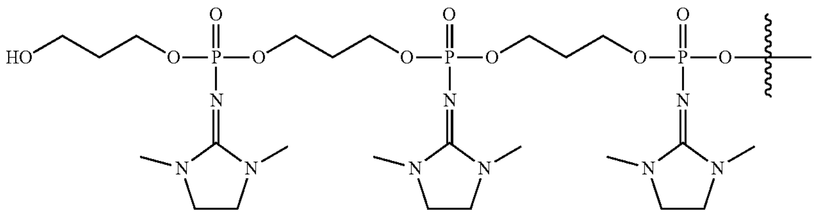 [SMILES: *OP(=O)(N=C1N(C)CCN1C)OCCCOP(=O)(N=C1N(C)CCN1C)OCCCOP(=O)(N=C1N(C)CCN1C)OCCCO]

L010n001L010n001L010n001L009: connected to the 5'-position of the 5' terminal sugar of an oligonucleotide chain (e.g., for WV-23936 and WV-23938, sugar of fU) through a phosphodiester:

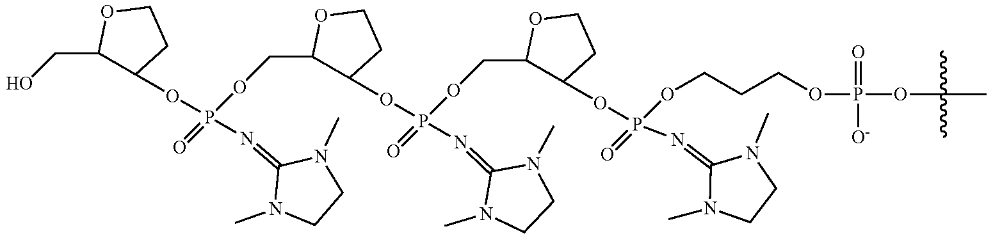 [SMILES: *OP(=O)([O-])OCCCOP(=O)(N=C1N(C)CCN1C)OC1CCOC1COP(=O)(N=C1N(C)CCN1C)OC1CCOC1COP(=O)(N=C1N(C)CCN1C)OC1CCOC1CO]

L010n001L010n001L010n001: connected to the 5'-position of the 5' terminal sugar of an oligonucleotide chain (e.g., for WV-23937 and WV-23939, sugar of fU) through n001:

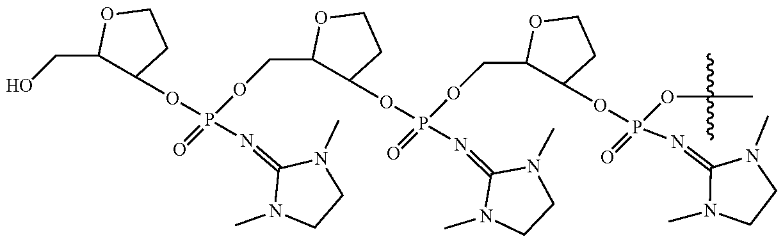 [SMILES: *OP(=O)(N=C1N(C)CCN1C)OC1CCOC1COP(=O)(N=C1N(C)CCN1C)OC1CCOC1COP(=O)(N=C1N(C)CCN1C)OC1CCOC1CO]

In some embodiments, some functional groups are optionally protected, e.g., for Mod024 and/or Mod 026, the hydroxyl groups are optionally protected as AcO—, before and/or during conjugation to oligonucleotide chains, and the functional groups, e.g., hydroxyl groups, can be deprotected, for example, during oligonucleotide cleavage and/or deprotection:

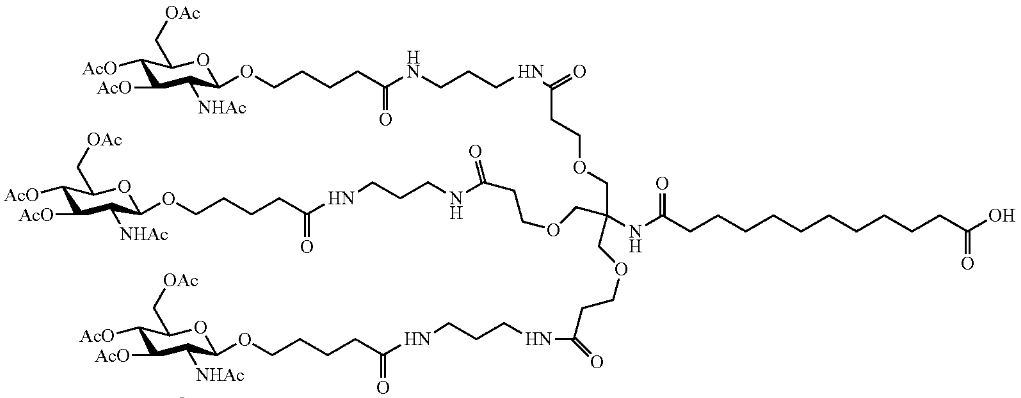

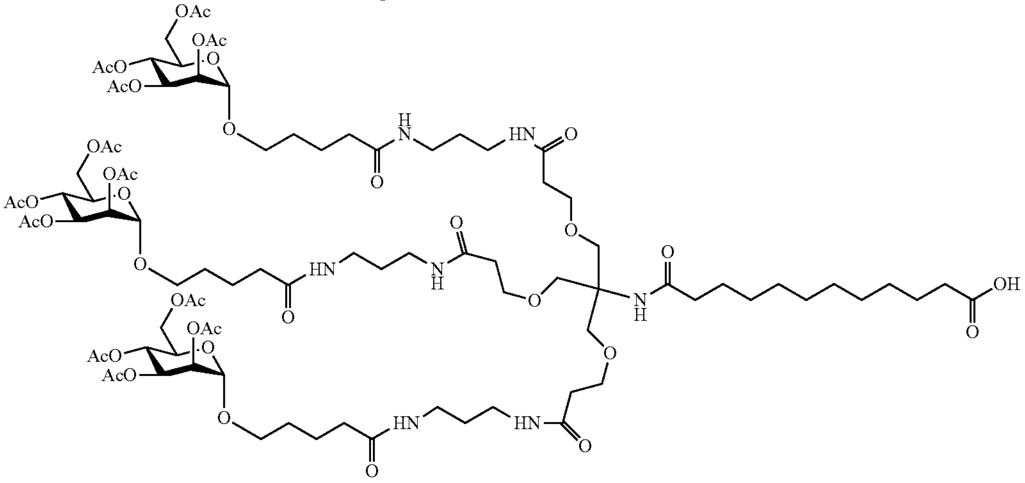

Applicant notes that presented in Table A1 are example ways of presenting structures of provided oligonucleotides, for example, WV-3546 (Mod020L001fU*SfC*SfA*SfA*SfG*SfG*SmAfA*Sm GmA*SfU*SmGmGfC*SfA*SfU*SfU*SfU*Sf C*SfU) (SEQ ID NO: 3151) can be presented as a lipid moiety (Mod020,

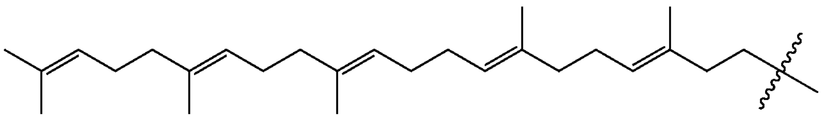

)

connected via —C(O)—(OOSSSSSSOSOSSOOSSSSSS, which "O" may be omitted as in Table A1) to the —NH— of —NH—$(CH_2)_6$—, wherein the —$(CH_2)_6$— is connected to the 5'-end of the oligonucleotide chain via a phosphodiester linkage (OOSSSSSSOSOSSOOSSSSSS). One having ordinary skill in the art understands that a provided oligonucleotide can be presented as combinations of lipid, linker and oligonucleotide chain units in many different ways, wherein in each way the combination of the units provides the same oligonucleotide. For example, WV-3546, can be considered to have a structure of $A^c$-[-$L^{LD}$-$(R^{LD})_a$]$_b$, wherein a is 1, b is 1, and have a lipid moiety $R^{LD}$ of

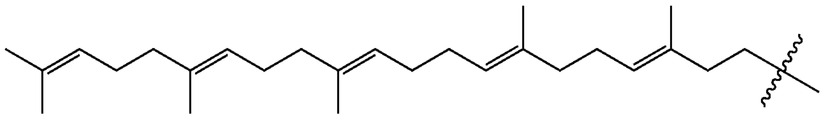

)

connected to its oligonucleotide chain ($A^c$) unit through a linker $L^{LD}$ having the structure of —C(O)—NH—$(CH_2)_6$—OP(=O)(OH)—O—, wherein —C(O)— is connected to $R^{LD}$, and —O— is connected to $A^c$ (as 5'-O— of the oligonucleotide chain); one of the many alternative ways is that $R^{LD}$ is

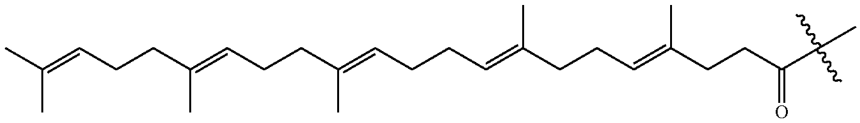

, and $L^{LD}$ is —NH—$(CH_2)_6$—OP(=O)(OH)—O—, wherein —NH— is connected to $R^{LD}$, and —O— is connected to $A^c$ (as 5'-O— of the oligonucleotide chain).

In some embodiments, each phosphorothioate internucleotidic linkage of an oligonucleotide is independently a chirally controlled internucleotidic linkage. In some embodiments, a provided oligonucleotide composition is a chirally controlled oligonucleotide composition of an oligonucleotide type listed in Table A1, wherein each phosphorothioate internucleotidic linkage of the oligonucleotide is independently a chirally controlled internucleotidic linkage.

In some embodiments, the present disclosure provides compositions comprising or consisting of a plurality of provided oligonucleotides (e.g., chirally controlled oligonucleotide compositions). In some embodiments, all oligonucleotides of the plurality are of the same type, i.e., all have the same base sequence, pattern of backbone linkages, pattern of backbone chiral centers, and pattern of backbone phosphorus modifications. In some embodiments, all oligonucleotides of the same type are structural identical. In some embodiments, provided compositions comprise oligonucleotides of a plurality of oligonucleotides types, typically in controlled amounts. In some embodiments, a provided chirally controlled oligonucleotide composition comprises a combination of two or more provided oligonucleotide types.

In some embodiments, an oligonucleotide composition of the present disclosure is a chirally controlled oligonucleotide composition, wherein the sequence of the oligonucleotides of its plurality comprises or consists of a base sequence listed in Table A1.

In some experiments, provided oligonucleotides can provide surprisingly high activities, e.g., when compared to those of Drisapersen and/or Eteplirsen. For example, chirally controlled oligonucleotide compositions of WV-887, WV-892, WV-896, WV-1714, WV-2444, WV-2445, WV-2526, WV-2527, WV-2528, and WV-2530, and many others, each showed a superior capability, in some embodiments many fold higher, to mediate skipping of an exon in dystrophin, compared to Drisapersen and/or Eteplirsen. Certain data are provided in the present disclosure as examples.

In some embodiments, the present disclosure pertains to a composition comprising a chirally controlled oligonucleotide selected from any DMD oligonucleotide listed herein, or any DMD oligonucleotide having a base sequence comprising at least 15 consecutive bases of any DMD oligonucleotide listed herein.

In some embodiments, a provided oligonucleotide is no more than 25 bases long. In some embodiments, a provided oligonucleotide is no more than 25 to 60 bases long. In some embodiments, a U can be replaced with T, or vice versa.

In some embodiments, when assaying example oligonucleotides in mice, oligonucleotides (e.g., WV-3473, WV-3545, WV-3546, WV-942, etc.) are intravenous injected via tail vein in male C57BL/10ScSndmdmdx mice (4-5 weeks old), at tested amounts, e.g., 10 mg/kg, 30 mg/kg, etc. In some embodiments, tissues are harvested at tested times, e.g., on Day, e.g., 2, 7 and/or 14, etc., after injection, in some embodiments, fresh-frozen in liquid nitrogen and stored in −80° C. until analysis.

Various assays can be used to assess oligonucleotide levels in accordance with the present disclosure. In some embodiments, hybrid-ELISA is used to quantify oligonucleotide levels in tissues using test article serial dilution as standard curve: for example, in an example procedure, maleic anhydride activated 96-well plate (Pierce 15110) was coated with 50 μl of capture probe at 500 nM in 2.5% $NaHCO_3$(Gibco, 25080-094) for 2 hours at 37° C. The plate was then washed 3 times with PBST (PBS+0.1% Tween-20), and blocked with 5% fat free milk-PBST at 37° C. for 1 hour. Test article oligonucleotide was serial diluted into matrix. This standard together with original samples were diluted with lysis buffer (4 M Guanidine; 0.33% N-Lauryl Sarcosine; 25 mM Sodium Citrate; 10 mM DTT) so that oligonucleotide amount in all samples is less than 100 ng/ml. 20 μl of diluted samples were mixed with 180 μl of 333 nM detection probe diluted in PBST, then denatured in PCR machine (65° C., 10 min, 95° C., 15 min, 4 C ∞). 50 μl of denatured samples were distributed in blocked ELISA plate in triplicates, and incubated overnight at 4° C. After 3 washes of PBST, 1:2000 streptavidin-AP in PBST was added, 50 μl per well and incubated at room temperature for 1 hour. After extensive wash with PBST, 100 μl of AttoPhos (Promega S1000) was added, incubated at room temperature in dark for 10 min and read on plate reader (Molecular Device, M5) fluorescence channel: Ex435 nm, Em555 nm. Oligonucleotides in samples were calculated according to standard curve by 4-parameter regression.

In some embodiments, provided oligonucleotides are stable in both plasma and tissue homogenates.

Additional Embodiments and Examples of Oligonucleotides and Compositions, Including Dystrophin (DMD) Oligonucleotides and Compositions Among other things, the present disclosure provides oligonucleotides, compositions, and methods for, modulating splicing, reducing target levels, treating various conditions, disorders, diseases, etc. For example, in some embodiments, the present disclosure provides dystrophin (DMD) oligonucleotides and/or DMD oligonucleotide compositions that are useful for various purposes. In some embodiments, a DMD oligonucleotide and/or composition is capable of mediating skipping of exon 23 in the mouse DMD gene. In some embodiments, a DMD oligonucleotide and/or composition is capable of mediating skipping of exon 44 in the human or mouse DMD gene. In some embodiments, a DMD oligonucleotide and/or composition is capable of mediating skipping of exon 46 in the human or mouse DMD gene. In some embodiments, a DMD oligonucleotide and/or composition is capable of mediating skipping of exon 47 in the human or mouse DMD gene. In some embodiments, a DMD oligonucleotide and/or composition is capable of mediating skipping of exon 51 in the human or mouse DMD gene. In some embodiments, a DMD oligonucleotide and/or composition is capable of mediating skipping of exon 52 in the human or mouse DMD gene. In some embodiments, a DMD oligonucleotide and/or composition is capable of mediating skipping of exon 53 in the human or mouse DMD gene. In some embodiments, a DMD oligonucleotide and/or composition is capable of mediating skipping of exon 54 in the human or mouse DMD gene. In some embodiments, a DMD oligonucleotide and/or composition is capable of mediating skipping of exon 55 in the human or mouse DMD gene.

In some embodiments, a DMD oligonucleotide and/or composition is capable of mediating skipping of multiple exons in the human or mouse DMD gene.

In some embodiments, a provided oligonucleotide, e.g., a DMD oligonucleotide, comprises a modification. In some embodiments, a DMD oligonucleotide comprises a sugar modification. In some embodiments, a DMD oligonucleotide comprises a sugar modification at the 2' position. In some embodiments, a DMD oligonucleotide comprises a sugar modification at the 2' position selected from 2'-F, 2'-OMe and 2'-MOE.

In some embodiments, a DMD oligonucleotide comprises a 2'-F, 2'-OMe and/or 2'-MOE. In some embodiments, a DMD oligonucleotide comprises a 2'-F. In some embodiments, in a DMD oligonucleotide, each sugar comprises a 2'-F.

In some embodiments, a DMD oligonucleotide comprises a 2'-OMe. In some embodiments, in a DMD oligonucleotide, each sugar comprises a 2'-OMe. In some embodiments, a DMD oligonucleotide comprises a 2'-MOE. In some embodiments, in a DMD oligonucleotide, each sugar comprises a 2'-MOE.

In some embodiments, a provided oligonucleotide, e.g., a DMD oligonucleotide comprises a 2'-OMe and a 2'-F. In some embodiments, a provided oligonucleotide, e.g., a DMD oligonucleotide, comprises a pattern of 2' sugar modifications, wherein the pattern comprises a sequence selected from: fm, mf, ffm, fffm, ffffm, fffffm, ffffffm, fffffffm, ffffffffm, fffffffffm, mf, mff, mfff, mffff, mfffff, mffffff, mfffffff, mffffffff, fmf, fmmf, fmmmf, fmmmmf, fmmmmmf, fmmmmmmf, fmmmmmmmf, fmmmmmmmmf, fmmmmmmmmmf, fffffmmmmmmmmmmfffff, ffffmmmmmmmmmmmmffff, fffmmmmmmmmmmmmmffff, fffmmmmmmmmmmmmmmfff, ffmmmmmmmmmmmmmmmmff, fmmmmmmmmmmmmmmmmmmf, ffffffffmmmmmmmmmmmm, fffffmmmmmmmmmmfffff, ffffmmmmmmmmmmmfffff, fffmmmmmmmmmmmmmffff, ffmmmmmmmmmmmmmmmfff, fmmmmmmmmmmmmmmmmmff, mmmmmmmmmmmmmmmmmmmf, ffffffffmmmmmmmmmmm, ffffmmmmmmmmmmfffff, fffmmmmmmmmmmmmffff, ffmmmmmmmmmmmmmffff, fmmmmmmmmmmmmmmmfff, mmmmmmmmmmmmmmmmmff, mmmmmmmmmmmmmmmmmmf, fffffffmmmmmmmmmmm, fffmmmmmmmmmmfffff, ffmmmmmmmmmmmfffff, fmmmmmmmmmmmmmffff, mmmmmmmmmmmmmmmfff, mmmmmmmmmmmmmmmmff, mmmmmmmmmmmmmmmmmf, ffffffmmmmmmmmmmm, ffmmmmmmmmmmfffff, fmmmmmmmmmmmmffff, mmmmmmmmmmmmmffff, mmmmmmmmmmmmmmfff, mmmmmmmmmmmmmmmff, mmmmmmmmmmmmmmmmf, fffffmmmmmmmmmmm, fmmmmmmmmmfffff, mmmmmmmmmmmfffff, mmmmmmmmmmmmffff, mmmmmmmmmmmmmfff, mmmmmmmmmmmmmmff, mmmmmmmmmmmmmmmf, ffffmmmmmmmmmmm, mmmmmmmmmffffff, mmmmmmmmmmfffff, mmmmmmmmmmmffff, mmmmmmmmmmmmfff, mmmmmmmmmmmmmff, mmmmmmmmmmmmmmf, fffmmmmmmmmmmm, fffffmmmmmmmmmmmffff, ffffmmmmmmmmmmmmffff, ffffmmmmmmmmmmmmmfff, fffmmmmmmmmmmmmmmmff, ffmmmmmmmmmmmmmmmmmf, fmmmmmmmmmmmmmmmmmmm, ffffffffmmmmmmmmmmm, fffffmmmmmmmmmmffff, ffffmmmmmmmmmmmmfff, fffmmmmmmmmmmmmmmff, fffmmmmmmmmmmmmmmmf, ffmmmmmmmmmmmmmmmmm, fmmmmmmmmmmmmmmmmmm, ffffffffmmmmmmmmmm, fffffmmmmmmmmmmfff, ffffmmmmmmmmmmmmff, fffmmmmmmmmmmmmmmf, fffmmmmmmmmmmmmmmm, ffmmmmmmmmmmmmmmmm, fmmmmmmmmmmmmmmmmm, ffffffffmmmmmmmm, fffffmmmmmmmmmff, ffffmmmmmmmmmmmf, ffffmmmmmmmmmmmm, fffmmmmmmmmmmmmm, ffmmmmmmmmmmmmmm, fmmmmmmmmmmmmmmm, ffffffffmmmmmmm, fffffmmmmmmmmmf, fffffmmmmmmmmmm, ffffmmmmmmmmmmm, fffmmmmmmmmmmmm, ffmmmmmmmmmmmmm, fmmmmmmmmmmmmmm, ffffffffmmmmmm, fffffmmmmmmmmm, ffffmmmmmmmmmm, fffmmmmmmmmmmm, fffmmmmmmmmmmm, ffmmmmmmmmmmmm, fmmmmmmmmmmmmm, ffffffffmmmmm, fffffmmmmmmmm, ffffmmmmmmmmm, fffmmmmmmmmmm, fffmmmmmmmmmm, ffmmmmmmmmmmm, ffffmmmmmmmm, fffmmmmmmmmm, ffffffffmm, fffffmmmmm, fffmmmmmmmmm, ffmmmmmmmmmm, fmmmmmmmmmmm, fmmmmmmmmmmmm, ffffffffmmm, fffffmmmmmm, ffffmmmmmm, ffffmmmmmmm, fffmmmmmmmm, ffmmmmmmmmm, fmmmmmmmmmm, ffffffffm, mmmmmmmmmmmmffffffff, fffffmmmmmmmmmmmmmmm, ffmmmmmmmmmfmmfmfffff, mmffffffmffmfmmmmm, mmmmmmmmmmmmmmmfffff, mfmfmfmfmfmfmfmfmfmf, mmmmmmffffffmmmmmmm, fffffmmmmmmmmmmfffff, mfmmffmmfmmfffmmmmfm, fmffmmffmffmmmffffmf, fmff, mffm, fmffm, mfmmf, fmmf, fmffmm, mfmmff, mmff, fmmff, mmffm, fmffmmf, mfmmffm, mfmm, mfmmf, mfmmff, fmffmmf, mfmmffm, mmffm, ffmmf, fmfff, mfffm, fmfffm, fmfffmm, mfmmfff, mmfff, fmmfff, mmfffm, fmfffmmf, mfmmfffm, mfmm, mfmmf, mfmmfff, fmfffmmf, mfmmfffm, mmfffm, fffmmf, mfmmmf, fmmmf, fmffmmm, mfmmmff, mmmff, fmmmff, mmmffm, fmffmmmf, mfmmmffm, mfmmm, mfmmmf, mfmmmff, fmffmmmf, mfmmmffm, mmmffm, ffmmmf, or any portion thereof comprising at least five consecutive modifications, wherein f is 2'-F and m is 2'-OMe.

In some embodiments, a provided oligonucleotide, e.g., a DMD oligonucleotide, comprises a pattern which comprises any of: O, OO, OOO, OOOO, OOOOO, OOOOOO, OOOOOOO, OOOOOOOO, OOOOOOOOO, OOOOOOOOOO, OOOOOOOOOOO, S, SS, SSS, SSSS, SSSSS, SSSSSS, SSSSSSS, SSSSSSSS, SSSSSSSSS, SSSSSSSSSS, SSSSSSSSSSS, X, XX, XXX, XXXX, XXXXX, XXXXXX, XXXXXXX, XXXXXXXX, XXXXXXXXX, XXXXXXXXXX, XXXXXXX, R, RR, RRR, RRRR, RRRRR, RRRRRR, RRRRRRR, RRRRRRRR, RRRRRRRRR, RRRRRRRRRR, RRRRRRRRRRR, OSOOO, OSOO, OSO, SOOO, OXOOO, OXOO, OXO, XOO, ROOOR, ROROR, RORОR, ROORR, RROOR, ROOR, OOR, RRROR, RRRO, RROR, ROR, SOOOR, ROOOS, ROOO, ROO, RO, OOOS, SOOOS, SOOO, SOOSS, SOSOS, SOSO, OSOS, SOS, SSOOS, SSOO, SSO, SOO, SSSOS, SSSO, SOS, XOOOX, XOOO, XOO, XO, OOOX, OOX, OX, SOOOS, SOOO, SOO, SO, OOOS, OOS, XXXXXXXXXXXXX, XXXXXXXXXXXX, XXXXXXXXXXX, XXXXXXXXXX, XXXXXX, XXXXXXXXX, XXXXXXX, XXXXXX, XXXXX, XXXX, SSSSRSSRSS, SSSSRSSRS, SSSSRSSR, SSSSRSS, SSSSRS, SSSS, SSS, SSSRSSRSS, SSRSSRSS, SRSSRSS, RSSRSS, SSRSS, SSRS, SSSRSSRSSS, SSRSSRSSS, SSSRSSRSS, SSRSSRSSSS, SRSSRSSSS, SSRSSRSSS, SSRSSSSSSS, SRSSSSSSS, SSRSSSSSS, SSSSSSRSSS, SSSSSRSSS, SSSSSSRSS, SSO, SOS, OSO, OSSO, SOS, SSOSS, SSOSSO, ssOSSOS, SSOS-SOSS, XO, XXO, XOX, XXOX, XXOXX, XXXOXX, XXXOX, XXOXX, XXXOXXX, XXOXXO, XXOXX, XXOXXOX, or XXOXXOXX, or any portion thereof comprising at least 5 consecutive internucleotidic linkages, wherein X is a stereorandom phosphorothioate linkage, S is a phosphorothioate linkage of the Sp configuration, and R is a phosphorothioate linkage of the Rp configuration.

Various oligonucleotides, including DMD oligonucleotides, having these modifications and patterns thereof, or portions thereof, are described in the present disclosure, including those listed in Table A1.

In some embodiments, a DMD oligonucleotide comprises a non-negatively charged internucleotidic linkage. Non-limiting examples of such an oligonucleotide include, inter alia: WV-11237, WV-11238, WV-11239, WV-11340, WV-11341, WV-11342, WV-11343, WV-11344, WV-11345, WV-11346, WV-11347, WV-12123, WV-12124, WV-12125, WV-12126, WV-12127, WV-12128, WV-12129, WV-12130, WV-12131, WV-12132, WV-12133, WV-12134, WV-12135, WV-12136, WV-12553, WV-12554, WV-12555, WV-12556, WV-12557, WV-12558, WV-12559, WV-12872, WV-12873, WV-12876, WV-12877, WV-12878, WV-12879, WV-12880, WV-12881, WV-12882, WV-12883, WV-12884, WV-12885, WV-12887, WV-12888, WV-13408, WV-13409, WV-13594, WV-13595, WV-13596, WV-13597, WV-13812, WV-13813, WV-13814, WV-13815, WV-13816, WV-13817, WV-13820, WV-13821, WV-13822, WV-13823, WV-13824, WV-13825, WV-13857, WV-13858, WV-13859, WV-13860, WV-13861, WV-13862, WV-13863, WV-13864, WV-13865, WV-14342, WV-14343, WV-14344, WV-14345, WV-14522, WV-14523, WV-14525, WV-14526, WV-14528, WV-14529, WV-14530, WV-14532, WV-14533, WV-14565, WV-14566, WV-14773, WV-14774, WV-14776, WV-14777, WV-14778, WV-14779, WV-14790, WV-14791, WV-15052, WV-15053, WV-15143, WV-15322, WV-15323, WV-15324, WV-15325, WV-15326, WV-15327, WV-15328, WV-15329, WV-15330, WV-15331, WV-15332, WV-15333, WV-15334, WV-15335, WV-15336, WV-15337, WV-15338, WV-15366, WV-15369, WV-15589, WV-15647, WV-15844, WV-15845, WV-15846, WV-15850, WV-15851, WV-15852, WV-15853, WV-15854, WV-15855, WV-15856, WV-15857, WV-15858, WV-15859, WV-15860, WV-15861, WV-15862, WV-15912, WV-15913, WV-15928, WV-15929, WV-15930, WV-15931, WV-15932, WV-15933, WV-15934, WV-15935, WV-15937, WV-15939, WV-15940, WV-15941, WV-15942, WV-15943, WV-15944, WV-15945, WV-15946, WV-15947, WV-15948, WV-15949, WV-15962, WV-15963, WV-15964, WV-15965, WV-15966, WV-15967, WV-15968, WV-15969, WV-15970, WV-15971, WV-15972, WV-15973, WV-16004, WV-16005, WV-16010, WV-16011, WV-16366, WV-16368, WV-16369, WV-16371, WV-16372, WV-16499, WV-16505, WV-16506, WV-16507, WV-17765, WV-17774, WV-17775, WV-17801, WV-17802, WV-17803, WV-17831, WV-17832, WV-17833, WV-17834, WV-17838, WV-17839, WV-17840, WV-17841, WV-17842, WV-17843, WV-17854, WV-17855, WV-17856, WV-17857, WV-17858, WV-17859, WV-17860, WV-17861, WV-17862, WV-17863, WV-17864, WV-17865, WV-17866, WV-17881, WV-17882, WV-17883, WV-18853, WV-18854, WV-18855, WV-18856, WV-18857, WV-18858, WV-18859, WV-18860, WV-18861, WV-18862, WV-18863, WV-18864, WV-18865, WV-18866, WV-18867, WV-18868, WV-18869, WV-18870, WV-18871, WV-18872, WV-18873, WV-18874, WV-18875, WV-18876, WV-18877, WV-18878, WV-18879, WV-18880, WV-18881, WV-18882, WV-18883, WV-18884, WV-18885, WV-18886, WV-18887, WV-18888, WV-18889, WV-18890, WV-18891, WV-18892, WV-18893, WV-18894, WV-18895, WV-18896, WV-18897, WV-18898, WV-18899, WV-18900, WV-18901, WV-18902, WV-18903, WV-18904, WV-18905, WV-18906, WV-18907, WV-18908, WV-18909, WV-18910, WV-18911, WV-18912, WV-18913, WV-18914, WV-18915, WV-18916, WV-18917, WV-18918, WV-18919, WV-18920, WV-18921, WV-18922, WV-18923, WV-18924, WV-18925, WV-18926, WV-18927, WV-18928, WV-18929, WV-18930, WV-18931, WV-18932, WV-18933, WV-18934, WV-18935, WV-18936, WV-18937, WV-18938, WV-18939, WV-18940, WV-18941, WV-18942, WV-18944, WV-18945, WV-19790, WV-19791, WV-19792, WV-19793, WV-19794, WV-19795, WV-19796, WV-19797, WV-19798, WV-19803, WV-19804, WV-19805, WV-19806, WV-19886, WV-19887, WV-19888, WV-19889, WV-19890, WV-19891, WV-19892, WV-19893, WV-19894, WV-19895, WV-19896, WV-19897, WV-19898, WV-19899, WV-19900, WV-19901, WV-19902, WV-19903, WV-19904, WV-19905, WV-19906, WV-19907, WV-19908, WV-19909, WV-19910, WV-19911, WV-19912, WV-19913, WV-19914, WV-19915, WV-19916, WV-19917, WV-19918, WV-19919, WV-19920, WV-19921, WV-19922, WV-19923, WV-19924, WV-19925, WV-19926, WV-19927, WV-19928, WV-19929, WV-19930, WV-19931, WV-19932, WV-19933, WV-19934, WV-19935, WV-19936, WV-19937, WV-19938, WV-19939, WV-19940, WV-19941, WV-19942, WV-19943, WV-19944, WV-19945, WV-19946, WV-19947, WV-19948, WV-19949, WV-19950, WV-19951, WV-19952, WV-19953, WV-19954, WV-19955, WV-19956, WV-19957, WV-19958, WV-19959, WV-19960, WV-19961, WV-19962, WV-19963, WV-19964, WV-19965, WV-19966, WV-19967, WV-19968, WV-19969, WV-19970, WV-19971, WV-19972, WV-19973, WV-19974, WV-19975, WV-19976, WV-19977, WV-19978, WV-19979, WV-19980, WV-19981, WV-19982, WV-19983, WV-19984, WV-19985, WV-19986, WV-19987, WV-19988, WV-19989, WV-19990, WV-19991, WV-19992, WV-19993, WV-19994, WV-19995, WV-19996, WV-19997, WV-19998, WV-19999, WV-20000, WV-20001, WV-20002, WV-20003, WV-20004, WV-20005, WV-20006, WV-20007, WV-20008, WV-20009, WV-20010, WV-20011, WV-20012, WV-20013, WV-20014, WV-20015, WV-20016, WV-20017, WV-20018, WV-20019, WV-20020, WV-20021, WV-20022, WV-20023, WV-20024, WV-20025, WV-20026, WV-20027, WV-20028, WV-20029, WV-20030, WV-20031, WV-20032, WV-20033, WV-20034, WV-20035, WV-20036, WV-20037, WV-20038, WV-20039, WV-20040, WV-20041, WV-20042, WV-20043, WV-20044, WV-20045, WV-20046, WV-20047, WV-20048, WV-20049, WV-20050, WV-20051, WV-20052, WV-20053, WV-20054, WV-20055, WV-20056, WV-20057, WV-20058, WV-20059, WV-20060, WV-20061, WV-20062, WV-20063, WV-20064, WV-20065, WV-20066, WV-20067, WV-20068, WV-20069, WV-20070, WV-20071, WV-20072, WV-20073, WV-20074, WV-20075, WV-20076, WV-20077, WV-20078, WV-20079, WV-20080, WV-20081, WV-20082, WV-20083, WV-20084, WV-20085, WV-20086, WV-20087, WV-20088, WV-20089, WV-20090, WV-20091, WV-20092, WV-20093, WV-20094, WV-20095, WV-20096, WV-20097, WV-20098, WV-20099, WV-20100, WV-20101, WV-20102, WV-20103, WV-20104, WV-20105, WV-20106, WV-20107, WV-20108, WV-20109, WV-20110, WV-20111, WV-20112, WV-20113, WV-20114, WV-20115, WV-20116, WV-20117, WV-20118, WV-20119, WV-20120, WV-20121, WV-20122, WV-20123, WV-20124, WV-20125, WV-20126, WV-20127, WV-20128, WV-20129, WV-20130, WV-20131, WV-20132, WV-20133, WV-20134, WV-20135, WV-20136, WV-20137, WV-20138, WV-20139, WV-20140, WV-20141, WV-20142, WV-20143, WV-20144, WV-20145, WV-20146, WV-20147, WV-20148, WV-20149, WV-20150, WV-20151, WV-20152, WV-20153, WV-20154, WV-20155, WV-20156, WV-20157, WV-20158, WV-20159, WV-20160, WV-21210, WV-21211, WV-21212, WV-21217, WV-21218, WV-21219, WV-21226, WV-21245, WV-21252, WV-21253, WV-21257, WV-21258, WV-21374, WV-21375, WV-21376, WV-21377, WV-21378, WV-21379, WV-21380, WV-21381, WV-21382, WV-21383, WV-21384, WV-21385, WV-21386, WV-21387, WV-21388, WV-21389, WV-21390, WV-21578, WV-21579, WV-21580, WV-21581, WV-21582, WV-21583, WV-21584, WV-21585, WV-21586, WV-21587, WV-21588, WV-21589, WV-21590, WV-21591, WV-21592, WV-21593, WV-21594, WV-21595, WV-21596, WV-21597, WV-21598, WV-21599, WV-21600, WV-21601, WV-21602, WV-21603, WV-21604, WV-21605, WV-21606, WV-21607, WV-21608, WV-21609, WV-21610, WV-21611, WV-21612, WV-21613, WV-21614, WV-21615, WV-21616, WV-21617, WV-21618, WV-21619, WV-21620, WV-21621, WV-21622, WV-21623, WV-21624, WV-21625, WV-21626, WV-21627, WV-21628, WV-21629, WV-21630, WV-21631, WV-21632, WV-21633, WV-21634, WV-21635, WV-21636, WV-21637, WV-21638, WV-21639, WV-21640, WV-21641, WV-21642, WV-21643, WV-21644, WV-21645, WV-21646, WV-21647, WV-21648, WV-21649, WV-21650, WV-21651, WV-21652, WV-21653, WV-21654, WV-21655, WV-21656, WV-21657, WV-21658, WV-21659, WV-21660, WV-21661, WV-21662, WV-21663, WV-21664, WV-21665, WV-21666, WV-21667, WV-21668, WV-21669, WV-21670, WV-21671, WV-21672, WV-21673, WV-21723, WV-21724, WV-21725, WV-21726, WV-21727, WV-21728, WV-21729, WV-21730, WV-21731, WV-21732, WV-21733, WV-21734, WV-21735, WV-21736, WV-21737, WV-21738, WV-21739, WV-21740, WV-21741, WV-21742, WV-21743, WV-21744, WV-21745, WV-21746, WV-21747, WV-21748, WV-21749, WV-21750, WV-21751, WV-21752, WV-21753, WV-21754, WV-21755, WV-21756, WV-21757, WV-21758, WV-21759, WV-21760, WV-21761, WV-21762, WV-21763, WV-21764, WV-21765, WV-21766, WV-21767, WV-21768, WV-21769, WV-21770, WV-21771, WV-21772, WV-21773, WV-21774, WV-21775, WV-21776, WV-21777, WV-21778, WV-21779, WV-21780, WV-21781, WV-21782, WV-21783, WV-21784, WV-21785, WV-21786, WV-21787, WV-21788, WV-21789, WV-21790, WV-21791, WV-21792, WV-21793, WV-21794, WV-21795, WV-21796, WV-21797, WV-21798, WV-21799, WV-21800, WV-21801, WV-21802, WV-21803, WV-21804, WV-21805, WV-21806, WV-21807, WV-21808, WV-21809, WV-21810, WV-21811, WV-21812, WV-21813, WV-21814, WV-21815, WV-21816, WV-21817, WV-21818, WV-22753, WV-23576, WV-23577, WV-23578, WV-23579, WV-23936, WV-23937, WV-23938, and WV-23939.

Example Dystrophin Oligonucleotides and Compositions for Exon Skipping of Exon 23

In some embodiments, the present disclosure provides oligonucleotides, oligonucleotide compositions, and methods of use thereof for mediating skipping of exon 23 in mouse DMD. Non-limiting examples include oligonucleotides and compositions of WV-10256, WV-10257, WV-10258, WV-10259, WV-10260, WV-1093, WV-1094, WV-1095, WV-1096, WV-1097, WV-1098, WV-1099, WV-1100, WV-1101, WV-1102, WV-1103, WV-1104, WV-1105, WV-1106, WV-1121, WV-1122, WV-1123, WV-11231, WV-11232, WV-11233, WV-11234, WV-11235, WV-11236, WV-1124, WV-1125, WV-1126, WV-1127, WV-1128, WV-1129, WV-1130, WV-11343, WV-11344, WV-11345, WV-11346, WV-11347, WV-1141, WV-1142, WV-1143, WV-1144, WV-1145, WV-1146, WV-1147, WV-1148, WV-1149, WV-1150, WV-1678, WV-1679, WV-1680, WV-1681, WV-1682, WV-1683, WV-1684, WV-1685, WV-2733, WV-2734, WV-4610, WV-4611, WV-4614, WV-4615, WV-4616, WV-4617, WV-4618, WV-4619, WV-4620, WV-4621, WV-4622, WV-4623, WV-4624, WV-4625, WV-4626, WV-4627, WV-4628, WV-4629, WV-4630, WV-4631, WV-4632, WV-4633, WV-4634, WV-4635, WV-4636, WV-4637, WV-4638, WV-4639, WV-4640, WV-4641, WV-4642, WV-4643, WV-4644, WV-4645, WV-4646, WV-4647, WV-4648, WV-4649, WV-4650, WV-4651, WV-4652, WV-4653, WV-4654, WV-4655, WV-4656, WV-4657, WV-4658, WV-4659, WV-4660, WV-4661, WV-4662, WV-4663, WV-4664, WV-4665, WV-4666, WV-4667, WV-4668, WV-4669, WV-4670, WV-4671, WV-4672, WV-4673, WV-4674, WV-4675, WV-4676, WV-4677, WV-4678, WV-4679, WV-4680, WV-4681, WV-4682, WV-4683, WV-4684, WV-4685, WV-4686, WV-4687, WV-4688, WV-4689, WV-4690, WV-4691, WV-4692, WV-4693, WV-4694, WV-4695, WV-4696, WV-4697, WV-6010, WV-7677, WV-7678, WV-7679, WV-7680, WV-7681, WV-7682, WV-7683, WV-7684, WV-7685, WV-7686, WV-7687, WV-7688, WV-7689, WV-7690, WV-7691, WV-7692, WV-7693, WV-7694, WV-7695, WV-7696, WV-7697, WV-7698, WV-7699, WV-7700, WV-7701, WV-7702, WV-7703, WV-7704, WV-7705, WV-7706, WV-7707, WV-7708, WV-7709, WV-7710, WV-7711, WV-7712, WV-7713, WV-7714, WV-7715, WV-7716, WV-7717, WV-7718, WV-7719, WV-7720, WV-7721, WV-7722, WV-7723, WV-7724, WV-7725, WV-7726, WV-7727, WV-7728, WV-7729, WV-7730, WV-7731, WV-7732, WV-7733, WV-7734, WV-7735, WV-7736, WV-7737, WV-7738, WV-7739, WV-7740, WV-7741, WV-7742, WV-7743, WV-7744, WV-7745, WV-7746, WV-7747, WV-7748, WV-7749, WV-7750, WV-7751, WV-7752, WV-7753, WV-7754, WV-7755, WV-7756, WV-7757, WV-7758, WV-7759, WV-7760, WV-7761, WV-7762, WV-7763, WV-7764, WV-7765, WV-7766, WV-7767, WV-7768, WV-7769, WV-7770, WV-7771, WV-9163, WV-9164, WV-9165, WV-9166, WV-9167, WV-9168, WV-9169, WV-9170, WV-9171, WV-9172, WV-9173, WV-9174, WV-9175, WV-9176, WV-9177, WV-9178, WV-9179, WV-9180, WV-9181, WV-9182, WV-9183, WV-9184, WV-9185, WV-9186, WV-9187, WV-9188, WV-9189, WV-9190, WV-9191, WV-9192, WV-9193, WV-9194, WV-9195, WV-9196, WV-9197, WV-9198, WV-9199, WV-9200, WV-9201, WV-9202, WV-9203, WV-9204, WV-9205, WV-9206, WV-9207, WV-9208, WV-9209, WV-9210, WV-9408, WV-9409, WV-9410, WV-9411, WV-9412, WV-9413, WV-9414, WV-9415, WV-9416, WV-9417, WV-9418, WV-9419, WV-9420, WV-943, WV-9875, WV-9876, WV-9877, WV-9878, and WV-9879, and other oligonucleotides having a base sequence which comprises at least 15 contiguous bases of any of these DMD oligonucleotides.

In some embodiments, a DMD oligonucleotide is capable of mediating skipping of exon 23. Non-limiting examples of such DMD oligonucleotides include: WV-12566, WV-12567, WV-12568, WV-12884, WV-12885, WV-12886, WV-12887, WV-12888, WV-12571, and WV-12572, and other DMD oligonucleotides having a base sequence which comprises at least 15 contiguous bases of any of these DMD oligonucleotides.

Exon skipping of DMD exon 23 and other exons may be assayed in patient-derived cell lines and in cells from the mdx mouse model (which carries a nonsense point mutation in the in-frame exon 23 (Sicinski et al. 1989 Science 244: 1578-1580). By skipping exon 23 the nonsense mutation is bypassed while the reading frame is maintained). Additional strains of mdx mice, including the mdx2cv mdx4cv and mdx5cv alleles were reported by Wha Bin Im et al. 1996 Hum. Mol. Gen. 5: 1149-1153.

Data showing the capability of various DMD oligonucleotides to mediate skipping of exon 23 is shown herein, inter alia, in Table 1A.1, Table 1A.2, Table 1A.3, and Table 25C.1 to Table 25C.5.

Example Dystrophin Oligonucleotides and Compositions Targeting Exon 44 and Adjoining Intronic Region 3' to Exon 44

In some embodiments, a DMD oligonucleotide targets DMD exon 44 or the adjoining intronic region 3' to DMD exon 44.

In some embodiments, a DMD oligonucleotide targets DMD exon 44 or the adjoining intronic region 3' to DMD exon 44, and the oligonucleotide is capable of mediating multiple exon skipping (e.g., of exons 45 to 55, or 45 to 57).

Reportedly, a phenomenon known as back-splicing can occur, in which, for example, a portion of the 3' end of exon 55 interacts with a portion of the 5' end of exon 45, forming a circular RNA (circRNA), which can thus skip multiple exons, e.g., all exons from exon 45 to 55, inclusive. The phenomenon can also reportedly occur between exon 57 and exon 45, skipping multiple exons, e.g., all exons from exon 45 to 57, inclusive. Back-splicing is described in the literature, e.g., in Suzuki et al. 2016 Int. J. Mol. Sci. 17.

Without wishing to be bound by any particular theory, the present disclosure suggests that it may be possible for a DMD oligonucleotide targeting DMD exon 44 or the adjoining intronic region 3' to exon 44 may be able to mediate splicing of exons 45 to 55, or of exons 45 to 57, which exons are excised as a single piece of circular RNA (circRNA) designated 45-55 (or 55-45) or 45-57 (or 57-45), respectively.

Several oligonucleotides were designed to target exon 44 or intron 44, or which straddle exon 44 and intron 44. In some embodiments, oligonucleotides designed to target exon 44 or intron 44, or which straddle exon 44 and intron 44 are tested to determine if they can increase the amount of backslicing and/or multiple-exon skipping.

In some embodiments, the present disclosure provides oligonucleotides, oligonucleotide compositions, and methods of use thereof for mediating exon skipping in human DMD, wherein the base sequence of the oligonucleotide is a sequence of exon 44 or intron 44, or a portion of both exon 44 and intron 44. Non-limiting examples include oligonucleotides and compositions of WV-13963, WV-13964, WV-13965, WV-13966, WV-13967, WV-13968, WV-13969, WV-13970, WV-13971, WV-13972, WV-13973, WV-13974, WV-13975, WV-13976, WV-13977, WV-13978, WV-13979, WV-13980, WV-13981, WV-13982, WV-13983, WV-13984, WV-13985, WV-13986, WV-13987, WV-13988, WV-13989, WV-13990, WV-13991, WV-13992, WV-13993, WV-13994, WV-13995, WV-13996, WV-13997, WV-13998, WV-13999, WV-14000, WV-14001, WV-14002, WV-14003, WV-14004, WV-14005, WV-14006, WV-14007, WV-14008, WV-14009, WV-14010, WV-14011, WV-14012, WV-14013, WV-14014, WV-14015, WV-14016, WV-14017, WV-14018, WV-14019, WV-14020, WV-14021, WV-14022, WV-14023, WV-14024, WV-14025, WV-14026, WV-14027, WV-14028, WV-14029, WV-14030, WV-14031, WV-14032, WV-14033, WV-14034, WV-14035, WV-14036, WV-14037, WV-14038, WV-14039, WV-14040, WV-14041, WV-14042, WV-14043, WV-14044, WV-14045, WV-14046, WV-14047, WV-14048, WV-14049, WV-14050, WV-14051, WV-14052, WV-14053, WV-14054, WV-14055, WV-14056, WV-14057, and WV-14058, and other oligonucleotides having a base sequence which comprises at least 15 contiguous bases of any of these DMD oligonucleotides.

Data showing the capability of various DMD oligonucleotides targeting exon 44 or the adjacent intron 3' to exon 44 are shown in Table 22A.2 and Table 22A.3.

TABLE 1A.1

Example data of certain oligonucleotides

| Oligo-nucleotide | 10 | 3.33 | 1.11 | 0.37 | 0.12 |
|---|---|---|---|---|---|
| WV-7684 | 4.2 | 2.1 | 1 | 0.2 | 0.1 |
| | 4.1 | 2.1 | 0.9 | 0.2 | 0.1 |
| | 5.2 | 3.2 | 1.5 | 0 | 0 |
| | 5.1 | 3.3 | 1.1 | 0 | 0 |
| WV-12886 | 27.7 | 17.5 | 10 | 5 | 2.4 |
| | 28 | 17.6 | 9.8 | 5 | 2.3 |
| | 29.8 | 22.8 | 13.1 | | 3.7 |
| | 32.7 | 21.5 | 11.9 | | 3.5 |
| WV-11231 | 3.8 | 2.1 | 1.4 | 0.4 | 0.3 |
| | 3.8 | 2.1 | 1.3 | 0.5 | 0.3 |
| | 5.3 | 2.7 | 1.4 | 0.7 | 0.2 |
| | 5.1 | 2.4 | 1.6 | 0.8 | 0.2 |
| WV-10258 | 24.5 | 19.9 | 9.5 | 4.8 | 2.8 |
| | 25.3 | 20.1 | 9.1 | 4.8 | 2.7 |
| | 24.4 | 19.4 | 13.2 | 6.2 | 3.4 |
| | 24.2 | 19.7 | 13.6 | 6.3 | 3.5 |
| WV-11345 | 29.2 | 24.9 | 15.9 | 12.1 | 5 |
| | 30.2 | 24.9 | 15.5 | 11.9 | 5.1 |
| | 30.8 | 25.8 | 17.8 | | |
| | 32.3 | 25.3 | 17.6 | | |
| WV-12885 | 26.8 | 23.3 | 16.5 | 8 | 2.8 |
| | 27.5 | 23 | 17.2 | 8.2 | 3.8 |
| | 32.3 | 25.8 | 16.3 | | 6.1 |
| | 30.7 | 27.1 | 16.3 | | 6.3 |
| WV-15589 | 22.2 | 14.8 | 11.2 | 4.6 | 2.2 |
| | 21.7 | 15 | 12.3 | 4.4 | 2.3 |
| | 24.1 | 11.3 | 11.4 | | |
| | 23.5 | 8.6 | 10.8 | | |

Oligonucleotides to DMD exon 23 were tested in vitro for their ability to induce skipping of exon 23.

H2K cells were dosed with oligonucleotide in differentiation media for 4 days. RNA was extracted with Trizol, pre-amp then treated with TaqMan with multiplexed reading of skipped and total DMD transcript; absolute quantification was via standard curve g-Blocks. In these and various other studies, numbers indicate amount of skipping (i.e., skipping efficiency; or the percentage of skipping as a percentage of total mRNA transcript).

Oligonucleotides were tested at 10, 3.33, 1.11, 0.37 or 0.12 uM.

TABLE 1A.2

Activity of certain oligonucleotides

| PBS | | WV-11345 | | WV-17774 | | WV-18945 | |
|---|---|---|---|---|---|---|---|
| Quadriceps | | | | | | | |
| 0.01 | 0.01 | 28.61 | 30.25 | 3.93 | 3.92 | 2.1 | 1.53 |
| 0.01 | 0.12 | 26.34 | 24.53 | 10.82 | 10.73 | 1.16 | 0.91 |
| 0.15 | 0.06 | 40.29 | 36.57 | 14.79 | 13.47 | 2.04 | 0.92 |

TABLE 1A.2-continued

Activity of certain oligonucleotides

| PBS | | WV-11345 | | WV-17774 | | WV-18945 | |
|---|---|---|---|---|---|---|---|
| | | 30 | 30.05 | 10.13 | 6.19 | 5.05 | 3.97 |
| | | 23.24 | 25.18 | 13.92 | 14.36 | 2.4 | 1.77 |
| Gastrocnemius | | | | | | | |
| 0.02 | 0.02 | 22.27 | 13.18 | 36.41 | 33.55 | 2.46 | 1.95 |
| 0.02 | 0.01 | 14.74 | 8.03 | 18.02 | 19.55 | 0.6 | 0.27 |
| 0.09 | 0.11 | 11.12 | 3.68 | 16.17 | 15.44 | 0.36 | 0.41 |
| | | 22.82 | 28.29 | 11.22 | 10.94 | 0.72 | 0.75 |
| | | 18.09 | 15.66 | 28.85 | 27.9 | 0.61 | 3.14 |
| Diaphram | | | | | | | |
| 0.04 | 0.03 | 27.05 | 24 | 7.11 | 4.07 | 0.72 | 0.82 |
| 0.01 | 1.13 | 16.22 | 16.2 | 18.1 | 18.6 | 0.81 | 0.68 |
| 0.04 | 0.09 | 15.16 | 13.23 | 9.66 | 10.02 | 0.33 | 0.32 |
| | | 33.66 | 36.52 | 4.55 | 4.86 | 0.63 | 0.21 |
| | | 20.03 | 20.55 | 8.38 | 9.46 | 0.56 | 0.91 |
| Tibialis | | | | | | | |
| 0.01 | 0.01 | 34.34 | 35.04 | 16.2 | 15.77 | 0 | 0 |
| 0 | 0 | 28.7 | 23.07 | 42.94 | 42.97 | | |
| 0.04 | 0.02 | 7.87 | 9.87 | 12.1 | 14.51 | | |
| | | 17.01 | 14.68 | 15.16 | 13.91 | | |
| | | 45.6 | 41.54 | | | | |

In this study, in vivo skipping activity was measured in MDX mouse model after single IV dose.

MDX mice received single IV dose of 150 mg/kg. Necropsied flash frozen tissues (Quadriceps, Diaphragm, etc.) were pulverized and RNA extracted with Trizol. Skipping efficiency was determined by multiplex TaqMan assay for 'total' and 'exon-23 skipped' DMD transcripts, normalized to gBlock standard curves.

Numbers indicate amount of skipping DMD exon 23 (as a percentage of total mRNA, where 100 would represent 100% skipped).

TABLE 1A.3

Activity of certain oligonucleotides

| | 10 uM | 3.3 uM | 1.1 uM | 0.3 uM | 0.1 uM |
|---|---|---|---|---|---|
| WV-10258 | 32.1 | 17.7 | 11.1 | 3.9 | 1.9 |
| | 33.2 | 19.4 | 13 | 4.6 | 2.1 |
| | 29 | 18.5 | 11.5 | 11.1 | 6.4 |
| | 29 | 18.6 | 12.4 | 11.3 | 6 |
| WV-11233 | 6.8 | 7.6 | 0.7 | 1.6 | 0.1 |
| | 6.9 | 7.8 | 0.5 | 1.3 | 0 |
| | 11.1 | 1.3 | 1.6 | 0.6 | 0.7 |
| | 11 | 1.3 | 1.6 | 0.4 | 0.7 |
| WV-11345 | | | | | |
| | 42 | 29.3 | 16.6 | 8.1 | 5 |
| | 40 | 27.4 | 17.4 | 8.2 | 4.7 |
| WV-18944 | | | | | |
| | 7.7 | 4 | 1.4 | 1 | 0.7 |
| | 8 | 4 | 1.7 | 1 | 0.8 |
| WV-17774 | 44.5 | 38.2 | 26.7 | 11.9 | 6.6 |
| | 45.2 | 37.5 | 26.3 | 12.5 | 6.6 |
| | 44 | 37.2 | 26.7 | 14.7 | 4.8 |
| | 44.7 | 35.6 | 27.2 | 13.2 | 4.5 |
| WV-18945 | 14.1 | 11.6 | 5 | 1.9 | 1.5 |
| | 14.3 | 11.2 | 4.8 | 2 | 1.5 |
| | 21.4 | 11.4 | 4.7 | 2.4 | 2.6 |
| | 21.3 | 11.1 | 4.7 | 2.3 | 3 |
| Mock | 0.2 | | 0.6 | 0 | |
| | 0.3 | | 0.8 | 0 | |
| | 2.5 | 0 | 0.3 | 2.5 | 1.2 |
| | 2 | 0 | 0.4 | 2.5 | 1.1 |

Oligonucleotides were tested in vitro for ability to skip DMD exon 23.

Oligonucleotides were tested at 10, 3.3., 1.1, 0.3, and 0.1 uM.

Numbers indicate amount of skipping DMD exon 23 (as a percentage of total mRNA, where 100 would represent 100% skipped).

Example Dystrophin Oligonucleotides and Compositions for Exon Skipping of Exon 45

In some embodiments, the present disclosure provides oligonucleotides, oligonucleotide compositions, and methods of use thereof for mediating skipping of exon 45 in DMD (e.g., of mouse, human, etc.).

In some embodiments, a provided DMD oligonucleotide and/or composition is capable of mediating skipping of exon 45. Non-limiting examples of such DMD oligonucleotides and compositions include those of: WV-11047, WV-11048, WV-11049, WV-11050, WV-11051, WV-11052, WV-11053, WV-11054, WV-11055, WV-11056, WV-11057, WV-11058, WV-11059, WV-11060, WV-11061, WV-11062, WV-11063, WV-11064, WV-11065, WV-11066, WV-11067, WV-11068, WV-11069, WV-11070, WV-11071, WV-11072, WV-11073, WV-11074, WV-11075, WV-11076, WV-11077, WV-11078, WV-11079, WV-11080, WV-11081, WV-11082, WV-11083, WV-11084, WV-11085, WV-11086, WV-11087, WV-11088, WV-11089, WV-11090, WV-11091, WV-11092, WV-11093, WV-11094, WV-11095, WV-11096, WV-11097, WV-11098, WV-11099, WV-11100, WV-11101, WV-11102, WV-11103, WV-11104, WV-11105, WV-9594, WV-9595, WV-9596, WV-9597, WV-9598, WV-9599, WV-9600, WV-9601, WV-9602, WV-9603, WV-9604, WV-9605, WV-9606, WV-9607, WV-9608, WV-9609, WV-9610, WV-9611, WV-9612, WV-9613, WV-9614, WV-9615, WV-9616, WV-9617, WV-9618, WV-9619, WV-9620, WV-9621, WV-9622, WV-9623, WV-9624, WV-9625, WV-9626, WV-9627, WV-9628, WV-9629, WV-9630, WV-9631, WV-9632, WV-9633, WV-9634, WV-9635, WV-9636, WV-9637, WV-9638, WV-9639, WV-9640, WV-9641, WV-9642, WV-9643, WV-9644, WV-9645, WV-9646, WV-9647, WV-9648, WV-9649, WV-9650, WV-9651, WV-9652, WV-9653, WV-9654, WV-9655, WV-9656, WV-9657, WV-9658, WV-9659, WV-9762, WV-9763, WV-9764, WV-9765, WV-9766, WV-9767, WV-9768, WV-9769, WV-9770, WV-9771, WV-9772, WV-9773, WV-9774, WV-9775, WV-9776, WV-9777, WV-9778, WV-9779, WV-9780, WV-9781, WV-9782, WV-9783, WV-9784, WV-9785, WV-9786, WV-9787, WV-9788, WV-9789, WV-9790, WV-9791, WV-9792, WV-9793, WV-9794, WV-9795, WV-9796, WV-9797, WV-9798, WV-9799, WV-9800, WV-9801, WV-9802, WV-9803, WV-9804, WV-9805, WV-9806, WV-9807, WV-9808, WV-9809, WV-9810, WV-9811, WV-9812, WV-9813, WV-9814, WV-9815, WV-9816, WV-9817, WV-9818, WV-9819, WV-9820, WV-9821, WV-9822, WV-9823, WV-9824, WV-9825, and WV-9826, and other DMD oligonucleotides having a base sequence which comprises at least 15 contiguous bases of any of these DMD oligonucleotides.

As shown in various tables from Table 1 to Table 22 (and parts thereof), various DMD oligonucleotides comprising various patterns of modifications were testing for skipping of various exons. The Tables show test results of certain DMD oligonucleotides. To assay exon skipping of DMD, certain DMD oligonucleotides were tested in vitro in Δ52 human patient-derived myoblast cells (also designated DEL52) and/or Δ45-52 human patient-derived myoblast cells (human cells wherein the exon 52 or exons 45-52 were already deleted, also designated DEL45-52). Unless noted otherwise, in various experiments, oligonucleotides were delivered gymnotically. In the tables, generally, 100.00 would represent 100% skipping and 0.0 would represent 0% skipping. Various DMD oligonucleotides are described in detail in Table A1.

Table 1A.4, below, shows example data of some DMD oligonucleotides in skipping exon 45. Procedure: Δ48-50 (Del48-50 or D48-50) myoblasts were treated with 10 uM oligonucleotides for 4 days in differentiation media.

TABLE 1A.4

Example data of certain oligonucleotides.

| | | | | |
|---|---|---|---|---|
| WV-11047 | 0.024 | 0.009 | 0.012 | 0.016 |
| WV-11051 | 0.022 | 0.024 | 0.046 | 0.014 |
| WV-11052 | 0.024 | 0.032 | 0.014 | 0.026 |
| WV-11053 | 0.027 | 0.009 | 0.017 | 0.023 |
| WV-11054 | 0.029 | 0.038 | 0.035 | 0.028 |
| WV-11055 | 0.030 | 0.025 | 0.016 | 0.033 |
| WV-11056 | 0.029 | 0.043 | 0.018 | 0.031 |
| WV-11057 | 0.000 | 0.015 | 0.000 | 0.032 |
| WV-11058 | 0.044 | 0.029 | 0.049 | 0.024 |
| WV-11059 | 0.025 | 0.041 | 0.049 | 0.024 |
| WV-11062 | 0.218 | 0.175 | 0.151 | 0.231 |
| WV-11063 | 0.472 | 0.730 | 0.456 | 0.594 |
| WV-11064 | 0.297 | 0.307 | 0.334 | 0.345 |
| WV-11065 | 0.651 | 0.630 | 0.675 | 0.544 |
| WV-11066 | 0.124 | 0.087 | 0.137 | 0.153 |
| WV-11067 | 0.183 | 0.210 | 0.238 | 0.224 |
| WV-11068 | 0.212 | 0.266 | 0.244 | 0.406 |
| WV-11069 | 0.389 | 0.715 | 0.407 | 0.744 |
| WV-11070 | 1.677 | 1.473 | 1.483 | 1.677 |
| WV-11071 | 0.385 | 0.362 | 0.413 | 0.310 |
| WV-11072 | 0.146 | 0.250 | 0.142 | 0.268 |
| WV-11073 | 0.709 | 0.876 | 0.721 | 0.835 |
| WV-11074 | 2.015 | 2.207 | 1.992 | 2.527 |
| WV-11075 | 0.254 | 0.238 | 0.157 | 0.220 |
| WV-11076 | 0.000 | 2.715 | 0.000 | 2.315 |
| WV-11077 | 1.568 | 1.414 | 1.388 | 1.308 |
| WV-11078 | 3.915 | 3.122 | 4.175 | 3.076 |
| WV-11079 | 7.178 | 8.083 | 8.257 | 6.955 |
| WV-11080 | 1.467 | 1.202 | 1.726 | 1.155 |
| WV-11081 | 9.279 | 4.780 | 10.244 | 4.512 |
| WV-11082 | 3.377 | 2.646 | 3.242 | 2.256 |
| WV-11083 | 3.964 | 2.631 | 4.001 | 2.419 |
| WV-11084 | 11.336 | 7.481 | 13.752 | 8.270 |
| WV-11085 | 1.818 | 0.679 | 1.787 | 2.003 |
| WV-11086 | 16.017 | 15.215 | 17.207 | 15.191 |
| WV-11087 | 1.104 | 0.766 | 1.728 | 1.030 |
| WV-11088 | 14.320 | 12.940 | 14.287 | 10.746 |
| WV-11089 | 16.126 | 13.507 | 15.515 | 15.389 |
| WV-11090 | 1.148 | 0.596 | 1.405 | 0.647 |
| WV-11091 | 0.105 | 0.069 | 0.311 | 0.049 |
| WV-11092 | 0.094 | 0.066 | 0.111 | 0.066 |
| WV-11093 | 0.123 | 0.060 | 0.087 | 0.037 |
| WV-11094 | 0.054 | 0.062 | 0.060 | 0.038 |
| WV-11095 | 0.317 | 0.064 | 0.241 | 0.109 |
| WV-11096 | 0.062 | 0.061 | 0.096 | 0.059 |
| WV-11098 | 0.026 | 0.033 | 0.032 | 0.024 |
| WV-11100 | 0.015 | 0.012 | 0.014 | 0.011 |
| WV-11101 | 0.000 | 0.021 | 0.000 | 0.011 |
| WV-11102 | 0.019 | 0.030 | 0.025 | 0.017 |
| WV-11103 | 0.017 | 0.023 | 0.014 | 0.029 |
| WV-11104 | 0.053 | 0.050 | 0.067 | 0.035 |
| WV-11105 | 0.017 | 0.033 | 0.034 | 0.051 |
| Mock | 0.050 | 0.018 | 0.010 | 0.037 |
| Mock | 0.019 | 0.023 | 0.009 | 0.023 |

Numbers represent level of skipping, wherein 100 would represent 100% skipping and 0 would represent 0% skipping. For various data described herein, "Mock" is a negative control, in which water was used instead of an oligonucleotide.

Table 1B.1, and 1B.2. Example data of certain oligonucleotides.

The Tables below show example data of some DMD oligonucleotides in skipping exon 45. Procedure: Δ48-50 (Del48-

50 or DEL48-50 or D48-50) myoblasts were treated with 10 or 3 uM oligonucleotides for 4 days in differentiation media. Oligonucleotides were dosed at 10 µM and 3 µM for 4 days in DEL48-50 Myoblasts. Certain oligonucleotides comprise a non-negatively charged internucleotidic linkage, as detailed in Table A1.

TABLE 1B.1

Example data of certain oligonucleotides.

| | 10 um | | | | 3 um | | | |
|---|---|---|---|---|---|---|---|---|
| WV-13810 | 7.0 | 6.5 | 7.1 | 6.5 | 2.7 | 2.8 | 2.5 | 2.3 |
| WV-13811 | 8.4 | 8.0 | 9.1 | 9.5 | 3.3 | 3.2 | 2.4 | 2.8 |
| WV-13812 | 22.8 | 21.1 | 22.9 | 23.7 | 9.2 | 9.2 | 10.0 | 9.7 |
| WV-13813 | 19.4 | 19.9 | 20.1 | 20.2 | 7.6 | 8.1 | 7.5 | 7.4 |
| WV-13814 | 13.6 | 13.6 | 13.5 | 13.3 | 5.1 | 4.3 | 4.9 | 4.9 |
| WV-13815 | 26.9 | 25.6 | 23.9 | 24.3 | 9.0 | 8.9 | 8.2 | 8.6 |
| WV-13816 | 37.0 | 35.0 | 31.8 | 33.8 | 14.0 | 14.5 | 14.6 | 12.0 |
| WV-13817 | 52.7 | 55.4 | 54.3 | 54.2 | 24.9 | 26.1 | 21.9 | 21.7 |
| WV-14531 | 2.9 | 2.7 | 2.8 | 2.9 | 0.7 | 0.9 | 1.0 | 1.2 |
| WV-14532 | 4.3 | 4.3 | 3.8 | 4.1 | 1.4 | 1.3 | 1.1 | 1.0 |
| WV-14533 | 7.9 | 7.6 | 7.3 | 7.9 | 1.9 | 2.1 | 2.4 | 2.1 |
| WV-11086 | 18.3 | 20.1 | 18.4 | 18.4 | 7.9 | 7.7 | 7.6 | 8.1 |

TABLE 1B.2

Example data of certain oligonucleotides.

| | 10 uM | | | | 3 uM | | | |
|---|---|---|---|---|---|---|---|---|
| WV-13818 | 3.2 | 2.8 | 3.2 | 2.9 | 0.9 | 0.8 | 1.1 | 1.2 |
| WV-13819 | 3.8 | 3.8 | 3.0 | 2.9 | 1.0 | 0.9 | 0.9 | 1.0 |
| WV-13820 | 6.6 | 6.7 | 6.4 | 6.3 | 3.2 | 3.0 | 2.9 | 3.0 |
| WV-13821 | 7.4 | 6.5 | 7.4 | 6.9 | 2.2 | 1.9 | 2.5 | 1.9 |
| WV-13822 | 9.5 | 9.5 | 8.1 | 8.6 | 3.4 | 3.5 | 3.4 | 3.9 |
| WV-13823 | 10.4 | 10.9 | 11.2 | 10.5 | 4.2 | 5.0 | 4.1 | 4.4 |
| WV-13824 | 17.1 | 16.3 | 16.1 | 15.6 | 8.1 | 7.6 | 7.1 | 7.0 |
| WV-13825 | 20.1 | 19.3 | 22.5 | 20.6 | 9.9 | 9.8 | 9.0 | 9.6 |
| WV-14527 | 2.2 | 1.9 | 1.4 | 2.0 | 0.7 | 0.7 | 0.9 | 0.7 |
| WV-14528 | 2.3 | 2.2 | 2.5 | 2.4 | 1.0 | 0.9 | 1.0 | 1.0 |
| WV-14529 | 5.2 | 1.8 | 2.0 | 2.0 | 0.7 | 0.7 | 0.8 | 0.8 |
| WV-11089 | 2.6 | 2.7 | 2.9 | 2.5 | 0.9 | 0.9 | 1.4 | 1.3 |

Additional data related to multiple exon skipping mediated by DMD oligonucleotides which target DMD exon 45 are shown in Table 22A.1.

Example Dystrophin Oligonucleotides and Compositions Which Target Exon 46

In some embodiments, the present disclosure provides oligonucleotides, oligonucleotide compositions, and methods of use thereof for targeting exon 46 and/or mediating skipping of exon 46 in human DMD. Non-limiting examples include oligonucleotides and compositions of WV-13701, WV-13702, WV-13703, WV-13704, WV-13705, WV-13706, WV-13707, WV-13708, WV-13709, WV-13710, WV-13711, WV-13712, WV-13713, WV-13714, WV-13715, WV-13716, WV-13780, and WV-13781, and other oligonucleotides having a base sequence which comprises at least 15 contiguous bases of any of these DMD oligonucleotides.

In some embodiments, DMD oligonucleotides are first tested for single exon skipping to select suitable oligonucleotides, then tested combinatorially (in combination with another DMD oligonucleotide) for multi-exon skipping.

In some embodiments, DMD oligonucleotides targeting DMD exon 46, 47, 52, 54 or 55 are first tested for single exon skipping to select suitable oligonucleotides, then tested combinatorially (in combination with another DMD oligonucleotide) for multi-exon skipping.

TABLE 2A

Example data of certain oligonucleotides. Numbers indicate percentage of exon 46 skipping.

| | | | | |
|---|---|---|---|---|
| WV-13701 | 0.3 | 0.3 | 0.5 | 0.4 |
| WV-13702 | 0.3 | 0.4 | 0.5 | 0.3 |
| WV-13703 | 0.9 | 0.9 | 1.1 | 0.8 |
| WV-13704 | | | 9.7 | 5.4 |
| WV-13705 | 4.9 | 5.1 | 5.9 | 3.4 |
| WV-13706 | | | 4.6 | 4.8 |
| WV-13707 | 8.5 | 7.4 | 5.2 | 5.1 |
| WV-13708 | 9.4 | 10.8 | 6.0 | 5.6 |
| WV-13709 | 8.8 | 12.1 | 8.1 | 4.9 |
| WV-13710 | 0.1 | 0.1 | 0.1 | 0.1 |
| WV-13711 | 0.1 | 0.1 | 0.0 | 0.1 |
| WV-13712 | 3.4 | 4.7 | 2.4 | 2.4 |
| WV-13713 | 0.5 | | 0.7 | 0.5 |
| WV-13714 | 0.6 | | 0.5 | 0.4 |
| WV-13715 | 0.9 | | 0.6 | 0.7 |
| WV-13716 | 1.5 | 3.9 | 1.1 | 2.8 |
| WV-13780 | 10.1 | 5.2 | | 6.1 |
| WV-13781 | 7.7 | 6.4 | | 5.0 |
| Mock | 0.0 | 0.0 | 0.0 | 0.0 |
| Mock | 0.0 | | | 0.0 |

Example Dystrophin Oligonucleotides and Compositions Which Target Exon 47

In some embodiments, the present disclosure provides oligonucleotides, oligonucleotide compositions, and methods of use thereof for targeting exon 47 and/or mediating skipping of exon 47 in human DMD. Non-limiting examples include oligonucleotides and compositions of exon 47 oligos include: WV-13717, WV-13718, WV-13719, WV-13720, WV-13721, WV-13722, WV-13723, WV-13724, WV-13725, WV-13726, WV-13727, WV-13728, WV-13729, WV-13730, WV-13731, WV-13732, WV-13788, and WV-13789, and other oligonucleotides having a base sequence which comprises at least 15 contiguous bases of any of these DMD oligonucleotides.

TABLE 3A

Example data of certain oligonucleotides. Numbers represent percentage of exon 47 skipping.

| | | |
|---|---|---|
| WV-13717 | 0.0 | 0.0 |
| WV-13718 | 0.0 | 0.0 |
| WV-13719 | 0.0 | 0.0 |
| WV-13720 | 0.0 | 0.0 |
| WV-13721 | 0.0 | 0.0 |
| WV-13722 | 0.0 | 0.0 |
| WV-13723 | 0.5 | 0.5 |
| WV-13724 | 1.4 | 1.8 |
| WV-13725 | 0.6 | 0.4 |
| WV-13726 | 0.0 | 0.0 |
| WV-13727 | 1.1 | 1.1 |
| WV-13728 | 1.1 | 1.1 |
| WV-13729 | 0.2 | 0.2 |
| WV-13730 | 0.5 | 0.6 |
| WV-13731 | 1.6 | 1.8 |
| WV-13732 | 0.1 | 0.6 |

Example Dystrophin Oligonucleotides and Compositions for Exon Skipping of Exon 51

In some embodiments, the present disclosure provides oligonucleotides, oligonucleotide compositions, and methods of use thereof for mediating skipping of exon 51 in DMD (e.g., of mouse, human, etc.).

In some embodiments, a provided DMD oligonucleotide and/or composition is capable of mediating skipping of exon 51. Non-limiting examples of such DMD oligonucleotides and compositions include those of: ONT-395, WV-10255, WV-10261, WV-10262, WV-10634, WV-10635, WV-10636, WV-10637, WV-10868, WV-10869, WV-10870, WV-10871, WV-10872, WV-10873, WV-10874, WV-10875, WV-10876, WV-10877, WV-10878, WV-10879, WV-10880, WV-10881, WV-10882, WV-10883, WV-10884, WV-10885, WV-10886, WV-10887, WV-10888, WV-1107, WV-1108, WV-1109, WV-1110, WV-1111, WV-1112, WV-1113, WV-1114, WV-1115, WV-1116, WV-1117, WV-1118, WV-1119, WV-1120, WV-11237, WV-11238, WV-11239, WV-1131, WV-1132, WV-1133, WV-1134, WV-1135, WV-1136, WV-1137, WV-1138, WV-1139, WV-1140, WV-1151, WV-1152, WV-1153, WV-1154, WV-1155, WV-1156, WV-1157, WV-1158, WV-1159, WV-1160, WV-1709, WV-1710, WV-1711, WV-1712, WV-1713, WV-1714, WV-1715, WV-1716, WV-2095, WV-2096, WV-2097, WV-2098, WV-2099, WV-2100, WV-2101, WV-2102, WV-2103, WV-2104, WV-2105, WV-2106, WV-2107, WV-2108, WV-2109, WV-2165, WV-2179, WV-2180, WV-2181, WV-2182, WV-2183, WV-2184, WV-2185, WV-2186, WV-2187, WV-2188, WV-2189, WV-2190, WV-2191, WV-2192, WV-2193, WV-2194, WV-2195, WV-2196, WV-2197, WV-2198, WV-2199, WV-2200, WV-2201, WV-2202, WV-2203, WV-2204, WV-2205, WV-2206, WV-2207, WV-2208, WV-2209, WV-2210, WV-2211, WV-2212, WV-2213, WV-2214, WV-2215, WV-2216, WV-2217, WV-2218, WV-2219, WV-2220, WV-2221, WV-2222, WV-2223, WV-2224, WV-2225, WV-2226, WV-2227, WV-2228, WV-2229, WV-2230, WV-2231, WV-2232, WV-2233, WV-2234, WV-2235, WV-2236, WV-2237, WV-2238, WV-2239, WV-2240, WV-2241, WV-2242, WV-2243, WV-2244, WV-2245, WV-2246, WV-2247, WV-2248, WV-2249, WV-2250, WV-2251, WV-2252, WV-2253, WV-2254, WV-2255, WV-2256, WV-2257, WV-2258, WV-2259, WV-2260, WV-2261, WV-2262, WV-2263, WV-2264, WV-2265, WV-2266, WV-2267, WV-2268, WV-2273, WV-2274, WV-2275, WV-2276, WV-2277, WV-2278, WV-2279, WV-2280, WV-2281, WV-2282, WV-2283, WV-2284, WV-2285, WV-2286, WV-2287, WV-2288, WV-2289, WV-2290, WV-2291, WV-2292, WV-2293, WV-2294, WV-2295, WV-2296, WV-2297, WV-2298, WV-2299, WV-2300, WV-2301, WV-2302, WV-2303, WV-2304, WV-2305, WV-2306, WV-2307, WV-2308, WV-2309, WV-2310, WV-2311, WV-2312, WV-2313, WV-2314, WV-2315, WV-2316, WV-2317, WV-2318, WV-2319, WV-2320, WV-2321, WV-2322, WV-2323, WV-2324, WV-2325, WV-2326, WV-2327, WV-2328, WV-2329, WV-2330, WV-2331, WV-2332, WV-2333, WV-2334, WV-2335, WV-2336, WV-2337, WV-2338, WV-2339, WV-2340, WV-2341, WV-2342, WV-2343, WV-2344, WV-2345, WV-2346, WV-2347, WV-2348, WV-2349, WV-2350, WV-2351, WV-2352, WV-2353, WV-2354, WV-2361, WV-2362, WV-2363, WV-2364, WV-2365, WV-2366, WV-2367, WV-2368, WV-2369, WV-2370, WV-2381, WV-2382, WV-2383, WV-2384, WV-2385, WV-2432, WV-2433, WV-2434, WV-2435, WV-2436, WV-2437, WV-2438, WV-2439, WV-2440, WV-2441, WV-2442, WV-2443, WV-2444, WV-2445, WV-2446, WV-2447, WV-2448, WV-2449, WV-2526, WV-2527, WV-2528, WV-2529, WV-2530, WV-2531, WV-2532, WV-2533, WV-2534, WV-2535, WV-2536, WV-2537, WV-2538, WV-2578, WV-2579, WV-2580, WV-2581, WV-2582, WV-2583, WV-2584, WV-2585, WV-2586, WV-2587, WV-2588, WV-2625, WV-2627, WV-2628, WV-2660, WV-2661, WV-2662, WV-2663, WV-2664, WV-2665, WV-2666, WV-2667, WV-2668, WV-2669, WV-2670, WV-2737, WV-2738, WV-2739, WV-2740, WV-2741, WV-2742, WV-2743, WV-2744, WV-2745, WV-2746, WV-2747, WV-2748, WV-2749, WV-2750, WV-2752, WV-2783, WV-2784, WV-2785, WV-2786, WV-2787, WV-2788, WV-2789, WV-2790, WV-2791, WV-2792, WV-2793, WV-2794, WV-2795, WV-2796, WV-2797, WV-2798, WV-2799, WV-2800, WV-2801, WV-2802, WV-2803, WV-2804, WV-2805, WV-2806, WV-2807, WV-2808, WV-2812, WV-2813, WV-2814, WV-3017, WV-3018, WV-3019, WV-3020, WV-3022, WV-3023, WV-3024, WV-3025, WV-3026, WV-3027, WV-3028, WV-3029, WV-3030, WV-3031, WV-3032, WV-3033, WV-3034, WV-3035, WV-3036, WV-3037, WV-3038, WV-3039, WV-3040, WV-3041, WV-3042, WV-3043, WV-3044, WV-3045, WV-3046, WV-3047, WV-3048, WV-3049, WV-3050, WV-3051, WV-3052, WV-3053, WV-3054, WV-3055, WV-3056, WV-3057, WV-3058, WV-3059, WV-3060, WV-3061, WV-3070, WV-3071, WV-3072, WV-3073, WV-3074, WV-3075, WV-3076, WV-3077, WV-3078, WV-3079, WV-3080, WV-3081, WV-3082, WV-3083, WV-3084, WV-3085, WV-3086, WV-3087, WV-3088, WV-3089, WV-3113, WV-3114, WV-3115, WV-3116, WV-3117, WV-3118, WV-3120, WV-3121, WV-3152, WV-3153, WV-3357, WV-3358, WV-3359, WV-3360, WV-3361, WV-3362, WV-3363, WV-3364, WV-3365, WV-3366, WV-3463, WV-3464, WV-3465, WV-3466, WV-3467, WV-3468, WV-3469, WV-3470, WV-3471, WV-3472, WV-3473, WV-3506, WV-3507, WV-3508, WV-3509, WV-3510, WV-3511, WV-3512, WV-3513, WV-3514, WV-3515, WV-3516, WV-3517, WV-3518, WV-3519, WV-3520, WV-3543, WV-3544, WV-3545, WV-3546, WV-3547, WV-3548, WV-3549, WV-3550, WV-3551, WV-3552, WV-3553, WV-3554, WV-3555, WV-3556, WV-3557, WV-3558, WV-3559, WV-3560, WV-3753, WV-3754, WV-3820, WV-3821, WV-3855, WV-3856, WV-3971, WV-4106, WV-4107, WV-4191, WV-4231, WV-4232, WV-4233, WV-4890, WV-6137, WV-6409, WV-6410, WV-6560, WV-6826, WV-6827, WV-6828, WV-7109, WV-7110, WV-7333, WV-7334, WV-7335, WV-7336, WV-7337, WV-7338, WV-7339, WV-7340, WV-7341, WV-7342, WV-7343, WV-7344, WV-7345, WV-7346, WV-7347, WV-7348, WV-7349, WV-7350, WV-7351, WV-7352, WV-7353, WV-7354, WV-7355, WV-7356, WV-7357, WV-7358, WV-7359, WV-7360, WV-7361, WV-7362, WV-7363, WV-7364, WV-7365, WV-7366, WV-7367, WV-7368, WV-7369, WV-7370, WV-7371, WV-7372, WV-7373, WV-7374, WV-7375, WV-7376, WV-7377, WV-7378, WV-7379, WV-7380, WV-7381, WV-7382, WV-7383, WV-7384, WV-7385, WV-7386, WV-7387, WV-7388, WV-7389, WV-7390, WV-7391, WV-7392, WV-7393, WV-7394, WV-7395, WV-7396, WV-7397, WV-7398, WV-7399, WV-7400, WV-7401, WV-7402, WV-7410, WV-7411, WV-7412, WV-7413, WV-7414, WV-7415, WV-7457, WV-7458, WV-7459, WV-7460, WV-7461, WV-7506, WV-7596, WV-8130, WV-8131, WV-8230, WV-8231, WV-8232, WV-8449, WV-8478, WV-8479, WV-8480, WV-8481, WV-8482, WV-8483, WV-8484, WV-8485, WV-8486, WV-8487, WV-8488, WV-8489, WV-8490, WV-8491, WV-8492, WV-8493, WV-8494, WV-8495, WV-8496, WV-8497, WV-8498, WV-8499, WV-8500, WV-8501, WV-8502, WV-8503, WV-8504, WV-8505, WV-8506, WV-8806, WV-884, WV-885, WV-886, WV-887, WV-888, WV-889, WV-890, WV-891, WV-892, WV-893, WV-894, WV-895, WV-896, WV-897, WV-9222, WV-9223, WV-9224, WV-9225, WV-9226, WV-9227, WV-942, WV-9540, WV-9541, WV-9737, WV-9738, WV-9739, WV-9740, WV-9741, WV-9742, WV-9827, WV-9828, WV-9829, WV-9830, WV-9831, WV-9832, WV-9833, WV-9834, WV-9835, WV-9836, WV-9837, WV-9838, WV-9839, WV-9840, WV-9841, WV-9842, WV-9843, WV-9844, WV-9845, WV-9846, WV-9847, WV-9848, WV-9849, WV-9850, WV-9851, WV-9852, WV-9858, and WV-8937, and other DMD oligonucleotides having a base sequence which comprises at least 15 contiguous bases of any of these DMD oligonucleotides.

Additional non-limiting examples of such DMD oligonucleotides and compositions include those of: WV-2444, WV-2528, WV-2531, WV-2578, WV-2579, WV-2580, WV-2581, WV-2669, WV-2745, WV-3032, WV-3152, WV-3153, WV-3360, WV-3363, WV-3364, WV-3465, WV-3466, WV-3470, WV-3472, WV-3473, WV-3507, WV-3545, WV-3546, WV-3552, WV-4106, WV-4231, WV-4232, WV-4233, WV-887, WV-896, WV-942, and other DMD oligonucleotides having a base sequence which comprises at least 15 contiguous bases of any of these DMD oligonucleotides.

Additional non-limiting examples of such DMD oligonucleotides and compositions include those of: WV-12494, WV-12130, WV-12131, WV-12132, WV-12133, WV-12134, WV-12135, WV-12136, WV-12496, WV-12495, WV-12123, WV-12124, WV-12125, WV-12126, WV-12127, WV-12128, WV-12129, WV-12553, WV-12554, WV-12555, WV-12556, WV-12557, WV-12558, WV-12559, WV-12872, WV-12873, WV-12876, WV-12877, WV-12878, WV-12879, WV-12880, WV-12881, WV-12882, and WV-12883, and other DMD oligonucleotides having a base sequence which comprises at least 15 contiguous bases of any of these DMD oligonucleotides.

In some embodiments, the sequence of the region of interest for exon 51 skipping differs between the mouse and human.

Various assays can be utilized to assess oligonucleotides for exon skipping in accordance with the present disclosure. In some embodiments, in order to test the efficacy of a particular combination of chemistry and stereochemistry of an oligonucleotide intended for exon 51 skipping in human, a corresponding oligonucleotide can be prepared which has the mouse sequence, and then tested in mouse. The present disclosure recognizes that in the human and mouse homologs of exon 51, a few differences exist (underlined below):

```
                                          (SEQ ID NO: 3152)
M GTGGTTACTAAGGAAACTGTCATCTCCAAACTAGAAATGCCATCTTCTTTGCTGTTG-
GAG

                                          (SEQ ID NO: 3153)
H GTGGTTACTAAGGAAACTGCCATCTCCAAACTAGAAATGCCATCTTCCTTGATGTTG-
GAG
```

where M is Mouse, nt 7571-7630; and His Human, nt 7665-7724.

Because of these differences, slightly different DMD oligonucleotides for skipping exon 51 can be prepared for testing in mouse and human. As a non-limiting example, the following DMD oligonucleotide sequences can be used for testing in human and mouse:

```
HUMAN DMD oligonucleotide sequence:
                                 (SEQ ID NO: 3154)
UCAAGGAAGAUGGCAUUUCU
```

-continued

```
MOUSE DMD oligonucleotide sequence:
                                 (SEQ ID NO: 3155)
GCAAAGAAGAUGGCAUUUCU
```

Mismatches between human and mouse are underlined.

A DMD oligonucleotide intended for treating a human subject can be constructed with a particular combination of base sequence (e.g., UCAAGGAAGAUGGCAUUUCU (SEQ ID NO: 3156), and a particular pattern of chemistry, internucleotidic linkages, stereochemistry, and additional chemical moieties (if any). Such a DMD oligonucleotide can be tested in vitro in human cells or in vivo in human subjects, but may have limited suitability for testing in mouse, for example, because base sequences of the two have mismatches.

A corresponding DMD oligonucleotide can be constructed with the corresponding mouse base sequence (GCAAAGAAGAUGGCAUUUCU (SEQ ID NO: 3157)) and the same pattern of chemistry, internucleotidic linkages, stereochemistry, and additional chemical moieties (if any). Such an oligonucleotide can be tested in vivo in mouse. Several DMD oligonucleotides comprising the mouse base sequence were constructed and tested.

In some embodiments, a human DMD exon skipping oligonucleotide can be tested in a mouse which has been modified to comprise a DMD gene comprising the human sequence.

Various DMD oligonucleotides comprising various patterns of modifications are described herein. The Tables below show test results of certain DMD oligonucleotides. To assay exon skipping of DMD, DMD oligonucleotides were tested in vitro in Δ52 human patient-derived myoblast cells and/or Δ45-52 human patient-derived myoblast cells (human cells wherein the exon 52 or exons 45-52 were already deleted). Unless noted otherwise, in various experiments, oligonucleotides were delivered gymnotically.

TABLE 4A

Example data of certain oligonucleotides.

| | 10 uM | | | 3 uM | | |
|---|---|---|---|---|---|---|
| WV-942 | 1.0 | 2.2 | 1.5 | 0.2 | 0.5 | 0.2 |
| WV-1709 | 8.5 | 12.9 | 7.7 | 3.3 | 5.8 | 3.7 |
| WV-1710 | 4.1 | 6.1 | 4.7 | 1.1 | 2.5 | 1.3 |

TABLE 4A-continued

Example data of certain oligonucleotides.

| | 10 uM | | | 3 uM | | |
|---|---|---|---|---|---|---|
| WV-1711 | 4.4 | 5.8 | 3.7 | 1.1 | 2.4 | 1.4 |
| WV-1712 | 2.6 | 4.4 | 3.1 | 0.9 | 2.0 | 1.7 |
| WV-1713 | 2.1 | 3.5 | 2.3 | 0.6 | 1.6 | 0.3 |
| WV-1714 | 7.8 | 10.5 | 10.2 | 2.3 | 4.1 | 2.3 |
| WV-1715 | 2.2 | 3.8 | 3.3 | 0.8 | 1.8 | 1.1 |
| WV-1716 | 2.1 | 3.5 | 2.4 | 0.9 | 1.8 | 0.9 |

DMD oligonucleotides were tested in vitro at 10 uM and 3 uM, in triplicates. Numbers represent skipping efficiency, wherein 100.0 would represent 100% skipping and 0.0 represents 0% efficiency; results from replicate experiments are shown. Full descriptions of the oligonucleotides tested in this Table (and other Tables) are provided in Table A1.

In Table 4B, below, additional data of DMD oligonucleotides for skipping exon 51 were presented.

TABLE 4B

Example data of certain oligonucleotides.

| | 10 uM | | | 3 uM | | |
|---|---|---|---|---|---|---|
| WV-942 | 1.0 | 2.2 | 1.5 | 0.2 | 0.5 | 0.2 |
| WV-1714 | 7.8 | 10.5 | 10.2 | 2.3 | 4.1 | 2.3 |
| WV-2444 | 22.2 | 26.7 | 28.6 | 9.1 | 12.6 | 11.9 |
| WV-2445 | 17.1 | 20.7 | 18.7 | 7.0 | 9.7 | 9.1 |
| WV-2528 | 32.4 | 34.6 | 39.3 | 16.9 | 19.9 | 22.3 |
| WV-2529 | 3.2 | 5.8 | 6.1 | 2.2 | 4.5 | 3.0 |
| WV-2530 | 18.6 | 21.1 | 25.4 | 7.6 | 11.5 | 11.4 |

DMD oligonucleotides were tested at 10 uM and 3 uM, in triplicates. Numbers represent skipping efficiency, wherein 100.0 would represent 100% skipping and 0.0 represents 0% efficiency; results from replicate experiments are shown.

In Table 4C, below, additional data of DMD oligonucleotides for skipping exon 51 were presented.

TABLE 4C

Example data of certain oligonucleotides.

| | WV-942 | | WV-887 | | WV-1714 | | WV-2438 | |
|---|---|---|---|---|---|---|---|---|
| 10 uM | 1.1 | 0.7 | 5.1 | 3.9 | 3.6 | 3.7 | 9.3 | 9.3 |
| 3 uM | 0.5 | 0.3 | 1.0 | 2.2 | 1.6 | 1.5 | 3.9 | 3.1 |
| 1 uM | 0.2 | 0.2 | 0.6 | 0.7 | 0.6 | 0.3 | 1.4 | 1.1 |
| | WV-2439 | | WV-2444 | | WV-2445 | | Mock | |
| 10 uM | 3.2 | 2.1 | 12.9 | 14.3 | 9.7 | 8.9 | 0.4 | 0.1 |
| 3 uM | 0.8 | 0.7 | 4.7 | 4.1 | 3.3 | 3.5 | 0.1 | 0.1 |
| 1 uM | 0.4 | 0.3 | 1.4 | 1.0 | 1.1 | 1.0 | 0.1 | |

Numbers represent skipping efficiency, wherein 100.0 would represent 100% skipping and 0.0 represents 0% efficiency; results from replicate experiments are shown.

In Table 4D, below, additional data of DMD oligonucleotides for skipping exon 51 were presented.

TABLE 4D

Example data of certain oligonucleotides.

| | 10 uM | | | |
|---|---|---|---|---|
| WV-942 | 0.6 | 0.6 | 0.6 | 0.6 |
| WV-2660 | 0.2 | 0.3 | 0.1 | 0.1 |
| WV-2661 | 0.4 | 0.4 | | |
| WV-2662 | 0.2 | 0.2 | 0.1 | 0.1 |
| WV-2663 | 0.5 | 0.5 | 0.4 | 0.5 |
| WV-2670 | 5.1 | 5.2 | 6.2 | 7.3 |

Numbers represent skipping efficiency, wherein 100.0 would represent 100% skipping and 0.0 represents 0% efficiency; results from replicate experiments are shown.

In Table 5, below, additional data of DMD oligonucleotides for skipping exon 51 were presented.

TABLE 5

Example data of certain oligonucleotides.

| | 10 uM | 3 uM | 1 uM |
|---|---|---|---|
| Mock | 0.0 | 0.1 | 0.0 |
| WV-2531 | 21.7 | 8.7 | 3.2 |
| WV-3152 | 26.1 | 15.3 | 5.7 |
| WV-2745 | 24.0 | 10.7 | 4.8 |
| WV-3463 | 6.6 | 3.0 | 0.8 |
| WV-3464 | 16.1 | 6.2 | 2.4 |
| WV-3465 | 16.4 | 6.0 | 1.8 |
| WV-3466 | 13.0 | 5.7 | 2.0 |
| WV-3467 | 12.6 | 5.8 | 2.6 |
| WV-3469 | 14.2 | 6.0 | 1.5 |
| WV-3470 | 24.9 | 11.9 | 6.4 |
| WV-3471 | 4.9 | 1.6 | 1.0 |
| WV-3472 | 20.1 | 12.4 | 7.2 |
| WV-3473 | 24.9 | 11.4 | 7.6 |
| WV-942 | 3.3 | 2.1 | 0.7 |

Numbers represent skipping efficiency, wherein 100.0 would represent 100% skipping and 0.0 represents 0% efficiency; results from replicate experiments are shown.

TABLE 6

Example data of certain oligonucleotides.

| | 5 uM | 1 uM |
|---|---|---|
| WV-942 | .2 | |
| PMO | .1 | |
| WV-6137 | 1 | .9 |
| WV-7333 | .3 | .2 |
| WV-7334 | .7 | .4 |
| WV-7335 | 1.7 | .4 |
| WV-7336 | 2.2 | .6 |
| WV-7337 | 1.7 | .4 |
| WV-7343 | 1.4 | .5 |
| WV-7344 | 2.8 | .7 |
| WV-7345 | 2.9 | 1 |
| WV-7346 | 1.9 | .7 |
| WV-7347 | 1.2 | .5 |
| WV-7348 | 2.5 | 1 |
| WV-7349 | 3 | .6 |
| WV-7350 | 3.1 | 1 |
| WV-7351 | 1.7 | .6 |
| WV-7352 | 2.7 | .8 |
| WV-7353 | 2.8 | .2 |
| WV-7354 | 2.2 | .3 |
| WV-7355 | 2.7 | 1.6 |
| WV-7356 | 3.3 | 1.2 |
| WV-7357 | 2.7 | 1.1 |
| WV-7358 | 2.2 | .6 |
| WV-7359 | .7 | .3 |
| WV-7360 | .6 | .5 |
| WV-7361 | 2.8 | .8 |
| WV-7362 | 4.1 | .8 |
| WV-7363 | 2 | .7 |

Numbers represent skipping efficiency, wherein 100.0 would represent 100% skipping and 0.0 represents 0% efficiency; results from replicate experiments are shown. Numbers are approximate. Oligonucleotides were delivered gymnotically to A48-50 patient-derived myoblasts (4 days post-differentiation). The oligonucleotide designated as "PMO" in this table and other tables related to skipping of DMD exon 51 is WV-8806 CTCCAACATCAAGGAAGATGGCATTTCTAG (SEQ ID NO: 3158), which is fully PMO (Morpholino).

In Table 7, below, additional data of DMD oligonucleotides for skipping exon 51 were presented.

TABLE 7

Example data of certain oligonucleotides.

| | | |
|---|---|---|
| Mock | .1 | |
| WV-942 | .2 | |
| PMO | .1 | |
| WV-7364 | 2 | .5 |
| WV-7365 | 1.8 | .5 |
| WV-7366 | 1.1 | 5.7 |
| WV-7367 | .2 | .3 |
| WV-7368 | .4 | .4 |
| WV-7369 | .4 | .2 |
| WV-7370 | .2 | .3 |
| WV-7371 | .3 | .2 |
| WV-7372 | .3 | |
| WV-7373 | .5 | 1.3 |
| WV-7374 | .3 | .4 |
| WV-7375 | .2 | .8 |
| WV-7376 | .2 | .5 |
| WV-7377 | .3 | .5 |
| WV-7378 | .4 | |
| WV-7379 | 7.8 | 1 |
| WV-7380 | 2.8 | .3 |
| WV-7381 | 4.1 | .2 |
| WV-7382 | 1.3 | .1 |
| WV-7383 | 1.7 | .3 |
| WV-7384 | 2.8 | .4 |
| WV-7385 | | 1.8 |
| WV-7386 | 4 | 1.6 |
| WV-7387 | 3 | 1.8 |
| WV-7388 | 1.2 | .7 |
| WV-7389 | .5 | .4 |
| WV-7390 | 1 | .5 |

Numbers represent skipping efficiency, wherein 100.0 would represent 100% skipping and 0.0 represents 0% efficiency; results from replicate experiments are shown. Numbers are approximate.

In some embodiments, the present disclosure pertains to metabolites of any oligonucleotide, e.g., DMD oligonucleotide, disclosed herein, or any combination thereof. In some embodiments, a metabolite of an oligonucleotide, e.g., a DMD oligonucleotide is the result of an oligonucleotide, e.g., a DMD oligonucleotide being acted upon by a nuclease (e.g., an exonuclease or endonuclease or other enzymes, including those may chemically process one or more modifications of an oligonucleotide). In some embodiments, a "metabolite" of an oligonucleotide, e.g., a DMD oligonucleotide is not the physical product of such an oligonucleotide being metabolized or physically treated with a nuclease, but rather a compound which corresponds chemically to a product of an oligonucleotide being metabolized or treated with an enzyme, e.g., a nuclease. In some embodiments, metabolite of an oligonucleotide, e.g., a DMD oligonucleotide, is chemically synthesized, without any metabolic process, and optionally administered to a subject.

In some embodiments, a metabolite is a truncation of an oligonucleotide on the 5' end and/or 3' end by one or two nucleotides or nucleosides. In some embodiments, the present disclosure provides an oligonucleotide, e.g., DMD oligonucleotide which corresponds to an oligonucleotide, e.g., DMD oligonucleotide listed herein, but is truncated at the 5' end by one or two nucleotides. In some embodiments, the present disclosure provides an oligonucleotide, e.g., a DMD oligonucleotide which corresponds to an oligonucleotide, e.g., a DMD oligonucleotide listed herein, but is truncated at the 3' end by one or two nucleotides. In some embodiments, the present disclosure provides an oligonucleotide, e.g., a DMD oligonucleotide which corresponds to an oligonucleotide, e.g., a DMD oligonucleotide listed herein, but is truncated at the 3' end and 5' end by one or two nucleotides. Among other things, such oligonucleotides may perform various of biological functions, e.g., such DMD oligonucleotides can mediate skipping of exon 23, 45, 51, 53, or any other DMD exon.

In some embodiments, the present disclosure pertains to a DMD oligonucleotide which has the base sequence of a DMD oligonucleotide listed herein, except that the base sequence is shorter on the 5' end by one or two bases. In some embodiments, the present disclosure pertains to a DMD oligonucleotide which has the base sequence of a DMD oligonucleotide listed herein, except that the base sequence is shorter on the 3' end by one or two bases. In some embodiments, the present disclosure pertains to a DMD oligonucleotide which has the base sequence of a DMD oligonucleotide disclosed herein, except that the base sequence is shorter on the 3' end and the 5' end by one or two bases. Such DMD oligonucleotides, among other things, can mediate skipping of exon 23, 45, 51, 53, or any other DMD exon.

In some embodiments, a metabolite of a DMD oligonucleotide has removed from the oligonucleotide an additional moiety (e.g., a lipid or other conjugated moiety).

In some embodiments, an oligonucleotide of the present disclosure may be a metabolite of another oligonucleotide. For example, several oligonucleotides may be metabolite of WV-3473, for example, WV-4231 (3' n-1, truncated at the 3' end by one nucleotide), WV-4232 (3' n-2), WV-4233 (5' n-1), etc. Example data of such "metabolite" oligonucleotides were presented in Table 9 below (at 1, 3 and 10 uM, in replicates). Generally, an oligonucleotide can be used independently whether or not it can be a metabolite of another oligonucleotide.

TABLE 9

Example data of certain oligonucleotides.

| Oligonucleotide | 10 uM | | 3 uM | | 1 uM | |
|---|---|---|---|---|---|---|
| PMO | 2.4 | 1.6 | 0.4 | 1.1 | 0.4 | 0.6 |
| WV-3473 | 78.8 | 73.5 | 62.5 | 59.8 | 38.8 | 38.8 |
| WV-4231 (3' n-1) | 83.8 | 71.4 | 65.0 | 67.2 | 44.4 | 43.0 |
| WV-4232 (3' n-2) | 48.5 | 66.5 | 42.2 | 57.5 | | 30.0 |
| WV-4233 (5' n-1) | 54.2 | 45.9 | 37.1 | 31.6 | 18.6 | 14.5 |

Results of replicate experiments are shown. Numbers represent skipping efficiency, wherein 100.0 would represent 100% skipping and 0.0 represents 0% efficiency; results from replicate experiments are shown. In this and other tables, PMO is a Morpholino oligonucleotide control.

In some embodiments, the present disclosure pertains to DMD oligonucleotides corresponding to any DMD oligonucleotide to exon 51 or any other exon listed herein (e.g., in Table A1), but which are truncated by one, two or more nucleotides on the 5' end and/or 3' end.

In some embodiments, the length of a provided oligonucleotide, e.g., a DMD oligonucleotide, is 15 to 45 bases. In some embodiments, the length of a provided oligonucleotide, e.g., a DMD oligonucleotide, is 20 to 45 bases. In some embodiments, the length of a provided oligonucleotide, e.g., a DMD oligonucleotide, is 20 to 40 bases. In some embodiments, the length of a provided oligonucleotide, e.g., a DMD oligonucleotide, is 35 bases. In some embodiments, the length of a provided oligonucleotide, e.g., a DMD oligonucleotide, is 20 to 25 bases.

In some experiments, lengths of DMD oligonucleotides for skipping exon 51 are 20 or 25 bases.

Tables 10A and 10B. Example data of certain oligonucleotides.

Table 10A shows data of 20-mers for skipping DMD exon 51; Table 10B shows data of 25-mers for skipping DMD exon 51. Sequences are provided in Table A1. Numbers represent skipping efficiency, wherein 100.0 would represent 100% skipping and 0.0 represents 0% efficiency; results from replicate experiments are shown.

TABLE 10A

| 20-mers | | | | | | | | | |
|---|---|---|---|---|---|---|---|---|---|
| untreated | | WV-2313 | | WV-2314 | | WV-2315 | | WV-2316 | |
| 0.1 | 0.1 | 1.0 | 1.4 | 1.7 | 1.6 | 2.0 | 2.0 | 4.6 | 2.5 |
| WV-2317 | | WV-2318 | | WV-2319 | | WV-2320 | | WV-942 | |
| 1.7 | 1.1 | 4.3 | 4.3 | 5.0 | 6.5 | 2.9 | 3.7 | 3.9 | 3.4 |

TABLE 10B

| 25-mers | | | | | | | |
|---|---|---|---|---|---|---|---|
| WV-2223 | | WV-2224 | | WV-2225 | | WV-2226 | |
| 15.7 | 14.8 | 6.6 | 7.3 | 13.4 | 16.1 | 7.7 | 7.7 |
| WV-2227 | | WV-2228 | | WV-2229 | | WV-2230 | |
| 9.8 | 9.7 | 15.7 | 15.6 | 8.5 | 8.9 | 12.9 | 13.4 |

Additional data are provided.

TABLE 10C

Example data of certain oligonucleotides.

| | 10 uM | | 3 uM | | 1 uM | |
|---|---|---|---|---|---|---|
| WV-2531 | 21.7 | 25.1 | 8.7 | 10.6 | 3.2 | 4.6 |
| WV-3152 | 26.1 | 21.7 | 15.3 | 10.7 | 5.7 | 4.1 |
| WV-3472 | 20.1 | 16.3 | 12.4 | 8.5 | 7.2 | 3.8 |
| WV-3473 | 24.9 | 38.4 | 11.4 | 11.2 | 7.6 | 6.5 |
| WV-942 | 3.3 | 0.2 | 2.1 | | 0.7 | 0.1 |

Oligonucleotides were tested in vitro at 10, 3 and 1 μM. Results of replicate experiments are shown. Numbers represent skipping efficiency, wherein 100.0 would represent 100% skipping and 0.0 represents 0% efficiency; results from replicate experiments are shown.

TABLE 10D

Example data of certain oligonucleotides.

| | 10 uM | | | 3 uM | | | 1 uM | | |
|---|---|---|---|---|---|---|---|---|---|
| WV-1714 | 5.8 | 6.2 | 8.1 | 2.4 | 3.0 | 2.7 | 0.7 | 0.7 | 2.0 |
| WV-3030 | 29.9 | 27.2 | 35.2 | 6.2 | 5.6 | 5.6 | 0.6 | 0.6 | 1.6 |
| WV-3032 | 31.7 | 29.3 | 37.9 | 7.8 | 6.4 | 7.7 | 1.2 | 1.1 | 1.1 |
| WV-2669 | 3.1 | 3.1 | 4.1 | 1.4 | 1.7 | 1.7 | 0.6 | 0.7 | 0.8 |
| WV-3035 | 13.2 | 16.4 | 17.6 | 1.9 | 2.5 | 2.8 | 1.0 | 1.1 | 0.8 |

Oligonucleotides were tested in vitro at 10, 3 and 1 μM. Results of replicate experiments are shown. Numbers represent skipping efficiency, wherein 100.0 would represent 100% skipping and 0.0 represents 0% efficiency; results from replicate experiments are shown.

TABLE 10E

Example data of certain oligonucleotides.

| | 10 uM | | 3 uM | | 1 uM | |
|---|---|---|---|---|---|---|
| WV-2531 | 24.7 | 21.7 | 11.0 | 8.7 | 4.8 | 3.2 |
| WV-3360 | | 25.1 | 12.9 | 10.1 | | 3.3 |
| WV-3363 | | 24.0 | | 7.7 | | 3.4 |
| WV-3364 | 72.8 | 45.5 | 17.2 | 9.8 | | 4.0 |

Oligonucleotides were tested in vitro at 10, 3 and 1 μM. Results of replicate experiments are shown. Numbers represent skipping efficiency, wherein 100.0 would represent 100% skipping and 0.0 represents 0% efficiency: results from replicate experiments are shown.

TABLE 10F

Example data of certain oligonucleotides.

| | 10 uM | 3 uM | 1 uM |
|---|---|---|---|
| Mock | 0.0 | 0.1 | 0.0 |
| WV-2531 | 21.7 | 8.7 | 3.2 |
| WV-3360 | 25.1 | 10.1 | 3.3 |
| WV-3363 | 24.0 | 7.7 | 3.4 |
| WV-3364 | 45.5 | 9.8 | 4.0 |

Oligonucleotides were tested in vitro at 10, 3 and 1 μM. Numbers represent skipping efficiency, wherein 100.0 would represent 100% skipping and 0.0 represents 0% efficiency; results from replicate experiments are shown.

TABLE 10G

Example data of certain oligonucleotides.

| | 10 uM | | | 3 uM | | | 1 uM | | |
|---|---|---|---|---|---|---|---|---|---|
| WV-1714 | 5.8 | 6.2 | 8.1 | 2.4 | 3.0 | 2.7 | 0.7 | 0.7 | 2.0 |
| WV-3030 | 29.9 | 27.2 | 35.2 | 6.2 | 5.6 | 5.6 | 0.6 | 0.6 | 1.6 |
| WV-3032 | 31.7 | 29.3 | 37.9 | 7.8 | 6.4 | 7.7 | 1.2 | 1.1 | 1.1 |
| WV-2669 | 3.1 | 3.1 | 4.1 | 1.4 | 1.7 | 1.7 | 0.6 | 0.7 | 0.8 |
| WV-3035 | 13.2 | 16.4 | 17.6 | 1.9 | 2.5 | 2.8 | 1.0 | 1.1 | 0.8 |

Oligonucleotides were tested in vitro at 10, 3 and 1 μM. Numbers represent skipping efficiency, wherein 100.0 would represent 100% skipping and 0.0 represents 0% efficiency; results from replicate experiments are shown.

TABLE 10H

Example data of certain oligonucleotides.

| | 10 uM, 15% serum | | | | 10 uM 5% serum | | | |
|---|---|---|---|---|---|---|---|---|
| Mock | 0.0 | 0.1 | | | 0.0 | 0.1 | | |
| WV-942 | 1.0 | 1.0 | 0.2 | 0.2 | 0.7 | 0.5 | 0.4 | 0.4 |
| WV-2578 | 3.2 | | | 2.2 | 2.4 | 2.3 | 2.2 | 0.9 |
| WV-2579 | | | 3.1 | 2.9 | | | 2.5 | 2.5 |
| WV-2580 | 2.5 | 2.9 | 2.4 | 3.1 | 6.8 | 6.4 | 2.8 | 3.2 |
| WV-2581 | 3.3 | 3.6 | 3.9 | 3.7 | 4.4 | 5.8 | 5.8 | 5.4 |
| | 10 uM 5% serum 20 mg/ml BSA | | | | 10 uM 5% serum 4 mg/ml BSA | | | |
| Mock | 0.1 | 0.1 | | | 0.1 | 0.1 | | |
| WV-942 | 0.7 | 0.6 | 1.4 | 1.3 | 0.2 | 0.3 | 0.6 | 0.5 |
| WV-2578 | 0.9 | 0.5 | 0.5 | 0.6 | 0.6 | 0.6 | 0.5 | 0.7 |
| WV-2579 | 0.1 | 0.1 | 0.5 | 0.3 | 0.1 | 0.1 | 0.5 | 0.4 |
| WV-2580 | 0.4 | 0.3 | 0.2 | 0.2 | | | 0.2 | 0.1 |
| WV-2581 | 0.2 | 0.2 | 0.4 | 0.4 | 0.2 | 0.2 | 0.1 | 0.1 |

TABLE 10H-continued

| Example data of certain oligonucleotides. | | | | | | | | |
|---|---|---|---|---|---|---|---|---|
| | 3 uM 15% serum | | | | 3 uM 5% serum | | | |
| Mock | 0.0 | 0.0 | | | 0.0 | 0.0 | | |
| WV-942 | 0.1 | 0.0 | 0.3 | 0.3 | 0.1 | 0.1 | 0.2 | 0.2 |
| WV-2578 | 0.5 | 0.3 | 0.3 | 0.4 | 0.3 | 0.5 | 0.6 | 0.2 |
| WV-2579 | 0.6 | 0.5 | 1.8 | 1.5 | 0.5 | 0.4 | 0.3 | 0.3 |
| WV-2580 | 1.0 | 1.0 | 0.5 | 0.6 | 1.2 | 1.0 | 0.5 | 0.7 |
| WV-2581 | 0.0 | 0.0 | 0.6 | 0.6 | 0.4 | 0.5 | 0.8 | 0.7 |
| | 3 uM 5% serum 20 mg/ml BSA | | | | 3 uM 5% serum 4 mg/ml BSA | | | |
| Mock | 0.0 | 0.0 | | | 0.0 | 0.0 | | |
| WV-942 | 0.1 | 0.1 | 0.1 | 0.1 | 0.1 | 0.1 | 0.4 | 0.3 |
| WV-2578 | 0.2 | 0.2 | 0.2 | 0.3 | 0.2 | 0.1 | 0.1 | |
| WV-2579 | 0.4 | 0.4 | 0.2 | 0.2 | 0.1 | 0.1 | 0.2 | 0.2 |
| WV-2580 | 0.2 | 0.2 | 0.2 | 0.3 | 0.0 | 0.0 | 0.3 | 0.3 |
| WV-2581 | 0.0 | 0.0 | 0.3 | 0.3 | 0.1 | 0.1 | 0.1 | 0.1 |
| | 10 uM, 15% serum | | | | 10 uM 5% serum | | | |
| Mock | 0.0 | 0.1 | | | 0.0 | 0.1 | | |
| WV-942 | 1.0 | 1.0 | 0.2 | 0.2 | 0.7 | 0.5 | 0.4 | 0.4 |
| WV-2578 | 3.2 | | | 2.2 | 2.4 | 2.3 | 2.2 | 0.9 |
| WV-2579 | | | 3.1 | 2.9 | | | 2.5 | 2.5 |
| WV-2580 | 2.5 | 2.9 | 2.4 | 3.1 | 6.8 | 6.4 | 2.8 | 3.2 |
| WV-2581 | 3.3 | 3.6 | 3.9 | 3.7 | 4.4 | 5.8 | 5.8 | 5.4 |
| | 10 uM 5% serum 20 mg/ml BSA | | | | 10 uM 5% serum 4 mg/ml BSA | | | |
| Mock | 0.1 | 0.1 | | | 0.1 | 0.1 | | |
| WV-942 | 0.7 | 0.6 | 1.4 | 1.3 | 0.2 | 0.3 | 0.6 | 0.5 |
| WV-2578 | 0.9 | 0.5 | 0.5 | 0.6 | 0.6 | 0.6 | 0.5 | 0.7 |
| WV-2579 | 0.1 | 0.1 | 0.5 | 0.3 | 0.1 | 0.1 | 0.5 | 0.4 |
| WV-2580 | 0.4 | 0.3 | 0.2 | 0.2 | | | 0.2 | 0.1 |
| WV-2581 | 0.2 | 0.2 | 0.4 | 0.4 | 0.2 | 0.2 | 0.1 | 0.1 |
| | 3 uM 15% serum | | | | 3 uM 5% serum | | | |
| Mock | 0.0 | 0.0 | | | 0.0 | 0.0 | | |
| WV-942 | 0.1 | 0.0 | 0.3 | 0.3 | 0.1 | 0.1 | 0.2 | 0.2 |
| WV-2578 | 0.5 | 0.3 | 0.3 | 0.4 | 0.3 | 0.5 | 0.6 | 0.2 |
| WV-2579 | 0.6 | 0.5 | 1.8 | 1.5 | 0.5 | 0.4 | 0.3 | 0.3 |
| WV-2580 | 1.0 | 1.0 | 0.5 | 0.6 | 1.2 | 1.0 | 0.5 | 0.7 |
| WV-2581 | 0.0 | 0.0 | 0.6 | 0.6 | 0.4 | 0.5 | 0.8 | 0.7 |
| | 3 uM 5% serum 20 mg/ml BSA | | | | 3 uM 5% serum 4 mg/ml BSA | | | |
| Mock | 0.0 | 0.0 | | | 0.0 | 0.0 | | |
| WV-942 | 0.1 | 0.1 | 0.1 | 0.1 | 0.1 | 0.1 | 0.4 | 0.3 |
| WV-2578 | 0.2 | 0.2 | 0.2 | 0.3 | 0.2 | 0.1 | 0.1 | |
| WV-2579 | 0.4 | 0.4 | 0.2 | 0.2 | 0.1 | 0.1 | 0.2 | 0.2 |
| WV-2580 | 0.2 | 0.2 | 0.2 | 0.3 | 0.0 | 0.0 | 0.3 | 0.3 |
| WV-2581 | 0.0 | 0.0 | 0.3 | 0.3 | 0.1 | 0.1 | 0.1 | 0.1 |

Oligonucleotides were tested in vitro at 10 and 3 □M. In this table, in some cases, serum and/or BSA were added to test the effect on exon skipping. Numbers represent skipping efficiency, wherein 100.0 would represent 100% skipping and 0.0 represents 0% efficiency; results from replicate experiments are shown.

TABLE 10I

| Example data of certain oligonucleotides. | | | |
|---|---|---|---|
| | 10 uM | 3 uM | 1 uM |
| Mock | 0.0 | 0.1 | 0.0 |
| WV-2531 | 21.7 | 8.7 | 3.2 |
| WV-3152 | 26.1 | 15.3 | 5.7 |
| WV-2745 | 24.0 | 10.7 | 4.8 |
| WV-3463 | 6.6 | 3.0 | 0.8 |

TABLE 10I-continued

| Example data of certain oligonucleotides. | | | |
|---|---|---|---|
| | 10 uM | 3 uM | 1 uM |
| WV-3464 | 16.1 | 6.2 | 2.4 |
| WV-3465 | 16.4 | 6.0 | 1.8 |
| WV-3466 | 13.0 | 5.7 | 2.0 |
| WV-3467 | 12.6 | 5.8 | 2.6 |
| WV-3469 | 14.2 | 6.0 | 1.5 |
| WV-3470 | 24.9 | 11.9 | 6.4 |
| WV-3471 | 4.9 | 1.6 | 1.0 |
| WV-3472 | 20.1 | 12.4 | 7.2 |
| WV-3473 | 24.9 | 11.4 | 7.6 |
| WV-942 | 3.3 | 2.1 | 0.7 |

Oligonucleotides were tested in vitro at 10, 3 and 1 μM. Numbers represent skipping efficiency, wherein 100.0 would represent 100% skipping and 0.0 represents 0% efficiency; results from replicate experiments are shown.

TABLE 10J

| Example data of certain oligonucleotides. | | | | | | |
|---|---|---|---|---|---|---|
| | 10 uM | | 3 uM | | 1 uM | |
| WV-2531 | 32.9 | 32.0 | 16.9 | 16.7 | 6.2 | 6.2 |
| WV-3360 | 27.2 | 26.5 | 13.4 | 14.2 | 6.0 | 5.9 |
| WV-3361 | 28.9 | 28.0 | 16.7 | 16.1 | 6.3 | 6.0 |
| WV-3362 | 34.3 | 32.9 | 16.2 | 15.5 | 6.1 | 5.8 |
| WV-3363 | 33.2 | 33.6 | 16.4 | 16.0 | 6.7 | 6.4 |
| WV-3364 | 47.9 | 47.6 | 14.2 | 14.0 | 6.4 | 6.5 |
| WV-3365 | 25.6 | 24.2 | 14.7 | 14.2 | 6.9 | 6.4 |
| WV-3366 | 34.6 | 34.0 | 21.1 | 19.8 | 8.0 | 7.4 |
| WV-942 | 0.6 | 0.6 | 0.3 | 0.3 | 0.1 | 0.1 |
| Mock | 0.0 | 0.0 | 0.1 | 0.1 | 0.1 | 0.0 |

Oligonucleotides were tested in vitro at 10, 3 and 1 μM. Numbers represent skipping efficiency, wherein 100.0 would represent 100% skipping and 0.0 represents 0% efficiency; results from replicate experiments are shown.

TABLE 10K

| Example data of certain oligonucleotides. | | |
|---|---|---|
| | Activity relative to WV-942 | |
| WV-942 | 1.1 | 0.9 |
| Mock | 0.1 | 0.0 |
| WV-2526 | 18.4 | 15.3 |
| WV-2527 | 17.0 | 16.3 |
| WV-2528 | 34.6 | 27.2 |
| WV-2529 | 3.7 | 2.8 |
| WV-2530 | 17.0 | 16.9 |
| WV-2533 | 4.1 | 3.6 |
| WV-2534 | 2.0 | 1.2 |
| WV-2535 | 0.4 | 0.2 |
| WV-2536 | 0.2 | 0.1 |
| WV-2537 | 1.1 | 1.0 |

Oligonucleotides were tested in vitro at 10 μM. In this table, numbers represent skipping efficiency relative to WV-942 (ave): results from replicate experiments are shown.

TABLE 10L

| Example data of certain oligonucleotides. | | | |
|---|---|---|---|
| | Activity relative to WV-942 at 10 uM | | |
| WV-942 | 0.8 | 1.8 | 1.2 |
| WV-1709 | 7.1 | 10.7 | 6.5 |

TABLE 10L-continued

| | | | |
|---|---|---|---|
| Example data of certain oligonucleotides. | | | |
| WV-1710 | 3.4 | 5.1 | 3.9 |
| WV-1711 | 3.6 | 4.9 | 3.1 |
| WV-1712 | 2.1 | 3.7 | 2.6 |
| WV-1713 | 1.8 | 2.9 | 1.9 |
| WV-1714 | 6.5 | 8.8 | 8.5 |
| WV-1715 | 1.8 | 3.1 | 2.7 |
| WV-1716 | 1.7 | 2.9 | 2.0 |
| WV-2444 | 18.5 | 22.2 | 23.8 |
| WV-2445 | 14.2 | 17.2 | 15.6 |
| WV-2528 | 27.0 | 28.8 | 32.7 |
| WV-2529 | 2.7 | 4.8 | 5.1 |
| WV-2530 | 15.5 | 17.6 | 21.2 |
| Activity relative to WV-942 at 3 uM | | | |
| WV-942 | 0.7 | 1.7 | 0.6 |
| WV-1709 | 10.9 | 19.5 | 12.2 |
| WV-1710 | 3.6 | 8.3 | 4.3 |
| WV-1711 | 3.6 | 8.1 | 4.6 |
| WV-1712 | 3.0 | 6.7 | 5.8 |
| WV-1713 | 2.0 | 5.3 | 0.9 |
| WV-1714 | 7.5 | 13.8 | 7.8 |
| WV-1715 | 2.6 | 5.8 | 3.6 |
| WV-1716 | 3.2 | 6.1 | 3.1 |
| WV-2444 | 30.3 | 41.9 | 39.7 |
| WV-2445 | 23.4 | 32.3 | 30.2 |
| WV-2528 | 56.3 | 66.3 | 74.4 |
| WV-2529 | 7.5 | 15.0 | 10.0 |
| WV-2530 | 25.2 | 38.4 | 37.8 |

Oligonucleotides were tested in vitro at 10 and 3 μM. In this table, numbers represent skipping efficiency relative to WV-942 (ave); results from replicate experiments are shown.

In some embodiments, an oligonucleotide, e.g., a DMD oligonucleotide, can be tested in vivo for capability to skip an exon in a tissue in a live animal; in some embodiments, a tissue is gastrocnemius, triceps, quadriceps, diaphragm, and/or heart. In some embodiments, a live animal is a mouse, rat, monkey, dog, or non-human primate. In some embodiments, an oligonucleotide, e.g., a DMD oligonucleotide, is capable of mediating skipping, e.g., of exon 23, 45, 51, 53, or any other DMD exon. Various DMD oligonucleotides were shown to mediate skipping of DMD exon 51 in a tissue in a non-human primate (NHP), wherein the tissue was gastrocnemius, triceps, quadriceps, diaphragm, or heart.

In some embodiments, the present disclosure pertains to methods of administering oligonucleotides, e.g., DMD oligonucleotides, wherein the timeline of pre-differentiation (of myoblast cells to myotubules) and treatment with the oligonucleotide are suitably altered. In some embodiments, in a test in vitro, an oligonucleotide, e.g., a DMD oligonucleotide to exon 51, was tested with treatment of 1 day or 4 day.

TABLE 11A

Example data of certain oligonucleotides.

| Oligonucleotide | Group A | Group B | Group C |
|---|---|---|---|
| PMO | 1.3 | 0.6 | 3.3 |
| WV-3473 | 29.3 | 23.1 | 81.6 |

Numbers represent skipping efficiency, wherein 100.0 would represent 100% skipping and 0.0 represents 0% efficiency. PMO is a Morpholino having the sequence of CTCCAACATCAAGGAAGATGGCATTTCTAG (SEQ ID NO: 3159).

Conditions for Groups A to C in Table 11A.

| | Group A | Group B | Group C |
|---|---|---|---|
| Pre-differentiation | 1 day | 2 day | 0 day |
| ASO treatment | 1 day | 1 day | 4 days |
| Wash-out | 2 days | 2 days | — |

Example 19 describes various timelines for experiments suitable for testing oligonucleotides, e.g., DMD oligonucleotides, e.g., in patient-derived myoblasts in vitro.

TABLE 11B

Example data of certain oligonucleotides.

| Conc. (uM) | WV-942 | | | | | PMO | | | |
|---|---|---|---|---|---|---|---|---|---|
| 0.3 | 0.2 | 0.0 | 0.1 | 0.1 | | 0.5 | 0.4 | 0.1 | 0.0 |
| 1 | 0.6 | 0.1 | 0.2 | 0.1 | | 0.1 | 0.1 | 0.1 | 0.3 |
| 3 | 0.1 | 0.1 | 0.1 | 0.2 | 0.2 | 0.5 | 0.3 | 0.7 | 0.2 |
| 10 | 0.5 | 0.3 | 0.1 | 0.8 | 0.7 | 1.3 | 0.8 | 1.6 | 0.4 |
| 30 | 0.0 | 1.0 | 0.5 | 2.0 | 3.4 | 5.5 | 2.3 | 0.9 | 1.7 |

| Conc. (uM) | WV-3473 | | | | | | WV-3545 | | | | | |
|---|---|---|---|---|---|---|---|---|---|---|---|---|
| 0.3 | 5.1 | 4.7 | 1.9 | 8.7 | 1.4 | 3.9 | 6.4 | 3.0 | 4.2 | 0.9 | 1.1 | 2.9 |
| 1 | 15.6 | 8.5 | 13.8 | 5.7 | 6.2 | 12.9 | 13.9 | 11.7 | 2.8 | 5.6 | 5.2 | 12.0 |
| 3 | 24.4 | 25.1 | 7.7 | 14.7 | 18.5 | 27.3 | 22.6 | 21.3 | 16.9 | 16.9 | | 23.5 |
| 10 | 36.8 | 38.1 | 17.3 | 31.9 | 33.8 | 46.9 | 49.0 | 51.7 | 42.9 | 34.1 | 31.0 | 42.1 |
| 30 | 67.7 | | 49.0 | 47.6 | 51.6 | 69.4 | 91.2 | 88.9 | 89.9 | 83.7 | 79.8 | 84.7 |

| Conc. (uM) | WV-3546 | | | | | |
|---|---|---|---|---|---|---|
| 0.3 | 6.0 | 0.7 | 1.1 | 0.7 | 1.6 | 7.1 |
| 1 | 8.2 | 12.2 | 14.2 | 4.7 | 5.4 | 11.1 |
| 3 | 31.5 | | | | 15.9 | 29.6 |
| 10 | 62.1 | 59.1 | 74.0 | 49.9 | 43.6 | 65.1 |
| 30 | 98.9 | 98.8 | 97.4 | 97.4 | 95.6 | 98.1 |

Numbers represent skipping efficiency, wherein 100.0 would represent 100% skipping and 0.0 represents 0% efficiency. PMO is a control oligonucleotide which is a Morpholino corresponding to Eteplirsen. WV-942 is an oligonucleotide corresponding to Drisapersen. Oligonucleotides were delivered gymnotically.

TABLE 11C

Example data of certain oligonucleotides.

| Conc. (uM) | WV-942 | | | PMO | | | WV-3473 | | |
|---|---|---|---|---|---|---|---|---|---|
| 0.3 | 0.2 | 0.0 | 0.1 | 0.4 | 0.1 | 0.0 | 5.1 | 4.7 | 1.9 |
| 1 | 0.6 | 0.1 | 0.2 | 0.1 | 0.1 | 0.3 | 15.6 | 8.5 | 13.8 |
| 3 | 0.1 | 0.1 | 0.1 | 0.3 | 0.7 | 0.2 | 24.4 | 25.1 | 7.7 |
| 10 | 0.5 | 0.3 | 0.1 | 0.8 | 1.6 | 0.4 | 36.8 | 38.1 | 17.3 |
| 30 | 0.0 | 1.0 | 0.5 | 2.3 | 0.9 | 1.7 | 67.7 | | 49.0 |
| Conc. (uM) | WV-3545 | | | WV-3546 | | | WV-3543 | | |
| 0.3 | 6.4 | 3.0 | 4.2 | 6.0 | 0.7 | 1.1 | 5.1 | 2.1 | 4.6 |
| 1 | 13.9 | 11.7 | 2.8 | 8.2 | 12.2 | 14.2 | 8.2 | 2.8 | 9.2 |
| 3 | 22.6 | 21.3 | 16.9 | 31.5 | | | 17.9 | 21.6 | 18.8 |
| 10 | 49.0 | 51.7 | 42.9 | 62.1 | 59.1 | 74.0 | 26.7 | 28.9 | 31.2 |
| 30 | 91.2 | 88.9 | 89.9 | 98.9 | 98.8 | 97.4 | 83.2 | 82.5 | 75.5 |
| Conc. (uM) | WV-3544 | | | WV-3554 | | | WV-4107 | | |
| 0.3 | 5.6 | 3.0 | 3.1 | 2.2 | 2.0 | 4.0 | 1.1 | 1.0 | 0.8 |
| 1 | 12.4 | 9.8 | 12.0 | 12.6 | 4.5 | 8.4 | 3.9 | 2.3 | 4.0 |
| 3 | 22.7 | 23.9 | 15.7 | 18.6 | 15.7 | 18.3 | 15.7 | 14.1 | 13.5 |
| 10 | 37.8 | 32.0 | 35.1 | 42.3 | 36.8 | 33.0 | 70.0 | 53.6 | 64.3 |
| 30 | 80.4 | 81.3 | 79.1 | 86.4 | 91.1 | 84.3 | 93.6 | 92.0 | 93.0 |

Numbers represent skipping efficiency, wherein 100.0 would represent 100% skipping and 0.0 represents 0% efficiency. PMO is a control oligonucleotide which is a Morpholino corresponding to Eteplirsen. WV-942 is an oligonucleotide corresponding to Drisapersen. Oligonucleotides were delivered gymnotically.

In some embodiments, an oligonucleotide comprises a derivative of U. In some embodiments, an oligonucleotide capable of mediating skipping of an exon of DMD comprises a derivative of U. In some embodiments, an oligonucleotide capable of mediating skipping of an exon of DMD and comprises a derivative of U and at least one chirally controlled internucleotidic linkage. In some embodiments, an oligonucleotide capable of mediating skipping of an exon of DMD and comprises a derivative of U and at least one chirally controlled phosphorothioate internucleotidic linkage. In some embodiments, a derivative of U is BrU or Acet5U (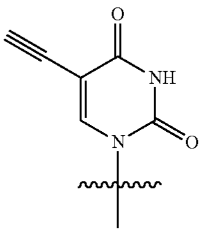).

In some embodiments, an oligonucleotide comprises BrU. In some embodiments, an oligonucleotide capable of mediating skipping of an exon of DMD comprises BrU. In some embodiments, an oligonucleotide capable of mediating skipping of an exon of DMD and comprises BrU and at least one chirally controlled internucleotidic linkage. In some embodiments, an oligonucleotide capable of mediating skipping of an exon of DMD and comprises BrU and at least one chirally controlled phosphorothioate internucleotidic linkage.

In some embodiments, an oligonucleotide comprises Acet5U. In some embodiments, Acet5U is also designated AcetU or acetU. In some embodiments, an oligonucleotide capable of mediating skipping of an exon of DMD comprises Acet5U. In some embodiments, in an oligonucleotide, e.g., DMD oligonucleotide, any U or T can be optionally replaced by Acet5U (e.g., in a first wing, a core, a second wing, or anywhere in the oligonucleotide). In some embodiments, an oligonucleotide capable of mediating skipping of an exon of DMD comprises an Acet5mU nucleoside unit, wherein the base is Acet5U and the sugar is the common natural RNA sugar wherein the 2'-OH is replaced with 2'-OMe. In some embodiments, an oligonucleotide comprises an Acet5fU nucleoside unit, wherein the base is Acet5U and the sugar is the common natural RNA sugar wherein the 2'-OH is replaced with 2'-F. In some embodiments, an oligonucleotide capable of mediating skipping of an exon of DMD and comprises Acet5U and at least one chirally controlled internucleotidic linkage. In some embodiments, an oligonucleotide capable of mediating skipping of an exon of DMD and comprises Acet5U and at least one chirally controlled phosphorothioate internucleotidic linkage.

As shown in Table 11D, Table 11E, and Table A1, certain oligonucleotides, e.g., DMD oligonucleotides, were designed and constructed comprising BrU or acet5U. In some oligonucleotides, the nucleoside at the 5' end comprises BrU or acet5U. In some embodiments, oligonucleotides comprise a BrfU nucleoside unit, wherein the base is BrU and the sugar is the common natural RNA sugar wherein the 2'-OH is replaced with 2'-F. In some oligonucleotides, the oligonucleotide comprises a BrdU nucleoside unit, wherein the base is BrU and the sugar is 2-deoxyribose (common natural DNA sugar). In some embodiments, any U or T can be replaced by BrU (e.g., in a first wing, a core, a second wing, or anywhere within an oligonucleotide). In some embodiments, in an oligonucleotide, e.g., a DMD oligonucleotide, any number of U or T can be replaced by BrU and/or Acet5U.

In some embodiments, an oligonucleotide comprises an acet5fU nucleoside unit, wherein the base is acet5U and the sugar is the common natural RNA sugar wherein the 2'-OH is replaced with 2'-F.

Table 11D shows data of various DMD oligonucleotides which mediate skipping of exon 51, including oligonucleotide WV-7410, which comprises BrfU, and WV-7413, which comprises acet5fU. Percentage was measured using RT-qPCR. Gymnotic delivery of 10 μM and 3 μM oligonucleotides in Δ48-50 patient derived myoblasts (4 days post-differentiation). The experiment was done in technical replicates.

TABLE 11D

Example data of certain oligonucleotides.

| | WV-3152 | WV-3516 | WV-7410 | WV-7413 |
|---|---|---|---|---|
| 10 μM | 39 | 10 | 49 | 11 |
| 3 μM | 20 | 6 | 34 | 6 |

Numbers represent skipping efficiency, wherein 100.0 would represent 100% skipping and 0.0 represents 0% efficiency. Approximate numbers are provided.

In some embodiments, the present disclosure provides oligonucleotides, e.g., various DMD oligonucleotides, that comprise BrdU at or near the center of the oligonucleotides (e.g., in a core region, middle region, etc.). In some embodiments, example such oligonucleotides include WV-2812, WV-2813, and WV-2814. Certain exon skipping data of these oligonucleotides were presented below.

TABLE 11E

| Example data of certain oligonucleotides. | | | | |
|---|---|---|---|---|
| | 10 uM | | 3 uM | |
| WV-1714 | 0.035 | 0.034 | 0.012 | 0.013 |
| WV-2812 | 0.094 | 0.095 | 0.023 | 0.024 |
| WV-942 | 0.004 | 0.004 | 0.001 | 0.001 |
| WV-2814 | 0.004 | 0.005 | 0.002 | 0.002 |
| WV-2813 | 0.041 | 0.042 | 0.017 | 0.017 |

Numbers represent skipping efficiency, wherein 1.000 would represent 100% skipping and 0.0 represents 0% efficiency. Approximate numbers are provided.

TABLE 11F

| Example data of certain oligonucleotides. | | | | | | | | |
|---|---|---|---|---|---|---|---|---|
| | 10 uM | | | | 3 uM | | | |
| WV-9738 | 44.7 | 44.0 | 46.1 | 45.4 | 26.6 | 25.9 | 25.6 | 24.4 |
| WV-9739 | 51.8 | 49.9 | 53.2 | 50.9 | 32.3 | 35.4 | 31.0 | 33.2 |
| WV-9740 | 49.9 | 48.8 | 47.8 | 46.1 | 32.5 | 30.3 | 29.0 | 29.6 |
| WV-9741 | 36.1 | 37.8 | 35.0 | 35.6 | 23.5 | 22.3 | 21.4 | 24.6 |
| WV-9742 | 53.4 | 54.8 | 59.1 | 56.8 | 41.7 | 40.4 | 37.6 | 40.3 |
| WV-7410 | 64.8 | 63.9 | 65.4 | 67.0 | 45.1 | 43.5 | 43.9 | 40.6 |
| WV-7410 | 66.0 | 67.2 | 64.7 | 64.5 | 44.9 | 40.3 | 33.7 | 31.7 |
| WV-3152 | 47.0 | 45.7 | 47.1 | 45.0 | 28.3 | 30.2 | 25.3 | 22.6 |
| WV-3516 | 12.5 | 12.5 | 9.7 | 10.4 | 5.0 | 4.9 | 5.2 | 4.6 |
| MOCK | 0.5 | 0.3 | 0.5 | 0.3 | 0.5 | 0.6 | 0.8 | 0.4 |
| MOCK | 0.6 | 0.4 | 0.5 | 0.5 | 0.6 | 0.6 | 0.3 | 0.4 |
| MOCK | 0.3 | 0.3 | 0.6 | 0.2 | 0.4 | 0.4 | 0.2 | 0.6 |

Additional DMD oligonucleotides for skipping Exon 51 were constructed. Various DMD oligonucleotides comprise BrU. In some cases, a BrU is attached to a sugar which is 2'-F modified (BrfU). D48-50 myoblasts were dosed at 10 uM and 3 uM in differentiation media for 4 days. Percentage of skipping is shown, wherein 100 would represent 100% skipping and 0 would represent 0% skipping.

TABLE 11G

| Activity of certain oligonucleotides | | | | | | | |
|---|---|---|---|---|---|---|---|
| | 10 | 3.3 | 1.1 | | 10 | 3.3 | 1.1 |
| WV- | 20.8 | 9 | 4.1 | WV- | 36.9 | 10.4 | 4.7 |
| 3152 | 22 | 10 | 4.9 | 14522 | 27.4 | 10.4 | 4.2 |
| | 17.3 | 9.3 | 3.2 | | 21 | 12.6 | 5.6 |
| | 21.3 | 7.2 | 4.4 | | 26.5 | 10.4 | 5.7 |
| WV- | 27.4 | 13.2 | 12.7 | WV- | 27.2 | 8.1 | 6.2 |
| 15860 | 30.4 | 15.4 | 9 | 14523 | 28.3 | 8.5 | 4.9 |
| | 33 | 14.2 | 6 | | 18.4 | 9.1 | 3.6 |
| | 33.4 | 16.9 | 5.9 | | 18.7 | 9.6 | 4.4 |
| WV- | 26.6 | 9.2 | 5.6 | Mock | 0.21 | | |
| 15861 | 28.5 | 6.1 | 5.4 | | 0.35 | | |
| | 34.1 | 8.2 | 5.2 | | 0.48 | | |
| | 29.9 | 11.1 | 4 | | 0.24 | | |
| WV- | 30.7 | | 7.8 | | | | |
| 15862 | 33.3 | | 7.2 | | | | |
| | 21.9 | 15.1 | 6.8 | | | | |
| | 26.4 | 13.2 | 7.2 | | | | |

Activity of various DMD exon 51 oligonucleotides was tested in vitro.

Numbers indicate amount of skipping DMD exon 23 (as a percentage of total mRNA, where 100 would represent 100% skipped).

Amounts tested were: 10, 3.3 and 1.1 μM.

TABLE 11H

| Activity of certain oligonucleotides | | | | | | | |
|---|---|---|---|---|---|---|---|
| | 10 uM | 3.3 uM | 1.1 uM | | 10 uM | 3.3 uM | 1.1 uM |
| Mock | 0.2 | 0.3 | 0.2 | WV- | 37.6 | 22.6 | 9 |
| | 0.3 | 0.2 | 0.3 | 17861 | 38.8 | 22.5 | 8.9 |
| | 0.2 | 0 | 0.2 | | 40.7 | 24.4 | 13.2 |
| | 0.2 | 0.6 | 0.2 | | 41.7 | 25.4 | 11.6 |
| WV- | 3.1 | 1.6 | 0.7 | WV- | 38.4 | 18.9 | 8.1 |
| 7336 | 8.9 | 1.8 | 0.1 | 17862 | 34.1 | 19.6 | 9 |
| | 5.4 | 1.4 | 0.9 | | 34.8 | 26 | 10 |
| | 4.9 | 1.5 | 0.7 | | 36.1 | 21.4 | 9.5 |
| WV- | 32.4 | 26.5 | 7.5 | WV- | 32.7 | 18.2 | 9.2 |
| 3152 | 27.2 | 22.2 | 8.4 | 17863 | 35.1 | 18.9 | 9.3 |
| | 28 | 14.5 | 7.6 | | 34.8 | 18.2 | 8.6 |
| | 26.8 | 14.8 | 7.3 | | 30.7 | 17 | 9 |
| WV- | 43.3 | 25.7 | 10.2 | WV- | 37.3 | 23.6 | 11.7 |
| 15860 | 37.9 | 23.8 | 9.6 | 17864 | 41.4 | 23.3 | 10.6 |
| | 38.4 | 24.5 | 11.2 | | 39.9 | 20.6 | 17.5 |
| | 42.4 | 21.9 | 11 | | 38.8 | 21.7 | 10.2 |
| WV- | 42.3 | 26.7 | 16.3 | WV- | 35.9 | 16.5 | 9.3 |
| 17859 | 41.3 | 26 | 16.8 | 17865 | 34 | 16.7 | 7.5 |
| | 39.9 | 22.9 | 15.5 | | 34.4 | 17.5 | 11.9 |
| | 48.6 | 23.6 | 14.9 | | 34.1 | 17.8 | 9.8 |
| WV- | 38.1 | 19.3 | 11.7 | WV- | 48.7 | 28.4 | 17.7 |
| 17860 | 35.3 | 19.2 | 12 | 17866 | 43.3 | 28.6 | 13.1 |
| | 41 | 28.2 | 16.4 | | 44.5 | 24.8 | 15.4 |
| | 40.4 | 21.9 | 11.1 | | 45.1 | 30.5 | 16.3 |

Oligonucleotides for skipping DMD exon 51 were tested in vitro.

Numbers indicate amount of skipping DMD exon 23 (as a percentage of total mRNA, where 100 would represent 100% skipped).

Concentrations of oligonucleotides used: 10, 3.3 and 1.1 uM.

TABLE 11I

| Activity of certain oligonucleotides | | |
|---|---|---|
| | 10 uM | 3.3 uM |
| Mock | 0 | 0 |
| | 0 | 0 |
| | 0 | 0 |
| | 0 | 0 |
| WV- | 15.9 | 7 |
| 20034 | 17.1 | 8.4 |
| | 16.1 | 7.3 |
| | 15.3 | 7.2 |
| WV- | 29.7 | 18.3 |
| 20037 | 27.2 | 17.5 |
| | 26.6 | 19.4 |
| | 29.2 | 18.4 |
| WV- | 9.6 | 4.9 |
| 20040 | 9.1 | 5.2 |
| | 11.4 | 3.5 |
| | 10.9 | 2.9 |
| WV- | 20.2 | 9.6 |
| 20043 | 20.4 | 9.8 |
| | 18.9 | 9.8 |
| | 21 | 10.4 |
| WV- | 28.5 | 14.7 |
| 20046 | 29.8 | 14.2 |
| | 29.2 | 15.8 |
| | 26.6 | 14.5 |
| WV- | 20.9 | 11.6 |
| 20049 | 18.6 | 12.2 |
| | 18.4 | 11.7 |

TABLE 11I-continued

| Activity of certain oligonucleotides | | |
|---|---|---|
| | 10 uM | 3.3 uM |
| WV-20052 | 28.8 | 18.8 |
| | 30.1 | 18.6 |
| | 29.6 | 20.1 |
| WV-20055 | 26.8 | 17 |
| | 25.3 | 16.6 |
| | 24.1 | 17 |
| WV-20058 | 14.6 | 4.8 |
| | 12 | 3.7 |
| | 12.6 | 3.5 |
| WV-20061 | 35.8 | 26.5 |
| | 39.3 | 24.2 |
| | 39.9 | 22.8 |
| WV-20064 | 26.5 | 17.6 |
| | 24.5 | 16.4 |
| | 27.5 | 17.1 |
| WV-20067 | 15.7 | 8.3 |
| | 16.8 | 9.3 |
| | 17.3 | 8.6 |
| | 16.3 | 8.7 |
| WV-20070 | 41.3 | 26.4 |
| | 31.7 | 22.3 |
| | 39.7 | 27.2 |
| | 38.4 | 26.9 |
| WV-20073 | 30.9 | 21.1 |
| | 26.9 | 17.9 |
| | 31.1 | 20.2 |
| | 30.7 | 22.2 |
| WV-20076 | 23.2 | 16.8 |
| | 18.9 | 11.4 |
| | 21.8 | 16.9 |
| | 22.8 | 15.8 |
| WV-3152 | 35.7 | 24.8 |
| | 33.5 | 24.9 |
| | 32.1 | 25.3 |
| WV-15860 | 41.9 | 27.5 |
| | 43.6 | 30.7 |
| | 42.4 | 30 |

Oligonucleotides for skipping DMD exon 51 were tested in vitro.

Numbers indicate amount of skipping DMD exon 23 (as a percentage of total mRNA, where 100 would represent 100% skipped).

Concentrations of oligonucleotides used: 10 and 3.3 uM.

TABLE 11J

| Activity of certain oligonucleotides | | | | |
|---|---|---|---|---|
| WV-3152 | 19 | 20 | 12 | 14 |
| WV-15860 | 29 | 31 | 26 | 23 |
| WV-20140 | 1 | 1 | 1 | 1 |
| WV-20139 | 3 | 3 | 2 | 2 |
| WV-20138 | | | 2 | 3 |
| WV-20137 | 4 | 5 | | |
| WV-20136 | | | | |
| WV-20135 | 5 | 5 | 5 | 5 |
| WV-20134 | 5 | 6 | 5 | 4 |
| WV-20133 | 17 | 17 | 13 | 13 |
| WV-20132 | 8 | 8 | 6 | 6 |
| WV-20131 | 14 | 16 | 12 | 12 |
| WV-20130 | 10 | 9 | 8 | 8 |
| WV-20129 | 12 | 14 | 11 | 11 |
| WV-20128 | 9 | 9 | 8 | 8 |
| WV-20127 | | | 8 | 8 |
| WV-20126 | 7 | 8 | 8 | 7 |
| WV-20125 | 8 | 8 | 8 | 8 |
| WV-20124 | 22 | 21 | 21 | 21 |
| WV-20123 | 13 | 13 | 14 | 12 |
| WV-20122 | 11 | 12 | 12 | 11 |
| WV-20121 | 21 | 22 | 22 | 21 |
| WV-20120 | 28 | 30 | 32 | 33 |
| WV-20119 | 52 | 50 | | |

TABLE 11J-continued

| Activity of certain oligonucleotides | | | | |
|---|---|---|---|---|
| WV-20118 | 39 | 37 | 27 | 26 |
| WV-20117 | 18 | 17 | 15 | 18 |
| WV-20116 | 20 | 20 | 17 | 17 |
| WV-20115 | 8 | 8 | 8 | 6 |
| WV-20114 | 19 | 20 | 15 | 14 |
| WV-20113 | 20 | 18 | 17 | 15 |
| WV-20112 | 16 | 15 | 12 | 12 |
| WV-20111 | 31 | 30 | 33 | 31 |
| WV-20110 | 14 | 14 | 14 | 12 |
| WV-20109 | 20 | 21 | 25 | 24 |
| WV-20108 | 27 | 25 | 22 | 22 |
| WV-20107 | 20 | 19 | 16 | 14 |
| WV-20106 | 44 | 42 | 34 | 37 |
| WV-20105 | 23 | 22 | 18 | 18 |
| WV-20104 | 41 | 40 | 33 | 28 |
| WV-20103 | 48 | 52 | 53 | 53 |
| WV-20102 | 54 | 52 | 55 | 59 |
| WV-20101 | 38 | 39 | 38 | 43 |
| WV-20100 | 52 | 51 | 48 | 50 |
| WV-20099 | 53 | 51 | 47 | 48 |
| WV-20098 | 46 | 44 | 45 | 46 |
| WV-20097 | 47 | 46 | 51 | 48 |
| WV-20096 | 45 | 41 | 42 | 43 |
| WV-20095 | 43 | 41 | 50 | 47 |
| WV-20094 | 55 | 50 | 57 | 55 |
| WV-20093 | 35 | 34 | 35 | 38 |
| WV-20092 | 25 | 26 | 25 | 25 |
| WV-20091 | 28 | 27 | 30 | 32 |
| WV-20090 | 21 | 19 | 22 | 22 |
| WV-20089 | 8 | 7 | 8 | 9 |
| WV-20088 | 22 | 21 | 26 | 25 |
| WV-20087 | 28 | 28 | 33 | 32 |
| WV-20086 | 25 | 25 | 27 | 26 |
| WV-20085 | 33 | 31 | 30 | 31 |
| WV-20084 | 21 | 22 | 21 | 21 |
| WV-20083 | 21 | 21 | 19 | 17 |
| WV-20082 | 42 | 37 | 32 | 30 |
| WV-20081 | 41 | 41 | 30 | 30 |
| WV-20080 | 49 | 44 | 26 | 25 |
| WV-20079 | 42 | 38 | 53 | 51 |
| WV-20078 | 27 | 28 | 36 | 35 |
| WV-20077 | 10 | 10 | 10 | 10 |
| WV-20076 | 45 | 45 | 45 | 41 |
| WV-20075 | 40 | 31 | 37 | 42 |
| WV-20074 | 55 | 57 | 53 | 56 |
| WV-20073 | 51 | 55 | 51 | 50 |
| WV-20072 | 41 | 36 | 37 | 36 |
| WV-20071 | 42 | 40 | 44 | 46 |
| WV-20070 | 18 | 18 | 25 | 25 |
| WV-20069 | 11 | 11 | 10 | 9 |
| WV-20068 | 20 | 17 | 20 | 18 |
| WV-20067 | 12 | 9 | 11 | 11 |
| WV-20066 | 12 | 11 | 13 | 12 |
| WV-20065 | 16 | 15 | 16 | 14 |
| WV-20064 | 37 | 35 | 37 | 36 |
| WV-20063 | 19 | | 24 | 22 |
| WV-20062 | 6 | 6 | 7 | 7 |
| WV-20061 | 24 | 23 | 26 | 24 |
| WV-20060 | 16 | 17 | 16 | 17 |
| WV-20059 | 55 | 42 | 62 | 67 |
| WV-20058 | 28 | 30 | 33 | 33 |
| WV-20057 | 37 | 38 | 37 | 34 |
| WV-20056 | 35 | 34 | 33 | 35 |
| WV-20055 | | | 40 | 40 |
| WV-20054 | 25 | 25 | 35 | 36 |
| WV-20053 | 43 | 45 | 46 | 46 |
| WV-20052 | 47 | 47 | 53 | 46 |
| WV-20051 | 30 | 33 | 30 | 30 |
| WV-20050 | 29 | 28 | 28 | 26 |
| WV-20049 | 41 | 41 | 38 | 38 |
| WV-20049 | 24 | 23 | 22 | 21 |

Oligonucleotides for skipping DMD exon 51 were tested in vitro.

Oligonucleotides were dosed 4d at 10 uM.

Numbers indicate amount of skipping DMD exon 51 (as a percentage of total mRNA, where 100 would represent 100% skipped).

Example Dystrophin Oligonucleotides and Compositions Which Target Exon 52

In some embodiments, the present disclosure provides oligonucleotides, oligonucleotide compositions, and methods of use thereof for targeting exon 52 and/or mediating skipping of exon 52 in human DMD. Non-limiting examples include oligonucleotides and compositions of Exon 52 oligos include: WV-13733, WV-13734, WV-13735, WV-13736, WV-13737, WV-13738, WV-13739, WV-13740, WV-13741, WV-13742, WV-13743, and WV-13744, WV-13782, and WV-13783, and other oligonucleotides having a base sequence which comprises at least 15 contiguous bases of any of these DMD oligonucleotides.

TABLE 12A

Example data of certain oligonucleotides.

| | | |
|---|---|---|
| WV-13733 | 0.3 | 0.2 |
| WV-13734 | 0.0 | 0.0 |
| WV-13735 | 1.6 | 0.3 |
| WV-13736 | 3.9 | 1.3 |
| WV-13737 | 0.7 | 0.4 |
| WV-13738 | 0.0 | 0.0 |
| WV-13739 | 28.3 | 29.3 |
| WV-13740 | 29.9 | 33.3 |
| WV-13741 | 1.6 | 1.6 |
| WV-13742 | 12.9 | 14.1 |
| WV-13743 | 0.9 | 1.0 |
| WV-13744 | 0.6 | 0.7 |
| WV-13782 | 0.1 | 0.1 |
| WV-13783 | 0.8 | 0.0 |
| Mock | 0.0 | 0.0 |
| Mock | 0.1 | 0.1 |

Skipping efficiency of various DMD oligonucleotides, tested for skipping of DMD exon 52.

Example Dystrophin Oligonucleotides and Compositions for Exon Skipping of Exon 53

In some embodiments, the present disclosure provides oligonucleotides, oligonucleotide compositions, and methods of use thereof for mediating skipping of exon 53 in DMD (e.g., of mouse, human, etc.).

In some embodiments, an oligonucleotide, e.g., a human DMD exon 53 skipping oligonucleotide can be tested in a mouse which has been modified to comprise a DMD gene comprising the human exon 53 sequence.

In some embodiments, an oligonucleotide, e.g., a DMD oligonucleotide, is capable of mediating skipping of exon 53. Non-limiting examples of such oligonucleotides include: WV-10439, WV-10440, WV-10441, WV-10442, WV-10443, WV-10444, WV-10445, WV-10446, WV-10447, WV-10448, WV-10449, WV-10450, WV-10451, WV-10452, WV-10453, WV-10454, WV-10455, WV-10456, WV-10457, WV-10458, WV-10459, WV-10460, WV-10461, WV-10462, WV-10463, WV-10464, WV-10465, WV-10466, WV-10467, WV-10468, WV-10469, WV-10470, WV-10487, WV-10488, WV-10489, WV-10490, WV-10491, WV-10492, WV-10493, WV-10494, WV-10495, WV-10496, WV-10497, WV-10498, WV-10499, WV-10500, WV-10501, WV-10502, WV-10503, WV-10504, WV-10505, WV-10506, WV-10507, WV-10508, WV-10509, WV-10510, WV-10511, WV-10512, WV-10513, WV-10514, WV-10515, WV-10516, WV-10517, WV-10518, WV-10519, WV-10520, WV-10521, WV-10522, WV-10523, WV-10524, WV-10525, WV-10526, WV-10527, WV-10528, WV-10529, WV-10530, WV-10531, WV-10532, WV-10533, WV-10534, WV-10535, WV-10536, WV-10537, WV-10538, WV-10539, WV-10540, WV-10541, WV-10542, WV-10543, WV-10544, WV-10545, WV-10546, WV-10547, WV-10548, WV-10549, WV-10550, WV-10551, WV-10552, WV-10553, WV-10554, WV-10555, WV-10556, WV-10557, WV-10558, WV-10559, WV-10560, WV-10561, WV-10562, WV-10563, WV-10564, WV-10565, WV-10566, WV-10567, WV-10568, WV-10569, WV-10570, WV-10571, WV-10572, WV-10573, WV-10574, WV-10575, WV-10576, WV-10577, WV-10578, WV-10579, WV-10580, WV-10581, WV-10582, WV-10583, WV-10584, WV-10585, WV-10586, WV-10587, WV-10588, WV-10589, WV-10590, WV-10591, WV-10592, WV-10593, WV-10594, WV-10595, WV-10596, WV-10597, WV-10598, WV-10599, WV-10600, WV-10601, WV-10602, WV-10603, WV-10604, WV-10605, WV-10606, WV-10607, WV-10608, WV-10609, WV-10610, WV-10611, WV-10612, WV-10613, WV-10614, WV-10615, WV-10616, WV-10617, WV-10618, WV-10619, WV-10620, WV-10621, WV-10622, WV-10623, WV-10624, WV-10625, WV-10626, WV-10627, WV-10628, WV-10629, WV-10630, WV-10670, WV-10671, WV-10672, WV-11340, WV-11341, WV-11342, WV-11544, WV-11545, WV-11546, WV-11547, WV-13835, WV-13864, WV-14344, WV-4698, WV-4699, WV-4700, WV-4701, WV-4702, WV-4703, WV-4704, WV-4705, WV-4706, WV-4707, WV-4708, WV-4709, WV-4710, WV-4711, WV-4712, WV-4713, WV-4714, WV-4715, WV-4716, WV-4717, WV-4718, WV-4719, WV-4720, WV-4721, WV-4722, WV-4723, WV-4724, WV-4725, WV-4726, WV-4727, WV-4728, WV-4729, WV-4730, WV-4731, WV-4732, WV-4733, WV-4734, WV-4735, WV-4736, WV-4737, WV-4738, WV-4739, WV-4740, WV-4741, WV-4742, WV-4743, WV-4744, WV-4745, WV-4746, WV-4747, WV-4748, WV-4749, WV-4750, WV-4751, WV-4752, WV-4753, WV-4754, WV-4755, WV-4756, WV-4757, WV-4758, WV-4759, WV-4760, WV-4761, WV-4762, WV-4763, WV-4764, WV-4765, WV-4766, WV-4767, WV-4768, WV-4769, WV-4770, WV-4771, WV-4772, WV-4773, WV-4774, WV-4775, WV-4776, WV-4777, WV-4778, WV-4779, WV-4780, WV-4781, WV-4782, WV-4783, WV-4784, WV-4785, WV-4786, WV-4787, WV-4788, WV-4789, WV-4790, WV-4791, WV-4792, WV-4793, WV-9067, WV-9068, WV-9069, WV-9070, WV-9071, WV-9072, WV-9073, WV-9074, WV-9075, WV-9076, WV-9077, WV-9078, WV-9079, WV-9080, WV-9081, WV-9082, WV-9083, WV-9084, WV-9085, WV-9086, WV-9087, WV-9088, WV-9089, WV-9090, WV-9091, WV-9092, WV-9093, WV-9094, WV-9095, WV-9096, WV-9097, WV-9098, WV-9099, WV-9100, WV-9101, WV-9102, WV-9103, WV-9104, WV-9105, WV-9106, WV-9107, WV-9108, WV-9109, WV-9110, WV-9111, WV-9112, WV-9113, WV-9114, WV-9115, WV-9116, WV-9117, WV-9118, WV-9119, WV-9120, WV-9121, WV-9122, WV-9123, WV-9124, WV-9125, WV-9126, WV-9127, WV-9128, WV-9129, WV-9130, WV-9131, WV-9132, WV-9133, WV-9134, WV-9135, WV-9136, WV-9137, WV-9138, WV-9139, WV-9140, WV-9141, WV-9142, WV-9143, WV-9144, WV-9145, WV-9146, WV-9147, WV-9148, WV-9149, WV-9150, WV-9151, WV-9152, WV-9153, WV-9154, WV-9155, WV-9156, WV-9157, WV-9158, WV-9159, WV-9160, WV-9161, WV-9162, WV-9422, WV-9423, WV-9424, WV-9425, WV-9426, WV-9427, WV-9428, WV-9429, WV-9511, WV-9512, WV-9513, WV-9514, WV-9515, WV-9516, WV-9517, WV-9518, WV-9519, WV-9520, WV-9521, WV-9522, WV-9523, WV-9524, WV-9525, WV-9534, WV-9535, WV-9536, WV-9537, WV-9538, WV-9539, WV-9680, WV-9681, WV-9682, WV-9683, WV-9684, WV-9685, WV-9686, WV-9687, WV-9688, WV-9689, WV-9690, WV-9691, WV-9699, WV-9700, WV-9701, WV-9702, WV-9703, WV-9704, WV-9709, WV-9710, WV-9711, WV-9712, WV-9713, WV-9714, WV-9715, WV-9743, WV-9744, WV-9745, WV-9746, WV-9747, WV-9748, WV-9749, WV-9750, WV-9751, WV-9752, WV-9753, WV-9754, WV-9755, WV-9756, WV-9757, WV-9758, WV-9759, WV-9760, WV-9761, WV-9897, WV-9898, WV-9899, WV-9900, WV-9901, WV-9902, WV-9903, WV-9904, WV-9905, WV-9906, WV-9907, WV-9908, WV-9909, WV-9910, WV-9911, WV-9912, WV-9913, WV-9914, WV-7436, WV-7437, WV-7438, WV-7439, WV-7440, WV-7441, WV-7442, WV-7443, WV-7444, WV-7445, WV-7446, WV-7447, WV-7448, WV-7449, WV-7450, WV-7451, WV-7452, WV-7453, WV-7454, WV-7455, and WV-7456, and other DMD oligonucleotides having a base sequence which comprises at least 15 contiguous bases of any of these DMD oligonucleotides.

Additional examples of such DMD oligonucleotides include: WV-9422, WV-9425, WV-9426, WV-9517, WV-9519, WV-9521, WV-9522, WV-9524, WV-9710, WV-9714, WV-9715, WV-9743, WV-9744, WV-9745, WV-9746, WV-9747, WV-9748, WV-9749, WV-9750, WV-9751, WV-9756, WV-9757, WV-9758, WV-9759, WV-9760, WV-9761, WV-9897, WV-9898, WV-9899, WV-9900, WV-9906, and WV-9912, and other DMD oligonucleotides having a base sequence which comprises at least 15 contiguous bases of any of these DMD oligonucleotides.

Non-limiting examples of such DMD oligonucleotides also include: WV-12123, WV-12124, WV-12125, WV-12126, WV-12127, WV-12128, WV-12129, WV-12553, WV-12554, WV-12555, WV-12556, WV-12557, WV-12558, WV-12559, WV-12872, WV-12873, WV-12876, WV-12877, WV-12878, WV-12879, WV-12880, WV-12881, WV-12882, and WV-12883, and other DMD oligonucleotides having a base sequence which comprises at least 15 contiguous bases of any of these DMD oligonucleotides.

Results of various experiments for skipping Dystrophin exon 53 are described in the present disclosure. For example, data from a sequence identification screen are shown below, in Table 13A.

TABLE 13A

Example data of certain oligonucleotides.

| Oligonucleotide | Replicate 1 | Replicate 2 |
|---|---|---|
| WV-4698 | 1.9 | 2.1 |
| WV-4699 | 2.0 | 2.2 |
| WV-4700 | 2.8 | 3.0 |
| WV-4701 | 3.7 | 2.9 |
| WV-4702 | 2.9 | 2.7 |
| WV-4703 | 1.8 | 2.4 |
| WV-4704 | 3.2 | 3.4 |
| WV-4705 | 3.7 | 4.3 |
| WV-4706 | 2.6 | 2.6 |
| WV-4707 | 3.2 | 3.6 |
| WV-4708 | 4.8 | 6.0 |
| WV-4709 | 6.6 | 5.2 |

TABLE 13A-continued

Example data of certain oligonucleotides.

| Oligonucleotide | Replicate 1 | Replicate 2 |
|---|---|---|
| WV-4710 | 3.9 | 4.6 |
| WV-4711 | 5.4 | 6.7 |
| WV-4712 | 5.3 | 6.4 |
| WV-4713 | 5.8 | 8.0 |
| WV-4714 | 2.9 | 3.6 |
| WV-4715 | 3.3 | 4.3 |
| WV-4716 | 3.8 | 4.3 |
| WV-4717 | 6.8 | 7.0 |
| WV-4718 | 4.3 | 5.0 |
| WV-4719 | 5.5 | 6.0 |
| WV-4720 | 7.7 | 8.6 |
| WV-4721 | 2.7 | 3.8 |
| WV-4722 | 3.8 | 4.6 |
| WV-4723 | 3.4 | 5.6 |
| WV-4724 | 3.5 | 4.7 |
| WV-4725 | 4.9 | 6.3 |
| WV-4726 | 4.2 | 4.4 |
| WV-4727 | 2.7 | 4.9 |
| WV-4728 | 2.6 | 5.6 |
| WV-4729 | 3.9 | 4.1 |
| WV-4730 | 2.4 | 3.3 |
| WV-4731 | 1.8 | 2.5 |
| WV-4732 | 1.8 | 2.3 |
| WV-4733 | 2.3 | 2.1 |
| WV-4734 | 2.0 | 2.0 |
| WV-4735 | 2.5 | 2.7 |
| WV-4736 | 2.7 | 3.0 |
| WV-4737 | 3.2 | 3.1 |
| WV-4738 | 3.1 | 3.5 |
| WV-4739 | 2.6 | 2.4 |
| WV-4740 | 4.4 | 3.6 |
| WV-4741 | 3.7 | 4.1 |
| WV-4742 | 4.5 | 4.9 |
| WV-4743 | 5.0 | 5.2 |
| WV-4744 | 3.6 | 4.7 |
| WV-4745 | 4.1 | 0.0 |
| WV-4746 | 2.9 | 2.0 |
| WV-4747 | 2.5 | 3.5 |
| WV-4748 | 2.1 | 1.7 |
| WV-4749 | 2.4 | 2.4 |
| WV-4750 | 2.3 | 2.9 |
| WV-4751 | 1.9 | 2.5 |
| WV-4752 | 2.2 | 1.6 |
| WV-4753 | 1.6 | 2.0 |
| WV-4754 | 1.7 | 2.0 |
| WV-4755 | 1.7 | 1.9 |
| WV-4756 | 1.7 | 1.5 |
| WV-4757 | 1.6 | 1.9 |
| WV-4758 | 1.6 | 2.0 |
| WV-4759 | 1.6 | 1.6 |
| WV-4760 | 1.8 | 1.8 |
| WV-4761 | 1.9 | 1.6 |
| WV-4762 | 1.2 | 1.3 |
| WV-4763 | 0.9 | 2.0 |
| WV-4764 | 3.0 | 2.7 |
| WV-4765 | 3.4 | 3.2 |
| WV-4766 | 2.5 | 2.3 |
| WV-4767 | 2.5 | 2.7 |
| WV-4768 | 2.3 | 2.7 |
| WV-4769 | 2.4 | 2.4 |
| WV-4770 | 2.8 | 2.8 |
| WV-4771 | 2.3 | 2.9 |
| WV-4772 | 4.0 | 2.5 |
| WV-4773 | 3.2 | 1.8 |
| WV-4774 | 3.0 | 2.3 |
| WV-4775 | 4.4 | 3.3 |
| WV-4776 | 3.1 | 3.8 |
| WV-4777 | 4.5 | 2.1 |
| WV-4778 | 0.0 | 2.0 |
| WV-4779 | 2.8 | 3.4 |
| WV-4780 | 3.2 | 3.5 |
| WV-4781 | 2.9 | 3.2 |
| WV-4782 | 1.8 | 2.9 |
| WV-4783 | 2.1 | 2.6 |
| WV-4784 | 2.4 | 2.4 |
| WV-4785 | 3.4 | 3.6 |

TABLE 13A-continued

Example data of certain oligonucleotides.

| Oligonucleotide | Replicate 1 | Replicate 2 |
|---|---|---|
| WV-4786 | 1.8 | 1.6 |
| WV-4787 | 2.9 | 2.7 |
| WV-4788 | 2.8 | 3.1 |
| WV-4789 | 4.3 | 4.0 |
| WV-4790 | 3.9 | 2.6 |
| WV-4791 | 2.2 | 2.2 |
| WV-4792 | 2.5 | 3.2 |
| WV-4793 | 2.4 | 2.6 |
| Mock | 1.3 | 1.6 |

Skipping efficiency of various DMD oligonucleotides, tested for skipping of DMD exon 53 in vitro in Delta 52 human myoblast cells. Oligonucleotides tested were 6-8-6 gapmers (2'-F-2'-OMe-2'-F), wherein each internucleotidic linkage is a stereorandom phosphorothioate. Numbers represent skipping efficiency, wherein 100.0 would represent 100% skipping and 0.0 represents 0% efficiency; results from replicate experiments are shown.

A number of oligonucleotides were generated and tested for efficacy in skipping DMD Exon 53 in vitro in human patient-derived myoblast cells; certain results are shown below in Tables 13B to 21 (A and B). Oligonucleotides were used at concentrations of 3 and 10 uM, in two replicates (R1 and R2). Numbers indicate the percentage of skipping of DMD exon 53, wherein 0.0 would indicate no skipping, and 100.0 would indicate 100% skipping. Several base sequences were tested in combination with a variety of chemical formats. For example, in some embodiments, a base sequence is GUACUUCAUCCCACUGAUUC (SEQ ID NO: 3160), GUGUUCTTGTACTTCAUCCC (SEQ ID NO: 3161), UUCUGAAGGTGTTCUUGUAC (SEQ ID NO: 3162), or CUCCGGTTCTGAAGGUGUUC (SEQ ID NO: 3163), wherein U is optionally substituted with T and vice versa. Various chemical formats were utilized, including, e.g., gapmers (for example, 6-8-6 wing-core-wing gapmers). In some embodiments, both wings are 2'-F, while the core was all 2'-MOE, alternating 2'-MOE/2-OMe, alternating 2'-OMe/2'-MOE, alternating 2'-MOE/2'-F, alternating 2'-F/2'-MOE, alternating 2'-OMe/2'-F, and alternating 2'-F/2'-OMe, etc. In some embodiments, the first wing was 2'-MOE or 2'-OMe and the second wing was 2'-F (a type of asymmetrical gapmers). In some embodiments, each internucleotidic linkage is a stereorandom phosphorothioate. In some embodiments, some alternating phosphorothioate linkages are replaced by phosphodiester linkages. In some embodiments, 5'-methyl 2'-MOE C is used. Descriptions of certain oligonucleotides tested are provided in Table A1.

TABLE 13B

Example data of certain oligonucleotides.

| | Replicate 1 | | Replicate 2 | |
|---|---|---|---|---|
| Oligonucleotide | 10 uM | 3 uM | 10 uM | 3 uM |
| WV-9067 | 6.6 | | 1.9 | 1.8 |
| WV-9068 | 6.5 | | 1.5 | 1.6 |
| WV-9069 | 6.9 | 1.8 | 1.7 | 1.5 |
| WV-9070 | 2.9 | 3.2 | 2.6 | 1.9 |
| WV-9071 | 2.9 | 1.9 | 2.0 | 1.4 |
| WV-9072 | 9.6 | 2.4 | 2.4 | 1.5 |
| WV-9073 | 8.6 | 3.3 | 2.7 | 2.1 |
| WV-9074 | 8.3 | 2.4 | 2.5 | 1.9 |
| WV-9075 | 7.0 | 2.1 | 2.1 | 2.0 |
| WV-9076 | 9.6 | 3.0 | 3.1 | 2.0 |
| WV-9077 | 6.3 | 1.7 | 2.0 | 1.5 |
| WV-9078 | 6.1 | 2.3 | 2.2 | 1.9 |
| WV-9079 | 10.0 | 3.9 | 3.6 | 2.3 |
| WV-9080 | 7.6 | 3.1 | 2.8 | 2.6 |
| WV-9081 | 5.7 | 2.2 | 1.9 | 1.6 |
| WV-9082 | 11.2 | 6.1 | 6.4 | 3.2 |
| WV-9083 | 6.0 | 1.9 | 2.1 | 1.6 |
| WV-9084 | 6.6 | 2.4 | 2.9 | 2.1 |
| WV-9085 | 0.0 | 7.5 | 7.6 | 3.4 |
| WV-9086 | 7.5 | 3.4 | 3.1 | 2.0 |
| WV-9087 | 7.1 | 2.4 | 2.1 | 1.7 |
| WV-9088 | 9.0 | 3.0 | 2.6 | 1.6 |
| WV-9089 | 8.2 | 2.5 | 2.3 | 1.9 |
| WV-9090 | 0.0 | 2.3 | 2.2 | 1.6 |
| WV-9091 | 9.9 | 4.7 | 3.7 | 3.2 |
| WV-9092 | 9.0 | 3.4 | 3.4 | 2.0 |
| WV-9093 | 8.7 | 2.9 | 3.2 | 2.0 |
| WV-9094 | 11.9 | 6.0 | 5.2 | 3.1 |
| WV-9095 | 7.5 | 3.4 | 2.6 | 2.5 |
| WV-9096 | 10.1 | 4.0 | 4.0 | 2.9 |
| WV-9097 | 10.7 | 5.7 | 4.5 | 2.8 |
| WV-9098 | 8.5 | 3.6 | 2.9 | 2.3 |
| WV-9099 | 8.1 | 2.9 | 2.4 | 2.4 |
| WV-9100 | 12.7 | 6.0 | 4.7 | 2.9 |
| WV-9101 | 7.6 | 2.9 | 3.1 | 2.0 |
| WV-9102 | 9.9 | 4.0 | 3.6 | 2.5 |
| WV-9103 | 12.6 | 6.9 | 6.1 | 3.0 |
| WV-9104 | 11.3 | 3.7 | 4.3 | 2.1 |
| WV-9105 | 6.5 | 2.9 | 2.3 | 2.4 |
| WV-9106 | 15.1 | 7.7 | 5.5 | 4.3 |
| WV-9107 | 7.8 | 2.5 | 2.2 | 2.6 |
| WV-9108 | 11.3 | 3.3 | 3.5 | 2.2 |
| WV-9109 | 16.1 | 10.6 | 8.9 | 4.1 |
| WV-9110 | 8.8 | 3.5 | 3.4 | 1.7 |
| WV-9111 | 7.3 | 3.4 | 2.5 | 1.7 |
| WV-9112 | 11.5 | 4.6 | 3.4 | 2.2 |
| WV-9113 | 10.6 | 4.2 | 3.1 | 2.3 |
| WV-9114 | 10.8 | 4.9 | 4.1 | 2.6 |
| WV-9115 | 8.4 | 0.0 | 2.5 | 2.1 |
| WV-9116 | 7.5 | 0.0 | 1.6 | 1.8 |
| WV-9117 | 6.8 | 0.0 | 2.0 | 1.5 |
| WV-9118 | 9.3 | 0.0 | 2.7 | 2.1 |
| WV-9119 | 7.2 | 0.6 | 2.0 | 2.0 |
| WV-9120 | 8.5 | 6.1 | 2.5 | 2.0 |
| WV-9121 | 11.8 | 5.7 | 3.9 | 2.5 |
| WV-9122 | 8.6 | 4.0 | 2.4 | 2.4 |
| WV-9123 | 10.7 | 5.2 | 2.0 | 2.0 |
| WV-9124 | 11.0 | 5.3 | 3.6 | 3.2 |
| WV-9125 | 8.7 | 3.5 | 2.3 | 2.2 |
| WV-9126 | 10.5 | 3.4 | 3.4 | 2.4 |
| WV-9127 | 8.5 | 3.4 | 2.7 | 2.5 |
| WV-9128 | 8.2 | 2.9 | 2.0 | 2.2 |
| WV-9129 | 7.5 | 2.6 | 1.6 | 1.7 |
| WV-9130 | 12.6 | 0.0 | 5.4 | 2.7 |
| WV-9131 | 7.6 | 2.3 | 2.2 | 1.8 |
| WV-9132 | 8.4 | 0.7 | 3.4 | 2.3 |
| WV-9133 | 16.2 | 7.0 | 6.9 | 3.2 |
| WV-9134 | 8.5 | 3.9 | 3.0 | 1.9 |
| WV-9135 | 12.5 | 2.8 | 2.9 | 1.7 |
| WV-9136 | 8.7 | 4.1 | 3.1 | 2.2 |
| WV-9137 | 7.5 | 2.5 | 1.7 | 1.6 |
| WV-9138 | 7.2 | 2.7 | 2.1 | 1.7 |
| WV-9139 | 9.3 | 5.3 | 5.1 | 2.8 |
| WV-9140 | 8.0 | 3.1 | 2.5 | 2.1 |
| WV-9141 | 7.7 | 3.3 | 2.9 | 1.8 |
| WV-9142 | 11.9 | 6.4 | 6.0 | 3.2 |
| WV-9143 | 7.0 | 3.2 | 3.9 | 1.8 |
| WV-9144 | 9.8 | 4.0 | 3.6 | 2.7 |
| WV-9145 | 13.0 | 6.6 | 5.3 | 2.6 |
| WV-9146 | 7.9 | 3.7 | 3.4 | 1.9 |
| WV-9147 | 8.2 | 3.9 | 3.1 | 2.0 |
| WV-9148 | 15.0 | 8.8 | 6.4 | 3.3 |
| WV-9149 | 6.9 | 2.9 | 2.3 | 3.1 |

TABLE 13B-continued

| Example data of certain oligonucleotides. | | | | |
|---|---|---|---|---|
| | Replicate 1 | | Replicate 2 | |
| Oligonucleotide | 10 uM | 3 uM | 10 uM | 3 uM |
| WV-9150 | 10.8 | 6.9 | 5.6 | 1.9 |
| WV-9151 | 12.9 | 7.2 | 5.1 | 2.7 |
| WV-9152 | 8.4 | 3.4 | 2.6 | 1.5 |
| WV-9153 | 7.2 | 3.9 | 2.9 | 1.7 |
| WV-9154 | 21.5 | 14.1 | 12.4 | 4.3 |
| WV-9155 | 6.9 | 3.3 | 2.5 | 1.6 |
| WV-9156 | 11.0 | 6.4 | 4.9 | 2.4 |
| WV-9157 | 16.7 | 10.5 | 9.7 | 3.9 |
| WV-9158 | 7.7 | 3.7 | 2.3 | 1.7 |
| WV-9159 | 7.7 | 3.1 | 3.3 | 1.5 |
| WV-9160 | 8.0 | 3.1 | 2.8 | 1.8 |
| WV-9161 | 8.4 | 4.5 | 3.2 | 2.2 |
| WV-9162 | 8.9 | 4.5 | 4.7 | 2.2 |
| Mock | 2.4 | | | |
| Mock | 2.1 | | | |
| WV-9746 | 2.5 | 2.5 | 4.6 | 3.4 |
| WV-9747 | 3.0 | 3.1 | 5.5 | 4.8 |
| WV-9748 | 4.9 | 2.5 | 4.3 | 4.0 |
| WV-9749 | 2.9 | 2.7 | 4.5 | 4.1 |
| WV-9750 | 3.2 | 2.5 | 4.4 | 3.8 |
| WV-9751 | 3.5 | 2.7 | 4.7 | 4.8 |
| WV-9758 | 1.7 | 1.9 | 2.1 | 3.5 |
| WV-9759 | 2.6 | 3.6 | 2.8 | 6.1 |
| WV-9760 | 3.1 | 3.9 | 3.4 | 4.8 |
| WV-9761 | 3.0 | 4.8 | 4.6 | 7.2 |
| WV-9756 | 3.9 | 4.4 | 5.3 | 8.4 |
| WV-9757 | 3.7 | 4.3 | 6.8 | 8.1 |
| WV-9517 | 3.3 | 2.7 | 7.1 | 5.3 |
| WV-9519 | 2.4 | 2.1 | 5.1 | 4.6 |
| WV-9521 | 2.4 | 2.5 | 6.3 | 4.9 |
| WV-9522 | 2.6 | 2.3 | 5.8 | 4.3 |
| WV-9715 | 4.6 | 5.7 | 10.5 | 4.2 |
| WV-9714 | 4.5 | 3.4 | 9.0 | 8.5 |
| WV-9422 | 2.1 | 2.0 | 6.2 | 4.3 |
| WV-9743 | 4.1 | 2.4 | 7.3 | 6.2 |
| WV-9744 | 3.4 | 1.9 | 4.4 | 5.1 |
| WV-9745 | 2.7 | 2.4 | 5.6 | 6.2 |
| Mock | 2.4 | 1.8 | 1.7 | 2.5 |

Efficacy of DMD Exon 53 skipping of various DMD oligonucleotides in vitro. Numbers represent skipping efficiency, wherein 100.0 would represent 100% skipping and 0.0 represents 0% efficiency. Results from replicate experiments are shown.

TABLE 14

| Example data of certain oligonucleotides. | | | | |
|---|---|---|---|---|
| | 3 uM-R1 | 3 uM-R2 | 10 uM-R1 | 10 uM-R2 |
| WV-9746 | 2.5 | 2.5 | 4.6 | 3.4 |
| WV-9747 | 3.0 | 3.1 | 5.5 | 4.8 |
| WV-9748 | 4.9 | 2.5 | 4.3 | 4.0 |
| WV-9749 | 2.9 | 2.7 | 4.5 | 4.1 |
| WV-9750 | 3.2 | 2.5 | 4.4 | 3.8 |
| WV-9751 | 3.5 | 2.7 | 4.7 | 4.8 |
| WV-9758 | 1.7 | 1.9 | 2.1 | 3.5 |
| WV-9759 | 2.6 | 3.6 | 2.8 | 6.1 |
| WV-9760 | 3.1 | 3.9 | 3.4 | 4.8 |
| WV-9761 | 3.0 | 4.8 | 4.6 | 7.2 |
| WV-9756 | 3.9 | 4.4 | 5.3 | 8.4 |
| WV-9757 | 3.7 | 4.3 | 6.8 | 8.1 |
| WV-9517 | 3.3 | 2.7 | 7.1 | 5.3 |
| WV-9519 | 2.4 | 2.1 | 5.1 | 4.6 |
| WV-9521 | 2.4 | 2.5 | 6.3 | 4.9 |
| WV-9522 | 2.6 | 2.3 | 5.8 | 4.3 |
| WV-9715 | 4.6 | 5.7 | 10.5 | 4.2 |
| WV-9714 | 4.5 | 3.4 | 9.0 | 8.5 |
| WV-9422 | 2.1 | 2.0 | 6.2 | 4.3 |
| WV-9743 | 4.1 | 2.4 | 7.3 | 6.2 |

TABLE 14-continued

| Example data of certain oligonucleotides. | | | | |
|---|---|---|---|---|
| | 3 uM-R1 | 3 uM-R2 | 10 uM-R1 | 10 uM-R2 |
| WV-9744 | 3.4 | 1.9 | 4.4 | 5.1 |
| WV-9745 | 2.7 | 2.4 | 5.6 | 6.2 |
| Mock | 2.4 | 1.8 | 1.7 | 2.5 |

Numbers represent skipping efficiency, wherein 100.0 would represent 100% skipping and 0.0 represents 0% efficiency; results from replicate experiments (R1 and R2) are shown.

TABLE 15

| Example data of certain oligonucleotides. | | |
|---|---|---|
| | 10 uM | 3 uM |
| WV-9897 | 7.4 | 4.8 |
| WV-9898 | 11.8 | 4.6 |
| WV-9899 | 10.1 | 4.1 |
| WV-9900 | 10.3 | 4.7 |
| WV-9901 | 5.7 | 2.5 |
| WV-9902 | 8.8 | 3.5 |
| WV-9903 | 7.3 | 3.4 |
| WV-9904 | 6.9 | 3.0 |
| WV-9905 | 6.7 | 3.1 |
| WV-9906 | 12.1 | 5.0 |
| WV-9907 | 11.1 | 3.8 |
| WV-9908 | 12.6 | 5.1 |
| WV-9909 | 11.3 | 3.9 |
| WV-9910 | 9.8 | 4.3 |
| WV-9911 | 3.5 | 4.0 |
| WV-9912 | 11.3 | 4.7 |
| WV-9913 | 10.3 | 3.9 |
| WV-9914 | 9.4 | 2.8 |
| WV-9747 | 7.6 | 3.4 |
| WV-9749 | 6.4 | 3.6 |
| WV-9750 | 6.0 | 3.5 |
| WV-9758 | 3.5 | 2.5 |
| WV-9517 | 9.6 | 4.1 |
| Mock | 2.5 | 2.6 |

Numbers represent skipping efficiency, wherein 100.0 would represent 100% skipping and 0.0 represents 0% efficiency.

Additional oligonucleotides were generated and tested for skipping DMD exon 53 in vitro in cells. Certain data are shown below in Table 16. Oligonucleotides were used at concentrations of 3 and 10 uM, in two replicates. Numbers indicate the percentage of skipping of DMD exon 53. As shown, oligonucleotides can have different base sequences in combination with a variety of chemical formats. In some embodiments, oligonucleotides tested were 20-mers, each having a gapmer format of wing-core-wing, wherein each wing was 2'-F, and the core was 2'-OMe or a mixture of 2'-OMe and 2'-F. In some embodiments, each internucleotidic linkage was a chirally controlled phosphorothioate internucleotidic linkage in Sp configuration. In some embodiments, oligonucleotides comprise one or more natural phosphate linkages. In some embodiments, oligonucleotides of the present disclosure comprise one or more 5'-methyl 2'-F C (5MSfC,

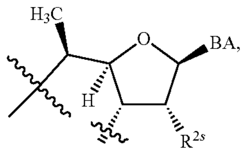

nucleoside is

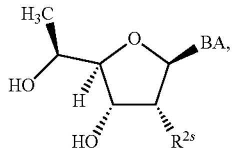

wherein BA is nucleobase C, $R^{2s}$ is —F).

TABLE 16

Example data of certain oligonucleotides.

| | Group A (3 uM) | | Group B (10 uM) | |
|---|---|---|---|---|
| WV-9746 | 8.0 | 7.5 | 13.7 | 7.5 |
| WV-9747 | 10.2 | 9.3 | 17.4 | 9.3 |
| WV-9748 | 8.8 | 8.2 | 14.1 | 8.2 |
| WV-9749 | 9.9 | 8.7 | 15.8 | 8.7 |
| WV-9750 | 10.0 | 9.3 | 17.3 | 9.3 |
| WV-9751 | 9.3 | 8.4 | 14.5 | 8.4 |
| WV-9758 | 6.9 | 6.1 | 8.8 | 6.1 |
| WV-9759 | 7.5 | 7.7 | 11.3 | 7.7 |
| WV-9760 | 8.1 | 7.3 | 10.2 | 7.3 |
| WV-9761 | 7.3 | 8.2 | 12.7 | 8.2 |
| WV-9756 | 10.9 | 10.3 | 20.2 | 10.3 |
| WV-9757 | 22.7 | 10.1 | 32.1 | 10.1 |
| WV-9517 | 10.3 | 9.2 | 20.1 | 9.2 |
| WV-9519 | 8.8 | 8.1 | 16.2 | 8.1 |
| WV-9521 | 9.2 | 8.0 | 16.0 | 8.0 |
| WV-9522 | 9.5 | 8.8 | 17.7 | 8.8 |
| WV-9715 | 14.3 | 12.3 | 26.9 | 12.3 |
| WV-9714 | 13.2 | 11.3 | 23.7 | 11.3 |
| WV-9422 | 8.3 | 7.3 | 16.6 | 7.3 |
| WV-9743 | 9.8 | 7.8 | 20.1 | 7.8 |
| WV-9744 | 7.6 | 6.7 | 12.9 | 6.7 |
| WV-9745 | 9.6 | 7.4 | 17.0 | 7.4 |
| Mock | 4.7 | 4.9 | 5.2 | |

Numbers represent skipping efficiency, wherein 100.0 would represent 100% skipping and 0.0 represents 0% efficiency; results from replicate experiments are shown.

A number of DMD oligonucleotides were also designed, constructed and tested for efficacy in skipping DMD Exon 53 in vitro in differentiated myoblast cells. Certain data are shown below in Table 17. Oligonucleotides were delivered gymnotically at concentrations of 3 and 10 μM, in two biological replicates (R1 and R2). Numbers indicate the percentage of skipping of DMD exon 53, as determined by RT-qPCR.

TABLE 17

Example data of certain oligonucleotides.

| | 3 uM-R1 | 3 uM-R2 | 10 uM-R1 | 10 uM-R2 |
|---|---|---|---|---|
| WV-9422 | 2.1 | 2.0 | 6.2 | 4.3 |
| WV-9743 | 4.1 | 2.4 | 7.3 | 6.2 |
| WV-9744 | 3.4 | 1.9 | 4.4 | 5.1 |
| WV-9745 | 2.7 | 2.4 | 5.6 | 6.2 |
| Mock | 2.4 | 1.8 | 1.7 | 2.5 |

Numbers represent skipping efficiency, wherein 100.0 would represent 100% skipping and 0.0 represents 0% efficiency; results from replicate experiments (R1 and R2) are shown.

A number of oligonucleotides were designed, constructed and tested for efficacy in skipping DMD Exon 53 in vitro in Δ52 differentiated myoblast cells. Certain data were shown below in Table 18. In an example procedure, cells were pre-differentiated for 4 days and oligonucleotides were delivered gymnotically for 4 days. Differentiation medium was DMEM, 2% horse serum and 10 μg/ml insulin. In some embodiments, with certain oligonucleotides, without pre-differentiating these cells, skipping efficiency was relatively low. Oligonucleotides were delivered gymnotically at concentrations of 1, 3 and 10 μM, in biological replicates (R1 and R2). Numbers indicate the percentage of skipping of DMD exon 53, as determined by RT-qPCR. PMO53 is an oligonucleotide also designated as WV-13405, HumDMDEx53, or PMO (in DMD exon 53 experiments), or PMO SR, which has a base sequence of GTTGCCTCCGGTTCTGAAGGTGTTC (SEQ ID NO: 3164) and is fully PMO (Morpholino).

"-" indicates that no data were available for that particular sample.

TABLE 18

Example data of certain oligonucleotides.

| | 30 uM-R1 | 30 uM-R2 | 10 uM-R1 | 10 uM-R2 | 3 uM-R1 | 3 uM-R2 | 1 uM-R1 | 1 uM-R2 |
|---|---|---|---|---|---|---|---|---|
| WV-9714 | — | — | 52.1 | 31.0 | 25.0 | 21.7 | 7.9 | 9.2 |
| WV-9715 | — | — | — | — | 12.6 | 7.3 | 11.1 | 8.7 |
| WV-9517 | — | — | — | — | 20.5 | 20.4 | 7.3 | 6.9 |
| WV-9519 | — | — | 39.0 | 30.5 | 15.1 | 13.3 | 5.3 | 6.6 |
| WV-9521 | — | — | 43.2 | 10.2 | 16.9 | 15.1 | 5.1 | 5.2 |
| WV-9747 | 83.0 | 87.5 | 50.7 | 46.6 | 17.0 | 19.5 | 6.4 | 6.2 |
| WV-9748 | 66.4 | 68.2 | 42.9 | 33.2 | 14.5 | 10.2 | 4.8 | 3.9 |
| WV-9749 | 76.8 | 80.2 | 39.2 | 35.4 | 18.5 | 13.0 | 5.7 | 23.5 |
| WV-9897 | — | — | — | — | 26.0 | 25.3 | 8.3 | 8.4 |
| WV-9898 | — | — | — | — | 22.8 | 23.6 | 8.5 | 7.9 |
| WV-9900 | — | — | 46.7 | 45.7 | 25.5 | 21.8 | 7.4 | 7.9 |
| WV-9899 | — | — | 28.7 | — | 27.2 | 26.1 | 8.8 | 8.8 |
| WV-9906 | — | — | — | — | 37.9 | — | 9.7 | 9.8 |
| WV-9912 | — | — | — | — | 22.5 | — | 8.8 | 9.7 |
| WV-9524 | — | 14.6 | — | 32.9 | 15.2 | 14.5 | 5.4 | 6.9 |
| PMO53 | 112.8 | 105.4 | 53.7 | 49.3 | 20.4 | 19.9 | 6.9 | 10.4 |
| Mock | 2.2 | 1.7 | 2.2 | 1.5 | 1.6 | 1.8 | 2.0 | 2.0 |

Numbers represent skipping efficiency, wherein 100.0 would represent 100% skipping relative to control and 0.0 would represent 0% efficiency; results from replicate experiments (R1 and R2) are shown.

A number of DMD oligonucleotides were designed, constructed and tested for efficacy in skipping DMD Exon 53 in vitro in Δ45-52 differentiated myoblast cell. Certain results, normalized to SFSR9, are shown below in Table 19. Oligonucleotides were delivered gymnotically at concentrations of 1, 3 and 10 μM, in biological replicates (R1 and R2). Numbers indicate the percentage of skipping of DMD exon 53, as determined by RT-qPCR.

TABLE 19

Example data of certain oligonucleotides.

| | 10 uM-R1 | 10 uM-R2 | 3 uM-R1 | 3 uM-R2 | 1 uM-R1 | 1 uM-R2 |
|---|---|---|---|---|---|---|
| MOCK | 0.8 | 0.8 | 0.8 | 0.8 | 0.9 | 0.9 |
| MOCK | 0.7 | 0.7 | 0.8 | 0.8 | 0.8 | 0.8 |
| PMO | 18.0 | 18.0 | 5.6 | 5.7 | 3.8 | 4.0 |
| PMO | 19.3 | 17.9 | 9.6 | 9.4 | 3.1 | 3.1 |
| WV-9517 | 39.4 | 42.3 | 16.0 | 16.1 | 5.3 | 5.2 |
| WV-9517 | 43.8 | 42.9 | 18.5 | 17.5 | 5.5 | 5.7 |
| WV-9519 | 33.7 | 28.5 | 14.3 | 13.3 | 4.5 | 4.5 |
| WV-9519 | 27.6 | 27.9 | 12.4 | 11.3 | 4.1 | 4.1 |
| WV-9897 | 30.8 | 31.1 | 11.7 | 12.5 | 3.9 | 3.8 |
| WV-9897 | 32.3 | 30.7 | 12.0 | 11.9 | 4.6 | 4.7 |
| WV-9714 | 46.8 | 42.8 | 21.5 | 20.6 | 4.5 | 4.1 |
| WV-9714 | 46.5 | 48.1 | 25.4 | 25.6 | 4.2 | 2.9 |
| WV-9747 | 31.1 | 31.8 | 12.0 | 12.5 | 4.7 | 4.7 |
| WV-9747 | 27.6 | 28.0 | 10.5 | 11.1 | 3.5 | 3.7 |
| WV-9748 | 21.7 | 21.7 | 7.9 | 8.0 | 3.3 | 3.2 |
| WV-9748 | 21.1 | 20.9 | 8.5 | 8.1 | 3.1 | 3.1 |
| WV-9749 | 23.2 | 24.2 | 10.1 | 9.4 | 3.7 | 3.7 |
| WV-9749 | 25.3 | 24.6 | 10.7 | 10.5 | 3.7 | 3.9 |
| WV-9897 | 53.2 | 53.1 | 24.5 | 24.4 | 5.4 | 5.5 |
| WV-9897 | 48.3 | 48.7 | 22.8 | 22.8 | 4.8 | 4.8 |
| WV-9898 | 46.5 | 46.8 | 21.1 | 21.1 | 5.2 | 5.4 |
| WV-9898 | 46.3 | 46.4 | 23.4 | 23.8 | 5.0 | 4.6 |
| WV-9899 | 45.4 | 44.1 | 19.5 | 19.5 | 4.8 | 5.0 |
| WV-9899 | 44.9 | 44.0 | 21.4 | 21.2 | 5.5 | 5.6 |
| WV-9900 | 34.9 | 35.0 | 19.5 | 19.6 | 5.0 | 5.3 |
| WV-9900 | 30.2 | 31.5 | 17.6 | 17.6 | 4.4 | 4.4 |
| WV-9906 | 42.9 | 44.6 | 18.0 | 19.0 | 2.9 | 3.1 |
| WV-9906 | 37.5 | 36.3 | 17.5 | 18.2 | 2.8 | 3.2 |
| WV-9912 | 39.8 | 41.6 | 19.6 | 17.7 | 5.0 | 4.4 |
| WV-9912 | 41.6 | 40.8 | 21.3 | 19.9 | 4.2 | 4.2 |

Numbers represent skipping efficiency, wherein 100.0 would represent 100% skipping and 0.0 represents 0% efficiency; results from replicate experiments (R1 and R2) are shown.

Additional testing of oligonucleotides was performed, and the results were shown below in Tables 20 and 21.

TABLE 20

Example data of certain oligonucleotides.

| | 10 uM | 10 uM | 3 uM | 3 uM | 1 uM | 1 uM |
|---|---|---|---|---|---|---|
| WV-9517 | 34.6 | 35.6 | 17.0 | 19.4 | 6.7 | 7.8 |
| WV-9897 | 43.8 | | 26.8 | 27.3 | 9.7 | 9.8 |
| WV-9898 | 42.7 | 30.3 | 22.8 | 26.7 | 8.5 | 9.3 |
| WV-9899 | 45.0 | | 16.4 | 26.8 | 10.0 | 8.6 |
| WV-10670 | 32.4 | 32.9 | 15.2 | 18.2 | 7.2 | 8.0 |
| WV-10671 | 28.7 | 30.9 | 14.7 | 16.1 | 6.7 | 8.0 |
| WV-10672 | 25.6 | 28.1 | 11.8 | 12.2 | 5.0 | 5.0 |
| PMO | 40.8 | 36.0 | 19.1 | 18.6 | 10.7 | 11.7 |
| Mock | 1.1 | 1.9 | 1.8 | 1.9 | 1.7 | 2.5 |

Numbers represent skipping efficiency, wherein 100.0 would represent 100% skipping and 0.0 represents 0% efficiency; results from replicate experiments are shown.

TABLE 21

Example data of certain oligonucleotides.

A.

| | | | | | | | | |
|---|---|---|---|---|---|---|---|---|
| WV-9422 | WV-9425 | WV-9426 | WV-9517 | WV-9519 | WV-9521 | WV-9522 | WV-9524 | WV-9536 |
| a) 8, c) 4 | a) 8 | a) 3 | a) 10, c) 6 | a) 9, c) 4 | a) 8, c) 5 | a) 8, c) 5 | a) 9 | a) 7 |
| WV-9700 | WV-9701 | WV-9702 | WV-9703 | WV-9704 | WV-9709 | WV-9710 | WV-9711 | WV-9713 |
| a) 4 | a) 4 | a) 6 | a) 8 | a) 7 | a) 4 | a) 6 | a) 6 | a) 4 |
| WV-9714 | WV-9715 | WV-9746 | WV-9747 | WV-9748 | WV-9749 | WV-9750 | WV-9751 | WV-9756 |
| a) 13, c) 9 | a) 15, c) 9 | c) 4 | c) 4 | c) 4 | c) 4 | c) 4 | c) 4 | c) 7 |
| WV-9757 | WV-9758 | WV-9759 | WV-9760 | WV-9761 | WV-9743 | WV-9744 | WV-9745 | |
| c) 7 | c) 2 | c) 4 | c) 4 | c) 6 | c) 6 | c) 4 | c) 6 | |

B.

| | | | | |
|---|---|---|---|---|
| WV-9422 | WV-9425 | WV-9426 | WV-9429 | WV-9517 |
| b) 4 | b) 2 | b) 2 | b) 1 | b) 5 |

Oligonucleotides were tested in vitro in delta 52 cells. A, Exon skipping at 10 uM is shown. B, protein restoration. Different replicates or experiments are designated as a), b), and c).

Additional DMD oligonucleotides were tested for their ability to mediate skipping of a DMD exon, as shown below. Full PMO (Morpholino) oligonucleotides have the following sequences:

(SEQ ID NO: 3165)
PMO SR WV-13405 GTTGCCTCCGGTTCTGAAGGTGTTC
(SEQ ID NO: 3166)
PMO WV WV-13406 CTCCGGTTCTGAAGGTGTTC
(SEQ ID NO: 3167)
PMO WV-13407 TGCCTCCGGTTCTGAAGGTGTTCTTGTA

WV-13407 is also designated PMO NS.

TABLE 21C

Example data of certain oligonucleotides.

| | 10 uM | | | | 3 uM | | | |
|---|---|---|---|---|---|---|---|---|
| Mock | 0.1 | 0.2 | 0.1 | 0.1 | 0.1 | 0.1 | 0.1 | 0.1 |
| PMO SR | 1.8 | 1.6 | 1.1 | 0.9 | 0.5 | 0.5 | 0.5 | 0.4 |
| PMO WV | 0.8 | 1.0 | 1.0 | 1.1 | 0.4 | 0.4 | 0.5 | 0.3 |
| PMO | 2.3 | 2.5 | 1.8 | 1.8 | 1.0 | 0.9 | 0.6 | 0.6 |
| WV-10454 | 5.5 | 6.1 | 4.5 | 3.9 | 1.3 | 1.3 | 0.9 | 0.7 |
| WV-10455 | 10.5 | 13.8 | 7.3 | 7.8 | 2.1 | 2.8 | 2.0 | 2.5 |
| WV-10456 | 7.2 | 7.4 | 5.6 | 5.0 | 1.4 | 1.5 | 1.7 | 1.3 |
| WV-10457 | 9.8 | 14.2 | 8.4 | 9.0 | 3.8 | 2.9 | 3.2 | 2.9 |
| WV-10458 | 6.6 | 5.4 | 5.6 | 5.2 | 1.2 | 1.1 | 1.1 | 1.2 |
| WV-10459 | 2.4 | 2.8 | 2.7 | 2.5 | 1.0 | 1.0 | 0.5 | 0.5 |
| WV-10460 | 7.9 | 6.0 | 7.6 | 7.5 | 1.9 | 1.8 | 1.4 | 1.4 |
| WV-10461 | 14.9 | 11.3 | | | 5.7 | 6.0 | 2.4 | 3.7 |
| WV-10462 | 1.6 | 2.4 | 3.4 | 3.1 | 0.8 | 0.8 | 0.7 | 0.9 |
| WV-10463 | 2.6 | 3.2 | 2.9 | 2.7 | 0.7 | 0.7 | 0.7 | 0.7 |
| WV-10464 | 1.2 | 1.1 | 0.2 | 0.1 | 0.4 | 0.3 | 0.2 | 0.3 |
| WV-10465 | 2.3 | 1.8 | | | 0.6 | 0.7 | 0.7 | 0.7 |
| WV-10466 | 8.6 | 9.1 | 3.9 | 2.6 | 1.8 | 1.6 | 1.9 | 1.6 |
| WV-10467 | 3.2 | 0.8 | 1.4 | 1.1 | 4.1 | 4.3 | 3.3 | 2.9 |

TABLE 21C-continued

| Example data of certain oligonucleotides. | | | | | | | | |
|---|---|---|---|---|---|---|---|---|
| | 10 uM | | | | 3 uM | | | |
| WV-10468 | | | | | 2.1 | 2.0 | | |
| WV-10469 | 3.2 | 3.1 | 4.8 | 4.2 | 0.6 | 0.6 | 1.0 | 0.0 |
| WV-9699 | 4.6 | 3.2 | 2.8 | 2.4 | 0.8 | 0.9 | 0.7 | 0.5 |
| WV-9898 | 19.4 | 19.0 | 17.6 | 18.2 | 5.4 | 6.2 | 5.9 | 5.4 |

Numbers represent skipping efficiency, wherein 100 would represent 100% skipping and 0 would represent 0% skipping. Replicate data is shown.

In some embodiments, oligonucleotides, e.g., DMD oligonucleotides, are designed to target Intronic Splice Enhancer elements, e.g., for DMD oligonucleotides for exon 53 skipping, elements within 4 kb of Exon53. In some embodiments, provided oligonucleotides are 30-mers. Example data for certain such oligonucleotides are presented in Table 21D.

TABLE 21D

| Example data of certain oligonucleotides. | | | | |
|---|---|---|---|---|
| WV-10490 | 1.6 | 1.6 | 1.8 | 1.9 |
| WV-10491 | 1.6 | 1.7 | 1.7 | 1.5 |
| WV-10492 | 1.4 | 1.5 | 1.6 | 1.4 |
| WV-10493 | | | 0.9 | 0.6 |
| WV-10494 | 1.4 | 1.5 | 1.3 | 1.6 |
| WV-10495 | | | | |
| WV-10496 | 1.8 | 1.5 | 1.8 | 1.7 |
| WV-10497 | 1.6 | 1.6 | 1.5 | 1.7 |
| WV-10498 | 0.7 | 0.7 | 2.0 | 1.8 |
| WV-10499 | 1.5 | 1.4 | 1.7 | 1.6 |
| WV-10500 | 0.8 | 1.3 | 0.9 | 0.6 |
| WV-10501 | 1.2 | 1.7 | 1.3 | 1.4 |
| WV-10502 | 1.4 | 1.4 | 1.5 | 1.4 |
| WV-10503 | | 1.5 | 1.0 | 1.7 |
| WV-10504 | | | 1.6 | 1.8 |
| WV-10505 | 1.5 | 1.2 | 1.9 | 1.5 |
| WV-10506 | 0.8 | 0.8 | 1.4 | 1.3 |
| WV-10507 | 1.4 | 1.1 | 0.9 | 1.4 |
| WV-10508 | 1.5 | 1.4 | 1.8 | 1.7 |
| WV-10509 | 1.2 | 1.5 | 1.4 | 1.6 |
| WV-10510 | 1.3 | 1.7 | 1.0 | 1.6 |
| WV-10511 | 0.5 | 0.9 | 0.8 | 1.2 |
| WV-10512 | 1.3 | 1.5 | 1.7 | 1.7 |
| WV-10513 | 1.5 | 1.6 | 1.6 | 1.7 |
| WV-10514 | 1.1 | | 1.7 | 1.8 |
| WV-10515 | 2.0 | 1.9 | 1.9 | 1.9 |
| WV-10516 | 8.3 | 8.7 | 9.1 | 8.0 |
| WV-10517 | 0.5 | 0.5 | 1.7 | 1.5 |
| WV-10518 | 1.7 | 1.5 | 1.5 | 1.7 |
| WV-10519 | 1.8 | 1.6 | 1.8 | 1.8 |
| WV-10520 | 2.1 | 1.8 | 1.8 | 1.7 |
| WV-10521 | 3.3 | 3.1 | 2.6 | 3.4 |
| WV-10522 | 1.9 | 2.0 | 1.7 | 2.1 |
| WV-10523 | 2.3 | 2.1 | 1.9 | 1.9 |
| WV-10524 | 1.8 | 1.9 | 2.1 | 2.0 |
| WV-10525 | 2.0 | 2.1 | 1.1 | 1.6 |
| WV-10526 | 1.7 | 1.9 | 1.8 | 1.7 |
| WV-10527 | 1.1 | 1.3 | 1.4 | 1.5 |
| WV-10528 | 1.6 | 1.6 | 1.7 | 1.4 |
| WV-10529 | 1.6 | 1.1 | | |
| WV-10530 | 0.9 | 1.7 | 1.7 | 1.6 |
| WV-10531 | 1.2 | 1.5 | 1.0 | 1.3 |
| WV-10532 | 1.4 | 1.6 | 1.6 | 1.5 |
| WV-10533 | 1.4 | 0.5 | 1.5 | 1.5 |
| WV-10534 | 1.3 | 1.4 | 1.7 | 1.6 |
| WV-10535 | 0.9 | 0.6 | 1.7 | 1.6 |
| WV-10536 | 1.5 | 1.0 | 1.4 | 1.3 |
| WV-10537 | 1.4 | 1.6 | 1.6 | 1.4 |
| WV-9517 | 44.5 | 42.5 | 41.6 | 43.2 |
| WV-9699 | 13.0 | 12.7 | 9.8 | 9.3 |
| Mock | 1.6 | 1.7 | 1.4 | 1.3 |

Results: Gymnotic delivery of 10 μM Intron ASO's in Δ45-52 patient derived myoblasts (4 days post-differentiation). Done in biological replicates. Numbers represent percentage of exon skipping, as determined by RT-qPCR.

TABLE 21E

| Example data of certain oligonucleotides. | | | | | | |
|---|---|---|---|---|---|---|
| Conc. | 10 | 3.33 | 1.11 | 0.3704 | 0.1235 | 0 |
| WV-13405 | 35.2 | 23.1 | 9.0 | 4.0 | 2.2 | 1.0 |
| (PMO) | 36.3 | 23.1 | 8.7 | 4.0 | 2.3 | 1.2 |
| | 33.1 | 20.6 | 8.3 | 3.3 | 2.1 | 1.0 |
| | 33.7 | 20.7 | 8.3 | 3.2 | 2.2 | 1.2 |
| WV-9898 | 31.2 | 22.2 | 8.6 | 1.7 | 1.3 | 1.1 |
| | 30.4 | 22.5 | 10.3 | 1.5 | 1.2 | 0.9 |
| | 49.6 | 23.3 | 6.2 | 1.7 | 1.4 | 1.2 |
| | 48.3 | 22.3 | 5.5 | 1.5 | 1.6 | 1.5 |
| WV-12880 | 73.1 | 53.5 | 38.4 | 10.3 | 4.5 | 1.0 |
| | 72.1 | 54.3 | 37.6 | 10.3 | 4.8 | 1.1 |
| | 69.3 | 51.5 | 24.4 | 5.5 | 3.5 | 1.2 |
| | 69.6 | 52.6 | 23.7 | 6.2 | 3.2 | 1.0 |
| WV-9517 | 40.4 | 28.1 | 3.5 | 2.1 | 1.4 | 1.0 |
| | 39.8 | 28.2 | 1.2 | 2.1 | 1.3 | 1.0 |
| | 29.3 | 18.1 | 5.5 | 1.8 | 1.3 | 1.6 |
| | 28.9 | 17.4 | 4.9 | 1.7 | 1.3 | 1.4 |
| WV-9897 | 21.2 | 20.0 | 3.9 | 1.6 | 2.1 | 1.3 |
| | 23.6 | 18.5 | 3.7 | 1.9 | 2.1 | 1.2 |
| | 39.5 | 18.7 | 5.1 | 1.7 | 2.0 | 1.5 |
| | 40.9 | 18.5 | 5.2 | 1.6 | 1.8 | 1.0 |
| WV-12887 | 79.7 | 59.4 | 44.2 | 9.6 | 5.5 | 0.9 |
| | 78.7 | 58.8 | 44.1 | 9.6 | 5.6 | 0.9 |
| | 76.1 | 61.0 | 38.1 | 12.3 | 6.7 | 1.1 |
| | 75.0 | 61.3 | 31.9 | 9.8 | 5.1 | 1.1 |

Δ45-52 DMD patient derived myoblasts, with 7d of pre-differentiation, were treated with oligonucleotides in muscle differentiation medium at indicated concentrations under free uptake condition before being collected and analyzed for RNA skipping efficiency (4d dosing) by qPCR. Relative (SRSF9 normalization) quantification. Oligonucleotides were tested at a concentration of 0 to 10 μM. Results of replicate experiments are shown. Some of the oligonucleotides tested comprise a non-negatively charged internucleotidic linkage (WV-12887 and WV-12880).

TABLE 21F

| Example data of certain oligonucleotides. | | | | | | | | |
|---|---|---|---|---|---|---|---|---|
| | 10 uM | | | | 3.3 uM | | | |
| Mock | 0.3 | 0.3 | 0.3 | 0.4 | 0.3 | 0.3 | 0.3 | 0.3 |
| WV-13405 (PMO) | 4.3 | 4.5 | 4.2 | 4.7 | 1.2 | 1.1 | 1.8 | 1.9 |
| WV-9517 | 15.0 | 14.2 | | | 5.6 | 5.8 | 8.7 | 9.3 |
| WV-11340 | 32.4 | 33.7 | 35.9 | 36.9 | 15.4 | 13.0 | 15.9 | 15.0 |
| WV-12873 | 38.7 | 37.5 | 39.6 | 39.2 | 13.6 | 11.7 | 17.0 | 14.5 |
| WV-12872 | 44.9 | 41.9 | 44.1 | 46.5 | 15.7 | 17.5 | 15.7 | 19.5 |
| WV-13408 | 49.0 | 48.7 | 50.2 | 50.3 | 21.6 | 22.0 | 23.0 | 24.5 |
| WV-12553 | 18.3 | 20.7 | 18.7 | 24.1 | 7.4 | 7.6 | 9.7 | 8.4 |
| WV-12557 | 40.0 | 39.2 | 33.8 | 35.9 | 15.3 | 15.5 | 23.6 | 23.9 |
| WV-12554 | 38.8 | 39.0 | 43.5 | 44.9 | 15.1 | 14.0 | 20.5 | 20.3 |
| WV-13409 | 34.6 | 38.4 | 39.1 | 40.3 | 14.7 | 12.9 | 18.9 | 16.5 |
| WV-9898 | 24.1 | 22.0 | | | 7.9 | 7.7 | 9.9 | 8.5 |
| WV-11342 | 30.4 | 34.5 | 31.3 | 31.9 | 14.3 | 14.4 | 14.1 | 13.3 |
| WV-12559 | 44.3 | 41.8 | | | 16.6 | 16.5 | 17.4 | 19.4 |
| WV-12556 | 42.5 | 43.0 | 39.7 | 43.3 | 16.1 | 17.1 | 18.8 | 17.1 |
| WV-9897 | 20.8 | 17.9 | | | 6.0 | 5.4 | 6.8 | 4.8 |
| WV-11341 | 36.6 | 39.4 | | | 17.8 | 16.8 | 18.2 | 19.3 |
| WV-12558 | 41.5 | 39.4 | 36.0 | | 18.2 | 15.1 | 18.5 | 16.7 |
| WV-12555 | 44.3 | 43.6 | | | 20.5 | 19.0 | 20.2 | 22.1 |
| WV12880 | 41.1 | 43.2 | 46.1 | 45.1 | 27.4 | 24.6 | 25.9 | 29.1 |
| WV-12877 | 51.5 | 53.3 | | | 26.2 | 27.1 | 30.2 | 30.7 |
| WV-12125 | 47.3 | 49.4 | 37.8 | 35.1 | 21.3 | 20.6 | 24.0 | 23.5 |
| WV-12127 | 40.0 | 40.6 | 41.2 | 39.7 | 19.9 | 15.5 | 18.3 | 18.0 |
| WV-12129 | 33.5 | 35.0 | 24.4 | 24.4 | 13.9 | 10.7 | 14.4 | 13.7 |

Δ45-52 DMD patient derived myoblasts were treated with oligos in muscle differentiation medium at indicated concentrations for 4d under free uptake conditions and analyzed for RNA skipping efficiency by qPCR.

TABLE 21G

Example data of certain oligonucleotides.

| Oligo Conc [uM] | 10 uM | | | | 3.3 uM | | | |
|---|---|---|---|---|---|---|---|---|
| Mock | 0.6 | 0.6 | 0.6 | 0.8 | 0.7 | 0.6 | 1.0 | 0.8 |
| WV-13405 (PMO) | 6.9 | 7.4 | 10.1 | 10.9 | 2.2 | 1.9 | 4.1 | 4.4 |
| WV-9517 | 24.2 | 22.0 | 11.5 | 33.7 | 9.3 | 9.8 | 19.8 | 20.6 |
| WV-11340 | 50.8 | 54.1 | 61.6 | 63.9 | 30.1 | 22.0 | 33.2 | 30.6 |
| WV-12872 | 70.6 | 66.4 | 71.0 | 74.6 | 24.7 | 29.2 | 27.9 | 38.9 |
| WV-12873 | 60.8 | 59.5 | 62.9 | 62.8 | 20.4 | 15.3 | 33.5 | 24.5 |
| WV-13408 | 73.5 | 72.3 | 75.8 | 75.6 | 35.6 | 35.7 | 42.2 | 46.3 |
| WV-12553 | 32.7 | 39.1 | 38.0 | 51.3 | 13.7 | 14.6 | 22.7 | 18.9 |
| WV-12557 | 65.2 | 64.4 | 76.7 | 80.4 | 26.3 | 27.1 | 45.3 | 45.6 |
| WV-12554 | 61.0 | 61.5 | 69.5 | 71.7 | 27.0 | 22.9 | 38.5 | 37.6 |
| WV-13409 | 57.2 | 63.6 | 66.2 | 69.3 | 23.6 | 18.9 | 34.4 | 28.4 |
| WV-9898 | 45.1 | 40.3 | 16.3 | 14.4 | 13.2 | 12.1 | 20.8 | 16.1 |
| WV-11342 | 49.9 | 58.1 | 57.9 | 60.0 | 27.4 | 27.8 | 30.3 | 27.4 |
| WV-12559 | 72.4 | 68.4 | 50.8 | 56.1 | 33.3 | 32.8 | 35.5 | 42.5 |
| WV-12556 | 70.5 | 71.0 | 68.4 | 73.5 | 31.0 | 33.5 | 42.0 | 37.0 |
| WV-9897 | 42.0 | 34.9 | | 41.2 | 10.2 | 8.0 | 17.9 | 9.4 |
| WV-11341 | 61.6 | 67.2 | 74.1 | 74.4 | 37.0 | 33.8 | 40.8 | 42.9 |
| WV-12558 | 71.6 | 68.0 | 66.3 | | 35.6 | 27.1 | 40.5 | 35.5 |
| WV-12555 | 70.2 | 68.9 | 56.0 | 61.7 | 35.2 | 32.4 | 40.1 | 45.0 |
| WV12880 | 58.8 | 63.0 | 68.5 | 66.5 | 44.4 | 36.6 | 44.8 | 52.1 |
| WV-12877 | 77.9 | 80.2 | 69.5 | 75.6 | 46.3 | 48.2 | 55.8 | 58.4 |
| WV-12125 | 71.1 | 74.1 | 83.6 | 80.4 | 36.5 | 34.8 | 45.6 | 44.3 |
| WV-12127 | 61.9 | 64.0 | 67.8 | 66.2 | 35.0 | 23.3 | 35.5 | 34.7 |
| WV-12129 | 52.7 | 55.8 | 63.1 | 63.6 | 23.8 | 14.7 | 26.5 | 24.1 |

Δ45-52 DMD patient derived myoblasts, with 7d of pre-differentiation, were treated with oligos in muscle differentiation medium at indicated concentrations for 4d under free uptake conditions and analyzed for RNA skipping efficiency by qPCR.

TABLE 21H

Example data of certain oligonucleotides.

| | | | | | |
|---|---|---|---|---|---|
| WV-12553 | 27.2 | WV-12124 | 74.4 | WV-12127 | 45.0 |
| | 30.1 | | 67.6 | | 42.3 |
| | 32.1 | | 67.7 | | 43.2 |
| WV-11341 | 63.6 | WV-12125 | 65.8 | WV-12129 | 50.2 |
| | 55.0 | | 74.2 | | 53.3 |
| | 55.7 | | 92.6 | | 51.2 |
| WV-11342 | 51.7 | WV-12126 | 65.8 | WV-12882 | 60.6 |
| | 54.0 | | 57.9 | | 66.9 |
| | 50.8 | | 55.8 | | 68.6 |
| WV-12555 | 81.1 | WV-12880 | 65.2 | WV-12878 | 76.0 |
| | | | 63.9 | | 75.1 |
| | 76.2 | | 60.9 | | 78.1 |
| WV-12556 | 73.4 | WV-12881 | 61.9 | WV-12876 | 67.0 |
| | 75.1 | | 60.3 | | 62.0 |
| | 66.9 | | 57.7 | | 66.4 |
| WV-12558 | 59.9 | WV-12123 | 59.5 | | |
| | 78.8 | | 55.1 | | |
| | 66.0 | | 49.9 | | |
| WV-12559 | 68.3 | WV-12877 | 78.9 | | |
| | 76.3 | | 78.0 | | |
| | 73.3 | | 83.1 | | |
| WV-9897 | 59.9 | | | | |
| | 59.6 | | | | |
| | 58.6 | | | | |
| WV-9898 | 44.7 | | | | |
| | 39.1 | | | | |
| | 46.3 | | | | |

Full length oligonucleotide stability at 5 day timepoint in Human Liver homogenate was tested. Numbers are replicates and represent percentage of full-length oligonucleotide remaining, wherein 100 would represent 100% oligonucleotide remaining (complete stability) and 0 would represent 0% oligonucleotide remaining (complete instability). Some nucleotides tested comprise a non-negatively charged internucleotidic linkage.

TABLE 21I

Example data of certain oligonucleotides.

| Oligo Conc [uM] | WV-9517 | WV-13826 | WV-13827 | WV-13835 | Mock |
|---|---|---|---|---|---|
| 10 uM | 45.7 | 46.5 | 23.1 | 40.5 | 1.2 |
| | 46.3 | 45.8 | 22.9 | 58.8 | 1.1 |
| | 49.3 | 46.8 | 26.8 | 54.5 | 1.3 |
| | 48.5 | 50.3 | 28.1 | 55.2 | 1.2 |
| 3.3 uM | 18.1 | 20.3 | 7.9 | 24.6 | 1 |
| | 17 | 19.5 | 8.3 | 25.3 | 1.1 |
| | 22.6 | 19.7 | 8.8 | 26.6 | 1.1 |
| | 22.8 | 20.2 | 8.3 | 27.2 | 1.1 |
| 1.1 uM | 6 | 7 | 2.9 | 7.9 | 1 |
| | 6 | 6.2 | 2.7 | 7.4 | 1.2 |
| | 6.9 | 7.3 | 0.7 | 9.6 | 0.9 |
| | 6.6 | 6.8 | 0.9 | 9.1 | 0.7 |
| | WV-9517 | WV-12880 | WV-13864 | WV-14344 | MOCK |
| 10 uM | 36.1 | 60.2 | 66.8 | 47.9 | 0.9 |
| | 38.3 | 62.0 | 67.0 | 46.8 | 1.0 |
| | 44.5 | 60.9 | 68.7 | 56.8 | 1.2 |
| | 43.9 | 59.2 | 69.6 | 56.3 | 1.0 |
| 3.3 uM | 15.4 | 38.3 | 45.3 | 25.1 | 0.9 |
| | 15.8 | 37.3 | 45.6 | 27.0 | 0.9 |
| | 18.8 | 37.9 | 50.5 | 39.2 | 1.0 |
| | 18.8 | 39.6 | 49.3 | 38.9 | 1.0 |
| 1.1 uM | 4.7 | 15.8 | 21.5 | 12.2 | 0.6 |
| | 4.9 | 14.4 | 22.6 | 12.4 | 0.9 |
| | 6.4 | 18.5 | 24.9 | 17.2 | 1.1 |
| | 6.2 | 16.2 | 13.2 | 17.1 | 0.9 |
| 0.3 uM | 2.2 | 5.0 | 6.6 | 5.7 | 0.8 |
| | 1.8 | 5.0 | 5.9 | 5.7 | 0.9 |
| | 2.7 | 7.4 | 8.2 | 7.2 | 1.0 |
| | 2.7 | 7.5 | 8.2 | 6.9 | 1.0 |

Numbers indicate amount of skipping relative to control.

TABLE 21I.1

Example data of certain oligonucleotides.

| | 10 uM | 3.3 uM | 1.1 uM | 0.3 uM | 0.1 uM |
|---|---|---|---|---|---|
| Mock | 1.1 | 1.2 | | 0.8 | 1.0 |
| | 1.0 | 1.1 | 2.0 | 0.9 | 1.0 |
| | 1.1 | 0.7 | 1.1 | 1.0 | 1.1 |
| | 1.2 | 0.7 | 1.1 | 0.9 | 1.0 |
| Wv-13405 (PMO) | 44.8 | 28.6 | 18.1 | 9.5 | 4.0 |
| | 44.8 | 23.4 | 17.4 | 8.7 | 4.0 |
| | 51.2 | 26.5 | 11.4 | 5.1 | 3.7 |
| | 50.8 | 25.6 | 11.2 | 5.5 | 3.6 |
| WV-9517 | 35.9 | 18.3 | 6.5 | 2.2 | 1.9 |
| | 36.6 | 17.3 | 6.4 | 2.1 | 1.9 |
| | 40.2 | 23.4 | 5.5 | 2.7 | 1.7 |
| | 38.7 | 25.6 | 5.9 | 2.2 | 1.8 |
| Wv-12880 | 57.3 | 36.3 | 16.4 | 4.8 | 7.5 |
| | 55.8 | 37.0 | 18.1 | 2.8 | 4.7 |
| | 57.5 | 35.9 | 16.6 | 8.0 | 7.4 |
| | 58.9 | 33.0 | 16.5 | 7.2 | 6.8 |
| WV-13864 | 68.1 | 45.1 | 22.6 | 10.5 | 7.4 |
| | 68.0 | 44.5 | 23.0 | 12.0 | 5.6 |
| | 67.5 | 43.1 | 24.3 | 8.4 | 6.0 |
| | 64.8 | 44.5 | 19.9 | 3.3 | 6.1 |
| WV-13835 | 40.2 | 21.5 | 6.3 | 2.8 | 2.0 |
| | 39.4 | 20.3 | 9.7 | 2.5 | 2.0 |
| | 50.0 | 21.0 | 5.5 | 3.2 | 2.0 |
| | 47.7 | 20.6 | 6.0 | 3.3 | 2.2 |

TABLE 21I.1-continued

Example data of certain oligonucleotides.

| | 10 uM | 3.3 uM | 1.1 uM | 0.3 uM | 0.1 uM |
|---|---|---|---|---|---|
| WV- | 41.4 | 25.9 | 7.4 | 4.7 | 0.7 |
| 14791 | 40.3 | 24.8 | 5.8 | 4.0 | 0.5 |
| | 40.1 | 24.9 | 9.1 | 4.3 | 3.9 |
| | 41.3 | 27.2 | 8.9 | 4.6 | 3.5 |
| WV- | 50.1 | 28.6 | 13.6 | 6.4 | 3.8 |
| 14344 | 47.4 | 28.6 | 8.8 | 5.8 | 4.7 |
| | 54.9 | 46.1 | 18.0 | 11.4 | 6.6 |
| | 55.7 | 38.3 | 18.7 | 11.8 | 6.0 |

Skipping efficiency of various DMD oligonucleotides, tested for skipping of DMD exon 53. Numbers represent skipping of exon 53.

Δ45-52 patient myoblasts were differentiated for 7 days, then treated with oligonucleotide for 4d under gymnotic conditions in differentiation media. RNA was harvested by Trizol extraction and skipping analyzed by TaqMan.

TABLE 21I.2

Example data of certain oligonucleotides.

| | 10 uM | 3.3 uM | 1.1 uM | 0.3 uM | 0.1 uM |
|---|---|---|---|---|---|
| Mock | 0.7 | 0.6 | 0.6 | 0.6 | 0.7 |
| | 0.7 | 0.7 | 0.6 | 0.6 | 0.7 |
| | 0.6 | 0.6 | 0.6 | 0.7 | 0.7 |
| | 0.5 | 0.5 | 0.7 | 0.6 | 0.7 |
| Wv- | 9.4 | 1.5 | 3.4 | 1.1 | 0.8 |
| 13405 | 9.3 | 1.4 | 3.1 | 1.1 | 0.8 |
| (PMO) | 6.6 | 2.8 | 1.5 | 0.9 | 0.8 |
| | 6.3 | 2.6 | 1.5 | 1.0 | 0.8 |
| WV- | 29.3 | 8.4 | 2.6 | 1.0 | 0.7 |
| 9517 | 28.7 | 9.2 | 3.0 | 1.1 | 0.8 |
| | 16.6 | 6.6 | 2.3 | 1.1 | 0.7 |
| | 16.9 | 6.8 | 2.2 | 1.1 | 0.9 |
| WV- | 37.9 | 17.7 | 9.6 | 3.4 | 1.3 |
| 12880 | 38.8 | 19.9 | 9.1 | 3.3 | 1.4 |
| | 31.4 | 16.1 | 7.9 | 3.3 | 1.6 |
| | 31.6 | 16.8 | 8.0 | 3.0 | 1.5 |
| WV- | 55.9 | 28.6 | 11.7 | 4.3 | 2.0 |
| 13864 | 54.3 | 27.8 | 11.6 | 4.6 | 2.0 |
| | 43.4 | 22.2 | 10.7 | 4.2 | 2.0 |
| | 43.0 | 22.7 | 9.8 | 3.8 | 2.1 |
| WV- | 38.7 | 11.6 | 2.9 | 1.3 | 0.9 |
| 13835 | 37.2 | 11.0 | 2.9 | 1.3 | 0.8 |
| | 42.3 | 13.1 | 3.5 | 1.2 | 0.9 |
| | 41.5 | 10.0 | 3.1 | 1.3 | 0.9 |
| WV- | 26.3 | 12.1 | 5.2 | 1.9 | 1.3 |
| 14791 | 24.8 | 11.2 | 4.7 | 2.1 | 1.1 |
| | 28.0 | 13.0 | 5.2 | 2.2 | 1.2 |
| | 27.6 | 12.4 | 4.9 | 2.1 | 1.4 |
| WV- | 36.2 | 17.8 | 8.0 | 2.7 | 1.7 |
| 14344 | 37.4 | 17.0 | 7.1 | 2.7 | 1.8 |
| | 37.4 | 22.3 | 9.8 | 3.7 | 1.7 |
| | 36.6 | 22.6 | 9.9 | 3.7 | 1.5 |

Skipping efficiency of various DMD oligonucleotides, tested for skipping of DMD exon 53. Numbers represent skipping of exon 53.

Δ45-52 patient myoblasts were treated with oligonucleotide for 4d (4 days) under gymnotic conditions in differentiation media. RNA was harvested by Trizol extraction and skipping analyzed by TaqMan.

Several oligonucleotides (including WV-9517, WV-13864, WV-13835, and WV-14791) were tested at various concentrations up to 30 uM for TLR9 activation in vitro in HEK-blue-TLR9 cells (16 hour gymnotic uptake). WV-13864 and WV-14791 comprise a chirally controlled non-negatively charged internucleotidic linkage in the Rp configuration. WV-9517, WV-13864, WV-13835, and WV-14791 did not exhibit significant TLR9 activation (less than 2-fold TLR9 induction; data not shown). WV-13864 and WV-14791 also exhibited negligible signal up to 30 uM in PBMC cytokine release assay compared to water (data not shown).

Example Dystrophin Oligonucleotides and Compositions Which Target Exon 54

In some embodiments, the present disclosure provides oligonucleotides, oligonucleotide compositions, and methods of use thereof for targeting exon 54 and/or mediating skipping of exon 54 in human DMD. Non-limiting examples include oligonucleotides and compositions of Exon 54 oligos include: WV-13745, WV-13746, WV-13747, WV-13748, WV-13749, WV-13750, WV-13751, WV-13752, WV-13753, WV-13754, WV-13755, WV-13756, WV-13757, WV-13758, WV-13759, WV-13760, WV-13784, and WV-13785, and other oligonucleotides having a base sequence which comprises at least 15 contiguous bases of any of these DMD oligonucleotides.

TABLE 21J

Example data of certain oligonucleotides.

| | | | | |
|---|---|---|---|---|
| WV-13745 | 0.2 | 0.3 | 0.2 | 0.0 |
| WV-13746 | 0.6 | 0.6 | 0.4 | 0.4 |
| WV-13747 | 0.4 | 0.5 | 0.4 | 0.4 |
| WV-13748 | 1.1 | 1.2 | 0.7 | 0.9 |
| WV-13749 | 2.5 | 2.1 | 1.7 | 1.8 |
| WV-13750 | 1.9 | 2.1 | 1.4 | 1.4 |
| WV-13751 | 4.3 | 5.1 | 4.4 | 5.7 |
| WV-13752 | 0.0 | 0.0 | 3.1 | 3.9 |
| WV-13753 | 0.0 | 0.0 | 0.0 | 0.0 |
| WV-13754 | 6.0 | | 1.4 | 1.7 |
| WV-13755 | 1.1 | 1.2 | 0.5 | 0.5 |
| WV-13756 | 4.7 | 5.0 | 2.3 | 2.4 |
| WV-13757 | 1.9 | 2.1 | 1.1 | 1.4 |
| WV-13758 | 2.0 | 2.2 | 0.9 | 1.2 |
| WV-13759 | 0.7 | 0.7 | 0.4 | 0.2 |
| WV-13760 | 0.7 | 0.6 | 0.3 | 0.5 |
| WV-13784 | 0.0 | 0.0 | 0.0 | 0.0 |
| WV-13785 | 0.0 | 0.0 | 0.0 | 0.0 |
| Mock | 0.0 | | 0.0 | |
| Mock | 0.0 | | 0.0 | |

Skipping efficiency of various DMD oligonucleotides, tested for skipping of DMD exon 54.

Example Dystrophin Oligonucleotides and Compositions Which Target Exon 55

In some embodiments, the present disclosure provides oligonucleotides, oligonucleotide compositions, and methods of use thereof for targeting exon 55 and/or mediating skipping of exon 55 in human DMD. Non-limiting examples include oligonucleotides and compositions of Exon 55 oligos include: WV-13761, WV-13762, WV-13763, WV-13764, WV-13765, WV-13766, WV-13767, WV-13768, WV-13769, WV-13770, WV-13771, WV-13772, WV-13773, WV-13774, WV-13775, WV-13776, WV-13777, WV-13778, WV-13779, WV-13786, and WV-13787, and other oligonucleotides having a base sequence (naked sequence) which comprises at least 15 contiguous bases of any of these DMD oligonucleotides.

In some embodiments, two or more oligonucleotides capable of skipping or targeting exon 44, 46, 47, 51, 52, 53, 54 and/or 55 can be used in any combination to mediate multiple exon skipping.

TABLE 21K

| Example data of certain oligonucleotides. | | | | |
|---|---|---|---|---|
| WV-13761 | 0.5 | 0.5 | 0.3 | 0.4 |
| WV-13762 | 0.3 | 0.2 | 0.1 | 0.1 |
| WV-13763 | 0.2 | 0.2 | 0.2 | 0.2 |
| WV-13764 | 0.1 | 0.1 | 0.1 | 0.1 |
| WV-13765 | 1.0 | 1.0 | 0.4 | 0.4 |
| WV-13766 | 2.6 | 2.7 | 1.7 | 1.8 |
| WV-13767 | 0.2 | 0.0 | 1.4 | 1.6 |
| WV-13768 | 1.1 | 1.1 | 0.7 | 0.7 |
| WV-13769 | 1.6 | 1.8 | 1.1 | 1.1 |
| WV-13770 | 1.4 | 1.4 | 0.8 | 0.9 |
| WV-13771 | 0.3 | 0.4 | 0.2 | 0.2 |
| WV-13772 | 1.8 | 1.7 | 0.9 | 0.9 |
| WV-13773 | 0.0 | 0.0 | 0.1 | 0.1 |
| WV-13774 | 0.0 | 0.0 | 0.0 | 0.0 |
| WV-13775 | 1.0 | 0.8 | 0.3 | 0.4 |
| WV-13776 | 0.7 | 0.6 | 0.3 | 0.7 |
| WV-13777 | 2.8 | 2.2 | 0.4 | 1.1 |
| WV-13778 | 0.3 | 0.3 | 0.2 | 0.3 |
| WV-13779 | 0.0 | 0.0 | 0.4 | 0.4 |
| WV-13786 | 0.0 | 0.0 | 2.0 | 2.3 |
| WV-13787 | 0.0 | 0.0 | 0.2 | 0.1 |
| Mock | 0.0 | 0.0 | 0.0 | 0.0 |
| Mock | 0.0 | 0.0 | 0.0 | 0.0 |

Skipping efficiency of various DMD oligonucleotides, tested for skipping of DMD exon 55.

Example Dystrophin Oligonucleotides and Compositions Which Target Exon 57

In some embodiments, the present disclosure provides oligonucleotides, oligonucleotide compositions, and methods of use thereof for targeting exon 57 and/or mediating skipping of exon 57 in human DMD. Non-limiting examples include oligonucleotides and compositions of Exon 57 oligos include: WV-18853, WV-18854, WV-18855, WV-18856, WV-18857, WV-18858, WV-18859, WV-18860, WV-18861, WV-18862, WV-18863, WV-18864, WV-18865, WV-18866, WV-18867, WV-18868, WV-18869, WV-18870, WV-18871, WV-18872, WV-18873, WV-18874, WV-18875, WV-18876, WV-18877, WV-18878, WV-18879, WV-18880, WV-18881, WV-18882, WV-18883, WV-18884, WV-18885, WV-18886, WV-18887, WV-18888, WV-18889, WV-18890, WV-18891, WV-18892, WV-18893, WV-18894, WV-18895, WV-18896, WV-18897, WV-18898, WV-18899, WV-18900, WV-18901, WV-18902, WV-18903, WV-18904, and other oligonucleotides having a base sequence (naked sequence) which comprises at least 15 contiguous bases of any of these DMD oligonucleotides.

Example Dystrophin Oligonucleotides and Compositions for Exon Skipping of Mutiple Exons (Multi-Exon Skipping)

In some embodiments, the present disclosure provides oligonucleotides, compositions, and methods for splicing modulation, including skipping of multiple exons. In some embodiments, a DMD oligonucleotide or composition thereof is capable of mediating skipping of multiple exons in the human or mouse Dystrophin gene.

In some embodiments, in a patient with muscular dystrophy, the symptoms of muscular dystrophy can at least be partially relieved and/or the disorder at least partially treated by administration of a DMD oligonucleotide capable of skipping one exon or multiple exons. Without wishing to be bound by any particular theory, the present disclosure notes that BMD patients with a deletion of exons 45 to 55 of DMD showed a milder or asymptomatic phenotype.

A non-limiting example of a scheme for multiple exon skipping is shown in FIG. 1. In this Figure, various numbers (43 to 57) indicate exons; and the shapes of the exons (e.g., <, > or |) indicate which reading frame is represented at the 5' and 3' end of each exon. Normally exon 44 is joined to exon 45. In a non-limiting example of multiple exon skipping, exons 45 to 55 are skipped, allowing exon 44 to join to exon 56. The 3' end of exon 44 is represented by the same reading frame (<) as the 5' end of exon 56; thus skipping exons 45 to 55 maintains or restores the correct reading frame. In some embodiments, skipping multiple exons restores the reading frame if one of the skipped exons comprises a mutation which alters the reading frame (in many cases, for example, producing a missense or prematurely truncated protein).

Among other things, the present disclosure notes that various exons represent at their 5' and/or 3' ends different reading frames; thus, some combinations of skipping adjacent reading frames but not other combinations are capable of maintaining or restoring the reading frame. In some embodiments, provided compositions and methods for multiple exon skipping skip, as non-limiting examples, exons 45-46, 45-47, 45-48, 45-49, 45-51, 45-53, 45-55, 47-48, 47-49, 47-51, 47-53, 47-55, 48-49, 48-51, 48-53, 46-55, 50-51, 50-53, 50-55, 49-51, 49-53, 49-55, 52-53, 52-55, 44-45, 44-54, or 44-56, wherein in each case multiple exon skipping maintains or restores the correct reading frame. In some embodiments, skipping of non-overlapping sets of exons is capable of maintaining or restoring reading frame, e.g., skipping of exons 45-46 and exons 49-55; skipping of exons 45-47 and 49-55; skipping of exons 45-49 and 52-55; etc.

Without wishing to be bound by any particular theory, the present disclosure notes that some DMD exons may be spliced transcriptionally, while others are spliced post-transcriptionally. For example, each of exons 45 to 55 are reportedly not simultaneously spliced, but rather first as three groups: exons 45 to 49, 50 to 52, and 53 to 55, the individual exons within each group being spliced transcriptionally. Reportedly, the remaining introns (between exons 44/45, 49/50, 52/53, and 55/56) are later spliced post-transcriptionally. Without wishing to be bound by any particular theory, the present disclosure notes that this lag in the timing of splicing may be exploited by oligonucleotides capable of increasing the splicing between exons whose adjacent introns are spliced post-transcriptionally, such as exon 44 and 56. It is reported that in nature, such multi-exon skipping joining exon 44 to exon 56 occurs at a low but detectable frequency (approximately 1/600). Without wishing to be bound by any particular theory, the present disclosure pertains in part to DMD oligonucleotides capable of skipping multiple exons at a therapeutically and clinically significant level.

In some embodiments, a composition capable of mediating multiple exon skipping comprises a DMD oligonucleotide. In some embodiments, a composition capable of mediating multiple exon skipping comprises a combination of (e.g., two or more different) DMD oligonucleotides. In some embodiments, a composition capable of mediating multiple exon skipping comprises a combination of (e.g., two or more different) DMD oligonucleotides, wherein at least one oligonucleotide recognizes a target associated with skipping the 5' exon to be skipped, and at least one oligonucleotide recognizes a target associated with skipping the 3' exon to be skipped. In some embodiments, a composition capable of mediating multiple exon skipping comprises a oligonucleotide capable of recognizes both (1) a target associated with skipping the 5' exon to be skipped and (2) a target associated with skipping the 3' exon to be skipped.

In some embodiments, an advantage of a composition capable of multiple exon skipping is that it is useful for treatment of dystrophy associated with a mutation in any individual exon included in the group of exons which is skipped. As a non-limiting example, a DMD oligonucleotide capable of mediating skipping of exon 48 is only capable of treating mutations within that exon (or, in some cases, an adjacent or nearby exon) but not mutations within other exons. However, a composition capable of mediating skipping of exons 45 to 55 is capable of treating mutations in any of exons 45, 46, 47, 48, 49, 50, 51, 52, 53, 54 or 55. Thus, both a patient with a mutation in exon 48 and a patient with a mutation in exon 54 can be treated with a composition capable of skipping exons 45 to 55. In some embodiments, a composition capable of mediating skipping of exons 45 to 55 is capable of treating up to about 63% of DMD patients.

In some embodiments, a composition comprises one or more DMD oligonucleotides, wherein the composition is capable of mediating skipping of multiple (two or more) DMD exons.

In some embodiments, a MESO(a composition comprising one or more oligonucleotides, which composition is capable of mediating multiple exon skipping) has an advantage over a DMD oligonucleotide capable of skipping only one exon. In some embodiments, a composition which is capable of mediating skipping of a single exon, is only useful for treating patients treatable by skipping that exon (e.g., patients having a genetic lesion in that exon). In some embodiments, a MESO is useful for treating patients treatable by skipping any of the exons which the MESO is able to skip, which is likely a larger percentage of the patient population. In some embodiments, double or multiple exon skipping can potentially be applicable to 90% of patients.

In addition, in some embodiments, because the 5' and 3' ends of an exon are sometimes not in the same frame, deletion of such an exon would cause a frameshift. Skipping of multiple exons, in various such cases, can restore the reading frame.

In some embodiments, multiple exon skipping is useful to treat DMD patients with deletion, duplication, and nonsense mutations.

In addition, in some embodiments, skipping of multiple exons can mimic the genetics of the milder Becker muscular dystrophy. In some embodiments, the more severe Duchenne muscular dystrophy, mediated by a genetic lesion in one exon, can be converted into a milder Becker muscular dystrophy, mediated by an in-frame deletion of multiple exons. It is reported that some BMD patients and an asymptomatic person have in-frame deletions of exons 48 to 51 or 45 to 51. Singh et al. 1997 Hum. Genet. 99:206-208; Melacini et al. 1993 J. Am. Col. Cardiol. 22:1927-1934; Melis et al. 1998 Eur. J. Paediatr. Neurol. 2:255-261; and Aartsma-Rus et al. 2003 Hum. Mol. Genet. 8:907-914.

In some embodiments, certain exons may be more challenging than others to skip. In some embodiments, the present disclosure provides technologies to skip such exons, e.g., through chemical modifications, linkage phosphorus stereochemistry, and combinations thereof. In some embodiments, the present disclosure encompasses the recognition that multiple exon skipping can be useful for skipping such challenging exons. In some embodiments, the present disclosure provides multiple exon skipping technologies for skipping such challenging exons.

In some embodiments, exon skipping, e.g., DMD exon skipping, can be used to treat patients, e.g., DMD patients, with circular or circularized RNA transcripts (e.g., those of DMD). Circular DMD transcripts are reported in, as a non-limiting example: Gualandi et al. 2003 J. Med. Gen. 40: e100.

In some embodiments, a composition capable of mediating multiple exon skipping (MESO) comprises one DMD oligonucleotide capable of mediating skipping of multiple exons. In some embodiments, a composition capable of mediating multiple exon skipping (MESO) comprises two DMD oligonucleotides which are together (e.g., when used in combination) capable of mediating skipping of multiple exons. In some embodiments, a composition capable of mediating multiple exon skipping (MESO) comprises a cocktail of (e.g., a mixture of three or more) DMD oligonucleotides which are together (e.g., when used in combination as a cocktail) capable of mediating skipping of multiple exons. Combinations or cocktails of oligonucleotides capable of mediating skipple of multiple exons have been reported by, for example, Yokota et al. 2009 Arch. Neurol. 66:32; Yokota et al. 2012 Nucl. Acid Ther. 22:306; Adkin et al. 2012 Neur. Dis. 22:297-305; Echigoya et al. 2013 Nucl. Acid. Ther.; and Echigoya et al. 2015 Molecular Therapy—Nucleic Acids 4: e225. Among other things, the present disclosure provides more effective combinations, through, e.g., selected sequences, chemical modifications, and/or linkage phosphorus chemistry, etc.

In some embodiments, the present disclosure provides oligonucleotides that, when combined with other oligonucleotides, can provide dramatically increased activities compared to either oligonucleotides individually prior to combination. For example, in some embodiments, the present disclosure provides DMD oligonucleotides which are individually incapable of mediating efficient skipping of a particular exon; when combined with other oligonucleotides, such oligonucleotides are capable of mediating skipping of multiple exons. Among other things, the present disclosure provides combination therapy, wherein two or more oligonucleotides are used together to provide desired and/or enhanced properties and/or activities. When used in combination therapy, the two or more agents, e.g., oligonucleotides, may be administered concurrently, or separately in suitable ways for them to achieve their combination effects. In some embodiments, two or more oligonucleotides in a combination are all (primarily) for skipping of the same exon, and their combination provides enhanced skipping of such exon, in some embodiments, significantly more than the addition of their separate effects. In some embodiments, two or more oligonucleotide in a combination are for skipping of difference exons, and their combination provides effective skipping, sometimes more than the oligonucleotides individually can achieve, of two or more exons. In some embodiments, the present disclosure provide combinations of oligonucleotides with synergies between two or more different oligonucleotides. In some embodiments, the present disclosure provides combinations of different oligonucleotides wherein one or more, or each oligonucleotide by itself is not effective for exon skipping. Certain combinations are described in Adams et al. 2007 BMC Mol. Biol. 8:57. Among other things, the present disclosure provides more effective combinations, through, e.g., designed control of one or more or all structural elements of oligonucleotides. In some embodiments, a provided combination provides exon skipping of DMD exon 45. In some embodiments, a provided combination provides exon skipping of another DMD exon, including those described herein or otherwise desirable for skipping (e.g., for prevention or treatment of one or more conditions, diseases or disorders etc.) as known in the art.

In some embodiments, cocktails, combinations and mixtures of oligonucleotides, e.g., for multiple exon skipping may have disadvantages compared to single oligonucleotides which can perform the same or comparable functions, such as higher costs of goods, complications in manufacturing and delivery, increased regulatory burden, etc. In accordance with FDA regulations, each component in a combination may need to be separately tested for toxicity, as well as the entire combination. In some embodiments, the present disclosure provides single oligonucleotides that can achieve the same or comparable functions of oligonucleotide combinations, and may be utilized to replace oligonucleotide combinations, through precise and designed control of one or more structural elements of oligonucleotides, e.g., chemical modifications, stereochemistry, and combinations thereof.

Various technologies are suitable for assessing multiple exon skipping in accordance with the present disclosure. Non-limiting examples are described in Example 20 and FIG. 2.

In some embodiments, a composition for skipping multiple DMD exons comprises a DMD oligonucleotide capable of skipping DMD exon 45. Various DMD oligonucleotides were tested for their capability to skip exon 45, as shown in Table 1A. Various DMD oligonucleotides for skipping exon 45 were also tested for their ability to skip multiple exons, as shown in Table 22A. Among other things, the present disclosure demonstrates that several oligonucleotides, including WV-11088 and WV-11089, can provide low levels of skipping of exons 45-55 (creating a junction between exon 44 and exon 56 or 44-56).

In another experiment, oligonucleotides WV-11047, WV-11051 to WV-11059 did not demonstrate significant skipping under the specific tested condition, and oligonucleotides WV-11062 to WV-11069 each exhibited detectable levels of skipping which were <1% under the specific tested condition. Oligonucleotides WV-11091 to WV-11096, WV-11098, and WV-11100 to WV-11105 exhibited <0.5% skipping of exon 45 under the specific tested condition.

TABLE 22A

Example data of certain oligonucleotides.

| | |
|---|---|
| WV-11070 | 1.6 |
| WV-11071 | .3 |
| WV-11072 | .2 |
| WV-11073 | .7 |
| WV-11074 | 2.2 |
| WV-11075 | .2 |
| WV-11076 | 1.2 |
| WV-11077 | 1.3 |
| WV-11078 | 3.3 |
| WV-11079 | 7.5 |
| WV-11080 | 1.3 |
| WV-11081 | 7.2 |
| WV-11082 | 2.8 |
| WV-11083 | 3.1 |
| WV-11084 | 10.1 |
| WV-11085 | 1.5 |
| WV-11086 | 15.8 |
| WV-11087 | 1.1 |
| WV-11088 | 13 |
| WV-11089 | 15.1 |
| WV-11090 | .9 |

Oligonucleotides were tested for their ability to skip DMD exon 45 in Δ48-50 cells.
Numbers indicate skipping level, wherein 100 would represent 100% skipping and 0 would represent 0% skipping.
Several oligonucleotides, including WV-11088 and WV-11089, showed detectable levels of multiple exon skipping (specifically exons 45-55) (approximately 0.1% skipping).

In another experiment, various DMD oligonucleotides targeting exon 45 were tested in Δ48-50 for an ability to skip multiple exons (specifically 45 to 53, creating a junction between exon 44 and exon 54 or 44-54). Oligonucleotides tested were: WV-11047, WV-11051, WV-11052, WV-11053, WV-11054, WV-11055, WV-11056, WV-11057, WV-11058, WV-11059, WV-11062, WV-11063, WV-11064, WV-11065, WV-11066, WV-11067, WV-11068, WV-11069, WV-11070, WV-11071, WV-11072, WV-11073, WV-11074, WV-11075, WV-11076, WV-11077, WV-11078, WV-11079, WV-11080, WV-11081, WV-11082, WV-11083, WV-11084, WV-11085, WV-11086, WV-11087, WV-11088, WV-11089, WV-11090, WV-11091, WV-11092, WV-11093, WV-11094, WV-11095, WV-11096, WV-11098, WV-11100, WV-11101. All these oligonucleotides, in one experiment, demonstrated on average about 0.05% or less skipping of exons 44-54 (data not shown).

Oligonucleotides targeting exon 45 were also tested for skipping of exons 45 to 57, as shown in Table 22A.1.

TABLE 22A.1

Example data of certain oligonucleotides.

| | | | | |
|---|---|---|---|---|
| WV-11047 | 0.064 | 0.118 | 0.048 | 0.099 |
| WV-11051 | 0.044 | 0.101 | 0.034 | 0.079 |
| WV-11052 | 0.076 | 0.089 | 0.078 | 0.090 |
| WV-11053 | 0.082 | 0.076 | 0.078 | 0.072 |
| WV-11054 | 0.126 | 0.083 | 0.110 | 0.100 |
| WV-11055 | 0.037 | 0.071 | 0.048 | 0.073 |
| WV-11056 | 0.133 | 0.102 | 0.116 | 0.092 |
| WV-11057 | 0.000 | 0.001 | 0.000 | 0.097 |
| WV-11058 | 0.102 | 0.030 | 0.071 | 0.042 |
| WV-11059 | 0.171 | 0.100 | 0.157 | 0.075 |
| WV-11062 | 0.070 | 0.112 | 0.081 | 0.088 |
| WV-11063 | 0.088 | 0.078 | 0.051 | 0.081 |
| WV-11064 | 0.085 | 0.071 | 0.071 | 0.075 |
| WV-11065 | 0.073 | 0.114 | 0.077 | 0.143 |
| WV-11066 | 0.083 | 0.100 | 0.004 | 0.143 |
| WV-11067 | 0.115 | 0.069 | 0.094 | 0.068 |
| WV-11068 | 0.112 | 0.071 | 0.125 | 0.053 |
| WV-11069 | 0.075 | 0.075 | 0.083 | 0.053 |
| WV-11070 | 0.062 | 0.107 | 0.067 | 0.101 |
| WV-11071 | 0.085 | 0.116 | 0.073 | 0.118 |
| WV-11072 | 0.080 | 0.097 | 0.052 | 0.084 |
| WV-11073 | 0.052 | 0.148 | 0.047 | 0.118 |
| WV-11074 | 0.155 | 0.098 | 0.116 | 0.101 |
| WV-11075 | 0.145 | 0.079 | 0.126 | 0.113 |
| WV-11076 | 0.000 | 0.105 | 0.000 | 0.111 |
| WV-11077 | 0.050 | 0.087 | 0.080 | 0.058 |
| WV-11078 | 0.087 | 0.095 | 0.077 | 0.103 |
| WV-11079 | 0.076 | 0.063 | 0.079 | 0.062 |
| WV-11080 | 0.059 | 0.058 | 0.052 | 0.070 |
| WV-11081 | 0.077 | 0.086 | 0.058 | 0.055 |
| WV-11082 | 0.117 | 0.071 | 0.112 | 0.080 |
| WV-11083 | 0.077 | 0.108 | 0.091 | 0.091 |
| WV-11084 | 0.080 | 0.102 | 0.053 | 0.069 |
| WV-11085 | 0.047 | 0.143 | 0.041 | 0.140 |
| WV-11086 | 0.085 | 0.087 | 0.084 | 0.074 |
| WV-11087 | 0.114 | 0.034 | 0.000 | 0.056 |
| WV-11088 | 0.134 | 0.112 | 0.057 | 0.063 |
| WV-11089 | 0.074 | 0.113 | 0.109 | 0.082 |
| WV-11090 | 0.119 | 0.076 | 0.074 | 0.081 |
| WV-11091 | 0.000 | 0.055 | 0.031 | 0.054 |
| WV-11092 | 0.039 | 0.057 | 0.068 | 0.058 |
| WV-11093 | 0.147 | 0.061 | 0.138 | 0.061 |
| WV-11094 | 0.108 | 0.078 | 0.061 | 0.080 |
| WV-11095 | 0.062 | 0.061 | 0.056 | 0.072 |
| WV-11096 | 0.104 | 0.071 | 0.072 | 0.101 |
| WV-11098 | 0.072 | 0.095 | 0.081 | 0.065 |
| WV-11100 | 0.068 | 0.079 | 0.078 | 0.068 |
| WV-11101 | 0.000 | 0.058 | 0.000 | 0.048 |

Oligonucleotides were tested in Δ48-50 for their ability to skip DMD exons 45 to 57, creating a junction between exon 44 and exon 58 or 44-58. Numbers indicate skipping level, wherein 100 would represent 100% skipping and 0 would represent 0% skipping. Replicate data in this and other tables are shown.

In some embodiments, a DMD oligonucleotide targets DMD exon 44 or the adjoining intronic region 3' to DMD exon 44 and is capable of mediating multiple exon skipping.

In some embodiments, a DMD oligonucleotide targets DMD exon 44 or the adjoining intronic region 3' to DMD exon 44, and the oligonucleotide is capable of mediating multiple exon skipping (e.g., of exons 45 to 55, or 45 to 57).

Reportedly, a phenomenon known as back-splicing can occur, in which, for example, a portion of the 3' end of exon 55 interacts with a portion of the 5' end of exon 45, forming a circular RNA (circRNA), which can thus skip multiple exons, e.g., all exons from exon 45 to 55, inclusive. The phenomenon can also reportedly occur between exon 57 and exon 45, skipping multiple exons, e.g., all exons from exon 45 to 57, inclusive. Back-splicing is described in the literature, e.g., in Suzuki et al. 2016 Int. J. Mol. Sci. 17.

Without wishing to be bound by any particular theory, the present disclosure suggests that it may be possible for a DMD oligonucleotide targeting DMD exon 44 or the adjoining intronic region 3' to exon 44 may be able to mediate splicing of exons 45 to 55, or of exons 45 to 57, which exons are excised as a single piece of circular RNA (circRNA) designated 45-55 (or 55-45) or 45-57 (or 57-45), respectively.

Several oligonucleotides were designed to target exon 44 or intron 44, or which straddle exon 44 and intron 44. In some embodiments, oligonucleotides designed to target exon 44 or intron 44, or which straddle exon 44 and intron 44 are tested to determine if they can increase the amount of backslicing and/or multiple-exon skipping.

As shown in Table 22A.2 and Table 22A.3, below, DMD oligonucleotides targeting Exon44 were tested for the ability to increase circRNA 55-45 (e.g., mediate multiple exon skipping of exons 45 to 55); or for the ability to increase circRNA 57-45 (e.g., mediate multiple exon skipping of exons 45 to 57). Various DMD oligonucleotides comprise various difference including, inter alia, base sequence and length (18 or 20 bases). Numbers indicate relative amount of circRNA 55-45 (Table 22A.2) or circRNA 57-45 (Table 22A.3). In this and various other tables, Rep indicates Replicate.

TABLE 22A.2

Example data of certain oligonucleotides.

| | | |
|---|---|---|
| WV-13964 | 0.9 | 1 |
| WV-13965 | 1.1 | 1.1 |
| WV-13966 | 1.1 | 0.6 |
| WV-13967 | 1.3 | 1.2 |
| WV-13969 | 1 | 0.8 |
| WV-13971 | 0.3 | 0.9 |
| WV-13972 | 1.1 | 1.3 |
| WV-13973 | 1.1 | 1.3 |
| WV-13976 | 1.2 | 1.2 |
| WV-13979 | 0.5 | 0.5 |
| WV-13980 | 1.3 | 0.4 |
| WV-13981 | 0.9 | 0.7 |
| WV-13982 | 1 | 1 |
| WV-13983 | 0.9 | 0.6 |
| WV-13984 | 1.1 | |
| WV-13985 | 1.3 | 0.8 |
| WV-13987 | 1.2 | 1 |
| WV-13988 | 1.4 | 0.9 |
| WV-13989 | 1.6 | 1 |
| WV-13990 | 1.7 | 1 |
| WV-13991 | 1.4 | 1 |
| WV-13992 | 1.6 | 1 |
| WV-13993 | 1.2 | 1 |

TABLE 22A.2-continued

Example data of certain oligonucleotides.

| | | |
|---|---|---|
| WV-13994 | 1.2 | 0.6 |
| WV-13995 | 1.1 | 0.9 |
| WV-13996 | 1.4 | 1 |
| WV-13997 | 1.2 | 1.3 |
| WV-13998 | 1.2 | 0.8 |
| WV-13999 | 1.2 | 1.3 |
| WV-14000 | 0.9 | 0.9 |
| WV-14001 | 1.1 | 1.5 |
| WV-14002 | 1 | 1.1 |
| WV-14003 | 2 | 2.1 |
| WV-14004 | 1.9 | 1.2 |
| WV-14005 | 1.1 | 1 |
| WV-14006 | 1.2 | 1.4 |
| WV-14007 | 1.3 | 1.7 |
| WV-14008 | 1.4 | 1.1 |
| WV-14009 | 1.3 | 1.3 |
| WV-14010 | 1 | 1.1 |
| WV-14011 | 3.2 | 3.7 |
| WV-14012 | 1.8 | 2 |
| WV-14013 | 1.4 | 1.8 |
| WV-14014 | 1.1 | 1.3 |
| WV-14015 | 1.1 | 1.3 |
| WV-14016 | 1.2 | 1.5 |
| WV-14017 | 1.5 | 1.5 |
| WV-14018 | 0.8 | 1 |
| WV-14019 | 1.2 | 1.4 |
| WV-14020 | 1 | 1 |
| WV-14021 | 1 | 1.3 |
| WV-14022 | 1.3 | 1.5 |
| WV-14023 | 1.3 | 1.7 |
| WV-14024 | 1.2 | 1.2 |
| WV-14025 | 1.5 | 1.6 |
| WV-14026 | 2.4 | 0.6 |
| WV-14027 | 1.2 | 1.2 |
| WV-14028 | 1.1 | 1.2 |
| WV-14029 | 1.2 | 1.4 |
| WV-14030 | 1.3 | 1.6 |
| WV-14031 | 1.3 | 1.6 |
| WV-14032 | 1.2 | 1.5 |
| WV-14033 | 1.3 | |
| WV-14034 | 1.1 | 1.2 |
| WV-14035 | 1.2 | 1.4 |
| WV-14036 | 1.1 | 1.1 |
| WV-14037 | 1.1 | 1.2 |
| WV-14038 | 1.4 | 1.4 |
| WV-14039 | 1.2 | 1.2 |
| WV-14040 | 2.2 | 3 |
| WV-14041 | 2.3 | 2.4 |
| WV-14042 | 1.3 | 1.3 |
| WV-14043 | 1.1 | 1.4 |
| WV-14044 | 1.3 | 1.5 |
| WV-14045 | 1.8 | 2.1 |
| WV-14046 | 1.3 | 1.6 |
| WV-14047 | 1.2 | 1.6 |
| WV-14048 | 3.8 | 4.9 |
| WV-14049 | 2.1 | 2.6 |
| WV-14050 | 1.4 | 1.5 |
| WV-14051 | 1.5 | 1.7 |
| WV-14052 | 1.4 | 2.2 |
| WV-14053 | 1.5 | 1.4 |
| WV-14054 | 1.4 | 1.8 |
| WV-14055 | 1.3 | 1.6 |
| WV-14056 | 1.3 | 1.4 |
| WV-14057 | 1.7 | 2.1 |
| WV-14058 | 1.8 | 1.4 |

TABLE 22A.3

Example data of certain oligonucleotides.

| | Biological Rep1 | Biological Rep2 |
|---|---|---|
| mock | | 0.9 |
| mock | 0.8 | 1 |

TABLE 22A.3-continued

Example data of certain oligonucleotides.

| | Biological Rep1 | Biological Rep2 |
|---|---|---|
| mock | 1 | 1.4 |
| mock | 1 | 0.5 |
| mock | 1.9 | 1.2 |
| mock | 0.7 | 0.7 |
| mock | 0.9 | 0.6 |
| mock | 0.3 | 1.6 |
| WV-13964 | 0.8 | 1 |
| WV-13965 | 0.8 | 0.7 |
| WV-13966 | 1 | 0.7 |
| WV-13967 | 1.2 | 0.9 |
| WV-13969 | 1.2 | 1.3 |
| WV-13971 | | 0.5 |
| WV-13972 | 0.9 | 1.3 |
| WV-13973 | 0.6 | 1.4 |
| WV-13976 | 1.3 | 1.6 |
| WV-13979 | 0.5 | 0.3 |
| WV-13980 | 1.4 | 0.6 |
| WV-13981 | 0.8 | 1.3 |
| WV-13982 | 1.1 | 1 |
| WV-13983 | 1 | 0.8 |
| WV-13984 | 0.8 | 0.4 |
| WV-13985 | 1.3 | 1.6 |
| WV-13987 | 1.4 | 1.1 |
| WV-13988 | 1.4 | 1 |
| WV-13989 | 1.5 | 0.7 |
| WV-13990 | 1.3 | 0.6 |
| WV-13991 | 1.3 | 0.8 |
| WV-13992 | 1.6 | 2.4 |
| WV-13993 | 0.9 | 0.9 |
| WV-13994 | 0.6 | 1 |
| WV-13995 | 0.9 | 1.6 |
| WV-13996 | 1.2 | 0.8 |
| WV-13997 | 1.4 | 0.7 |
| WV-13998 | 1.2 | 0.8 |
| WV-13999 | 0.9 | 0.9 |
| WV-14000 | 0.6 | 0.3 |
| WV-14001 | 0.8 | 0.9 |
| WV-14002 | 0.6 | 1.3 |
| WV-14003 | 2.1 | 2 |
| WV-14004 | 2.1 | 0.7 |
| WV-14005 | 0.9 | 0.8 |
| WV-14006 | 1.3 | 1.1 |
| WV-14007 | 0.9 | 1.6 |
| WV-14008 | 1.3 | 1.1 |
| WV-14009 | 0.9 | 1 |
| WV-14010 | 1 | 0.6 |
| WV-14011 | 3.1 | 4.7 |
| WV-14010 | 1 | 0.6 |
| WV-14011 | 3.1 | 4.7 |
| WV-14012 | 1.3 | 1.7 |
| WV-14013 | 0.9 | 1 |
| WV-14014 | 0.9 | 1.1 |
| WV-14015 | 0.4 | 1.2 |
| WV-14016 | 0.4 | 2.1 |
| WV-14017 | 1.4 | 1.3 |
| WV-14018 | 0.8 | 0.7 |
| WV-14019 | 1.3 | 1.5 |
| WV-14020 | 0.6 | 1.2 |
| WV-14021 | 1.2 | 1.4 |
| WV-14022 | 1.6 | 1.6 |
| WV-14023 | 1.2 | 1.3 |
| WV-14024 | 1.4 | 1.1 |
| WV-14025 | 0.5 | 1.6 |
| WV-14026 | 1.9 | |
| WV-14027 | 1.1 | 0.9 |
| WV-14028 | 0.8 | 1 |
| WV-14029 | 1.1 | 1.3 |
| WV-14030 | 1.2 | 1.4 |
| WV-14031 | 1.2 | 1.5 |
| WV-14032 | 0.9 | 1.7 |
| WV-14033 | 0.9 | |
| WV-14034 | 0.8 | 1.1 |
| WV-14035 | 1.3 | 1.1 |
| WV-14036 | 0.7 | 0.9 |
| WV-14037 | 1.2 | 1 |
| WV-14038 | 1.4 | 1.6 |
| WV-14039 | 1.1 | 0.5 |
| WV-14040 | 2.5 | 4.4 |
| WV-14041 | 2 | 2.8 |
| WV-14042 | 1.4 | 1.2 |
| WV-14043 | 1.4 | 1.4 |
| WV-14044 | 1.7 | 1.2 |
| WV-14045 | 1.7 | 2 |
| WV-14046 | 1.1 | 1.9 |
| WV-14047 | 1.3 | 0 |
| WV-14048 | 3.1 | 7.1 |
| WV-14049 | 1.9 | 2.5 |
| WV-14050 | 1.6 | 1.4 |
| WV-14051 | 1.8 | 1.7 |
| WV-14052 | 0.9 | 2.6 |
| WV-14053 | 1.1 | 1.8 |
| WV-14054 | 1.2 | 2 |
| WV-14055 | 1.2 | 2 |
| WV-14056 | 1.4 | 0.9 |
| WV-14057 | 1.5 | 1.9 |
| WV-14058 | 1.3 | 1 |

In some embodiments, a composition capable of mediating exon skipping of a particular DMD exon comprises two or more oligonucleotides targeting a particular exon. In some embodiments, a combination of two or more oligonucleotides provides skipping levels significantly higher than the addition of the skipping level of each oligonucleotide individually. In some embodiments, a combination of two or more oligonucleotides provides significant (1%, 5%, 10%, or more) and/or detectable levels of skipping while each oligonucleotide individually does not provide detectable levels of skipping. Combinations of traditional oligonucleotides (e.g., stereorandom oligonucleotide and/or oligonucleotides without non-negatively charged internucleotidic linkages described in the present disclosure) has been reported to provide certain improved effects, e.g., in Wilton et al. 2007 Mol. Ther. 7:1288-1296 (exons 10, 20, 34, 65, etc.). Among other things, provided combinations comprise at least one oligonucleotide comprising one or more chirally controlled internucleotidic linkages and/or one or more non-negatively charged internucleotidic linkages, and can provide significantly increased levels of exon skipping.

Among other things, the present disclosure recognizes that certain exons are particularly challenging for skipping. For example, in one report, for exons 47 and 57. individual DMD oligonucleotides were not capable of mediating exon skipping, but pairs of oligonucleotides were capable of mediating exon skipping. In one report, effective skipping of exon 45 was mediated by combining two DMD oligonucleotides which were individually not effective in skipping of this exon. Aartsma-Rus et al. 2006 Mol. Ther. 14:401. Aartsma-Rus et al. 2006 Mol. Ther. 14:401. In some embodiments, the present disclosure provides oligonucleotides (e.g., chirally controlled oligonucleotides), and compositions and methods of use thereof, for exon skipping of such challenging exons. With chemistry modifications and/or stereochemistry technologies described herein, the present disclosure provides technologies with greatly improved exon skipping efficiency. In some embodiments, the present disclosure provides single oligonucleotide (e.g., a chirally controlled oligonucleotide) and compositions thereof (e.g., a chirally controlled oligonucleotide composition) for exon skipping of one or more exons that are challenging to skip. In some embodiments, the present disclosure provides combinations of oligonucleotides (e.g., chirally controlled oligonucleotides) and compositions thereof (e.g., chirally controlled oligonucleotide compositions) for exon skipping of one or more exons that are challenging to skip. In some embodiments, combinations of DMD oligonucleotides targeting the same exon mediate increased exon skipping levels relative to individual DMD oligonucleotides.

In some embodiments, a composition comprises two or more DMD oligonucleotides, wherein each individual DMD oligonucleotide mediates low levels of exon skipping, while the combination mediates a higher level of skipping (higher than the addition of levels achieved by each oligonucleotide individually).

In some embodiments, a composition comprises two or more DMD oligonucleotides, wherein the oligonucleotides target different exons.

In some embodiments, a combination of multiple DMD oligonucleotides targeting different exons is capable of mediating skipping of two or more (e.g., multiple) exons.

In some embodiments, a composition comprises two or more DMD oligonucleotides. In some embodiments, a composition comprises two or more DMD oligonucleotides, at least one of which is described herein or has a base sequence, stereochemistry or other chemical characteristic described herein.

Oligonucleotides Comprising Non-Negatively Charged Internucleotidic Linkages Can Provide Significantly Improved Activities.

In some embodiments, the present disclosure provides oligonucleotides comprising one or more non-negatively charged internucleotidic linkages. In some embodiments, a non-negatively charged internucleotidic linkage is a neutral internucleotidic linkage. In some embodiments, the present disclosure provides oligonucleotides comprising one or more neutral internucleotidic linkages. In some embodiments, a non-negatively charged internucleotidic linkage has the structure of formula I-n-1, I-n-2, I-n-3, I-n-4, II, II-a-1, II-a-2, II-b-1, II-b-2, II-c-1, II-c-2, II-d-1, II-d-2, or a salt form thereof.

In some embodiments, a non-negatively charged internucleotidic linkage comprises a triazole moiety. In some embodiments, a non-negatively charged internucleotidic linkage comprises an optionally substituted triazolyl group. In some embodiments, a non-negatively charged internucleotidic linkage has the structure of

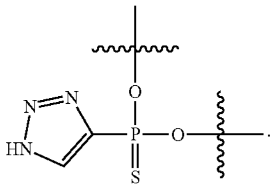

In some embodiments, a non-negatively charged internucleotidic linkage has the structure of

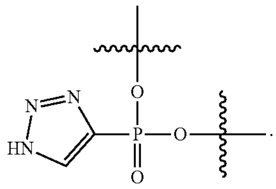

In some embodiments, a non-negatively charged internucleotidic linkage comprises a substituted triazolyl group. In some embodiments, a non-negatively charged internucleotidic linkage has the structure of

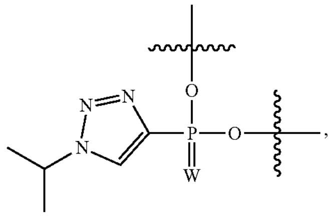

wherein W is O or S. In some embodiments, a non-negatively charged internucleotidic linkage comprises an optionally substituted alkynyl group. In some embodiments, a non-negatively charged internucleotidic linkage has the structure of

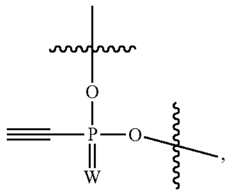

wherein W is O or S.

In some embodiments, the present disclosure provides oligonucleotides comprising an internucleotidic linkage, e.g., a non-negatively charged internucleotidic linkage, which comprises a cyclic guanidine moiety. In some embodiments, an internucleotidic linkage comprises a cyclic guanidine and has the structure of:

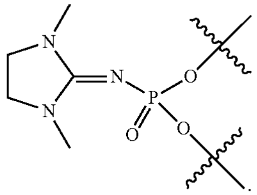

In some embodiments, an internucleotidic linkage, e.g., a non-negatively charged internucleotidic linkage, comprising a cyclic guanidine is stereochemically controlled.

In some embodiments, a non-negatively charged internucleotidic linkage, or a neutral internucleotidic linkage, is or comprising a structure selected from

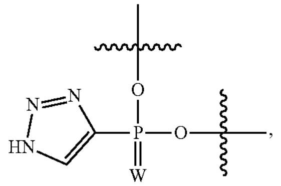

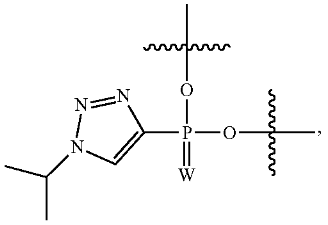

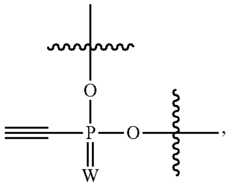

or

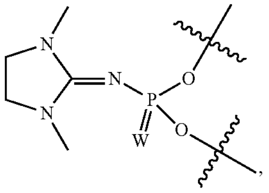

wherein W is O or S. In some embodiments, a non-negatively charged internucleotidic linkage is a chirally controlled internucleotidic linkage. In some embodiments, a neutral internucleotidic linkage is a chirally controlled internucleotidic linkage. In some embodiments, a nucleic acid or an oligonucleotide comprising a modified internucleotidic linkage comprising a cyclic guanidine moiety is a siRNA, double-straned siRNA, single-stranded siRNA, gapmer, skipmer, blockmer, antisense oligonucleotide, antagomir, microRNA, pre-microRNs, antimir, supermir, ribozyme, Ul adaptor, RNA activator, RNAi agent, decoy oligonucleotide, triplex forming oligonucleotide, aptamer or adjuvant.

In some embodiments, an oligonucleotide comprises a neutral internucleotidic linkage and a chirally controlled internucleotidic linkage. In some embodiments, an oligonucleotide comprises a neutral internucleotidic linkage and a chirally controlled internucleotidic linkage which is a phosphorothioate in the Rp or Sp configuration. In some embodiments, the present disclosure provides an oligonucleotide comprising one or more non-negatively charged internucleotidic linkages and one or more phosphorothioate internucleotidic linkage, wherein each phosphorothioate internucleotidic linkage in the oligonucleotide is independently a chirally controlled internucleotidic linkage. In some embodiments, the present disclosure provides an oligonucleotide comprising one or more neutral internucleotidic linkages and one or more phosphorothioate internucleotidic linkage, wherein each phosphorothioate internucleotidic linkage in the oligonucleotide is independently a chirally controlled internucleotidic linkage. In some embodiments, a provided oligonucleotide comprises at least 5, 6, 7, 8, 9, 10, 11, 12, 13, 14, 15, 16, 17, 18, 19, 20 or more chirally controlled phosphorothioate internucleotidic linkages.

Without wishing to be bound by any particular theory, the present disclosure notes that a neutral internucleotidic linkage is more hydrophobic than a phosphorothioate internucleotidic linkage (PS), which is more hydrophobic than a phosphodiester linkage (natural phosphate linkage, PO). Typically, unlike a PS or PO, a neutral internucleotidic linkage bears less charge. Without wishing to be bound by any particular theory, the present disclosure notes that incorporation of one or more neutral internucleotidic linkages into an oligonucleotide may increase oligonucleotides' ability to be taken up by a cell and/or to escape from endosomes. Without wishing to be bound by any particular theory, the present disclosure notes that incorporation of one or more neutral internucleotidic linkages can be utilized to modulate melting temperature between an oligonucleotide and its target nucleic acid.

Without wishing to be bound by any particular theory, the present disclosure notes that incorporation of one or more non-negatively charged internucleotidic linkages, e.g., neutral internucleotidic linkages, into an oligonucleotide may be able to increase the oligonucleotide's ability to mediate a function such as exon skipping or gene knockdown. In some embodiments, an oligonucleotide capable of altering skipping of one or more exons in a target gene comprises one or more neutral internucleotidic linkages. In some embodiments, an oligonucleotide capable of mediating skipping of an exon(s) in a target gene comprises one or more neutral internucleotidic linkages. In some embodiments, an oligonucleotide capable of mediating skipping of one or more DMD exon(s) comprises one or more neutral internucleotidic linkages.

In some embodiments, an oligonucleotide capable of mediating knockdown of level of a nucleic acid or a product encoded thereby comprises one or more non-negatively charged internucleotidic linkages. In some embodiments, an oligonucleotide capable of mediating knockdown of expression of a target gene comprises one or more non-negatively charged internucleotidic linkages. In some embodiments, an oligonucleotide capable of mediating knockdown of expression of a target gene comprises one or more neutral internucleotidic linkages.

In some embodiments, a non-negatively charged internucleotidic linkage is not chirally controlled. In some embodiments, a non-negatively charged internucleotidic linkage is chirally controlled. In some embodiments, a non-negatively charged internucleotidic linkage is chirally controlled and its linkage phosphorus is Rp. In some embodiments, a non-negatively charged internucleotidic linkage is chirally controlled and its linkage phosphorus is Sp.

In some embodiments, a provided oligonucleotide comprises 1, 2, 3, 4, 5, 6, 7, 8, 9, 10, or more non-negatively charged internucleotidic linkages. In some embodiments, a provided oligonucleotide comprises 1, 2, 3, 4, 5, 6, 7, 8, 9, 10, or more neutral internucleotidic linkages. In some embodiments, each of non-negatively charged internucleotidic linkage and/or neutral internucleotidic linkages is optionally and independently chirally controlled. In some embodiments, each non-negatively charged internucleotidic linkage in an oligonucleotide is independently a chirally controlled internucleotidic linkage. In some embodiments, each neutral internucleotidic linkage in an oligonucleotide is independently a chirally controlled internucleotidic linkage. In some embodiments, at least one non-negatively charged internucleotidic linkage/neutral internucleotidic linkage has the structure of

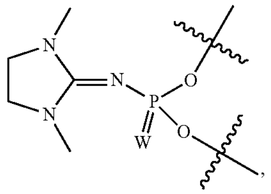

wherein W is O or S. In some embodiments, at least one non-negatively charged internucleotidic linkage/neutral internucleotidic linkage has the structure of

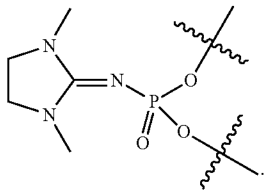

In some embodiments, at least one non-negatively charged internucleotidic linkage/neutral internucleotidic linkage has the structure of

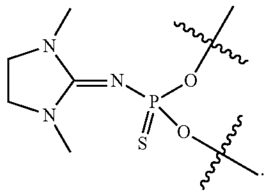

In some embodiments, at least one non-negatively charged internucleotidic linkage/neutral internucleotidic linkage has the structure of

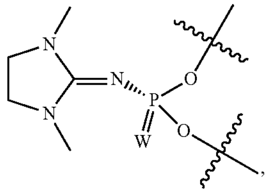

wherein W is O or S. In some embodiments, at least one non-negatively charged internucleotidic linkage/neutral internucleotidic linkage has the structure of

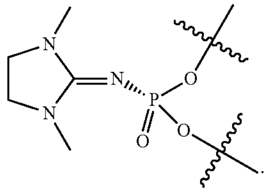

In some embodiments, at least one non-negatively charged internucleotidic linkage/neutral internucleotidic linkage has the structure of

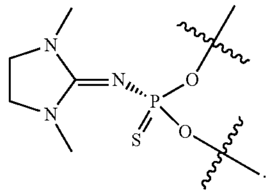

In some embodiments, at least one non-negatively charged internucleotidic linkage/neutral internucleotidic linkage has the structure of

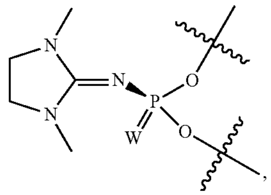

wherein W is O or S. In some embodiments, at least one non-negatively charged internucleotidic linkage/neutral internucleotidic linkage has the structure of

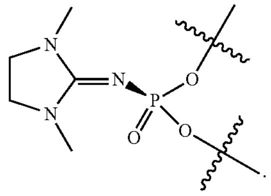

In some embodiments, at least one non-negatively charged internucleotidic linkage/neutral internucleotidic linkage has the structure of

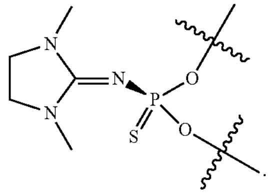

In some embodiments, a provided oligonucleotide comprises at least one non-negatively charged internucleotidic linkage wherein its linkage phosphorus is in Rp configuration, and at least one non-negatively charged internucleotidic linkage wherein its linkage phosphorus is in Sp configuration.

In some embodiments, an oligonucleotide capable of increasing the frequency of skipping of an exon of a target gene comprises a non-negatively charged internucleotidic linkage. In some embodiments, an oligonucleotide capable of increasing the frequency of skipping of an exon of a target gene comprises a non-negatively charged internucleotidic linkage and is useful for treatment of a disease wherein the exon comprises a deleterious or disease-associated mutation. A non-limiting example is the DMD gene, wherein the skipping of an exon comprising a mutation contributes to muscular dystrophy.

Various oligonucleotides, including DMD oligonucleotides, that comprise one or more non-negatively charged internucleotidic linkages/neutral internucleotidic linkages were designed and/or constructed and/or tested, for example, WV-11343, WV-11344, WV-11345, WV-11346, WV-11347, WV-11237, WV-11238, WV-11239, WV-12130, WV-12131, WV-12132, WV-12133, WV-12134, WV-12135, WV-12136, WV-11340, WV-11341, WV-11342, WV-12123, WV-12124, WV-12125, WV-12126, WV-12127, WV-12128, WV-12129, WV-12553, WV-12554, WV-12555, WV-12556, WV-12557, WV-12558, WV-12559, WV-12872, WV-12873, etc. Example DMD oligonucleotides for skipping exon 23 and comprising a non-negatively charged internucleotidic linkage (e.g., a neutral internucleotidic linkage) include: WV-11343, WV-11344, WV-11345, WV-11346, and WV-11347. Example DMD oligonucleotides for skipping exon 51 and comprising a non-negatively charged internucleotidic linkage (e.g., a neutral internucleotidic linkage) include: WV-11237, WV-11238, WV-11239, WV-12130, WV-12131, WV-12132, WV-12133, WV-12134, WV-12135, and WV-12136. Example DMD oligonucleotides for skipping exon 53 and comprising a non-negatively charged internucleotidic linkage (e.g., a neutral internucleotidic linkage) include: WV-11340, WV-11341, WV-11342, WV-12123, WV-12124, WV-12125, WV-12126, WV-12127, WV-12128, WV-12129, WV-12553, WV-12554, WV-12555, WV-12556, WV-12557, WV-12558, WV-12559, WV-12872, and WV-12873. Certain oligonucleotides are in Table A1.

Additional DMD oligonucleotides comprising a non-negatively charged internucleotidic linkage were designed and/or constructed. These include DMD oligonucleotides for skipping DMD exon 45, WV-14528, WV-14529, WV-14532, and WV-14533.

In some embodiments, a non-negatively charged internucleotidic linkage may be designated as n001 if stereorandom, or n001S chirally controlled and linkage phosphorus in the Sp configuration, or n001R if chirally controlled and the linkage phosphorus in the Rp configuration (e.g., in Table A1).

Various DMD oligonucleotides comprising a non-negatively charged internucleotidic linkage in the Rp configuration were constructed, including WV-12872, WV-13408, WV-12554, WV-13409, WV-12555, and WV-12556.

Various DMD oligonucleotides comprising a non-negatively charged internucleotidic linkage in the Sp configuration were constructed, including WV-12557, WV-12558, and WV-12559.

Data showing activity and stability of various oligonucleotides comprising a non-negatively charged internucleotidic linkage in the Rp or Sp configuration are shown in Table 21H Table 21I, Table 21I.1, and Table 21I.2

Several oligonucleotides (including WV-9517, WV-13864, WV-13835, and WV-14791) were tested at various concentrations up to 30 uM for TLR9 activation in HEK-blue-TLR9 cells (16 hour gymnotic uptake). WV-13864 and WV-14791 comprise a chirally controlled non-negatively charged internucleotidic linkage in the Rp configuration. WV-9517, WV-13864, WV-13835, and WV-14791 did not exhibit significant TLR9 activation (data not shown).

Several oligonucleotides which target a gene other than DMD were designed and/or constructed which comprise a non-negatively charged internucleotidic linkage.

Below are presented oligonucleotides comprising a cyclic guanidine moiety which target DMD or Malat-1 (Malat1). The DMD oligonucleotides are designed to mediate skipping of exon 23 (in mouse) or exon 51 or exon 53 (in human). The Malat-1 oligonucleotides are designed to for Malat1 mRNA knockdown, e.g., mediated through RNase H.

TABLE 22B

Example Malat-1 oligonucleotides comprising a neutral backbone.

| Oligonucleotide | Description | Stereochemistry |
|---|---|---|
| WV-11533 | mU * SGeon001m5Ceon001 m5Ceo n001mA * SG * SG * RC * ST * SG * RG * ST * ST * RA * ST * SmG * SmA * SmC * SmU * SmC (SEQ ID NO: 3169) | SnXnXnXSSRSSRSSRSSSSSS |
| WV-12504 | Mod001L00mU * SGeon001 m5Ceon001 m5Ceon001mA * SG * SG * RC * ST * SG * RG * ST * ST * RA * ST * SmG * SmA * SmC * SmU * SmC (SEQ ID NO: 3170) | OSnXnXnXSSRSSRSSRSSSSSS |
| WV-12505 | L001mU * SGeon001m5Ceon001 m5Ceon001mA * SG * SG * RC * ST * SG * RG * ST * ST * RA * ST * SmG * SmA * SmC * SmU * SmC (SEQ ID NO: 3171) | OSnXnXnXSSRSSRSSRSSSSSS |

The efficacy of various DMD oligonucleotides comprising a non-negatively charged internucleotidic linkage in skipping DMD exon 45 is shown in Table 1B.1 and Table 1B.2 herein.

The efficacy of various DMD oligonucleotides comprising a non-negatively charged internucleotidic linkage in skipping DMD exon 53 is shown in Table 21E, Table 21F, Table 21G, and Table 21H herein.

In some embodiments, a non-negatively charged internucleotidic linkage may be designated as nX if stereorandom, or nS chirally controlled and linkage phosphorus in the Sp configuration, or nR if chirally controlled and the linkage phosphorus in the Rp configuration.

In some embodiments, a non-negatively charged internucleotidic linkage may be designated as n001 if stereorandom, or n001S chirally controlled and linkage phosphorus in the Sp configuration, or n001R if chirally controlled and the linkage phosphorus in the Rp configuration (e.g., in Table A1).

All of these oligonucleotides have the base sequence of UGCCAGGCTGGTTATGACUC (SEQ ID NO: 3168).

Oligonucleotides comprising non-negatively charged internucleotidic linkages and targeting other gene targets were also designed, constructed and/or tested for their properties and activities, including activities for reducing levels of target mRNAs and/or proteins, e.g., via RNaseH-mediated knockdown. Such oligonucleotides are active in reducing target levels.

Various Malat1 oligonucleotides were designed, constructed and tested which comprise a non-negatively charged internucleotidic linkage. Various Malat1 oligonucleotides comprise 1, 2 or 3 non-negatively charged internucleotidic linkages in a wing and/or a core.

TABLE 22C

| Oligonucleotide | Sequence | SEQ ID NO: | Stereochemistry |
|---|---|---|---|
| | Malat1 oligonucleotides | | |
| WV-8587 | mU * SGeo m5Ceo m5Ceo mA * SG * SG * RC * ST * SG * RG * ST * ST * RA * ST * S mG * S mA * S mC * S mU * S mC | 3173 | SOOOSSRSSRSSRSSSSS |
| WV-14733 | mU * SGeo m5Ceo m5Ceo mA * SG * SG * SC * ST * SG * SG * ST * ST * SA * ST * S mG * S mA * S mC * S mU * S mC | 3174 | SOOOSSSSSSSSSSSSSS |
| WV-15351 | mU * SGeo m5Ceo m5Ceo mA * SG * SGn001C * ST * SGn001G* ST * STn001A * ST * S mG * S mA * S mC * S mU * S mC | 3175 | SOOOSSIASSnXSSnXSSSSSS |
| WV-15352 | mU * SGeo m5Ceo m5Ceo mA * SG * SGn001C * ST * SG * RG * ST * ST * RA * ST * S mG * S mA * S mC * S mU * S mC | 3176 | SOOOSSnXSSRSSRSSSSS |
| WV-15353 | mU * SGeo m5Ceo m5Ceo mA * SG * SG * RC * ST * SGn001G * ST* ST * RA * ST* S mG* S mA * S mC * S mU * S mC | 3177 | SOOOSSRSSnXSSRSSSSSS |
| WV-15354 | mU * SGeo m5Ceo m5Ceo mA * SG * SG * RC * ST * SG * RG * ST * STn001A * ST * S mG * S mA * S mC * S mU * S mC | 3178 | SOOOSSRSSRSSnXSSSSSS |
| WV-15356 | mU * SGeo m5Ceo m5Ceo mA * SG * SG * RCn001Tn001G * RG * ST * ST * RA * ST * S mG * S mA * S mC * S mU * S mC | 3179 | SOOOSSRnXnXRSSRSSSSS |
| WV-15357 | mU * SGeo m5Ceo m5Ceo mA * SG * SG * RC * ST * SG * RGn001Tn001T * RA * ST * S mG * S mA * S mC * S mU * S mC | 3180 | SOOOSSRSSRnXnXRSSSSSS |
| WV-15358 | mU * SGeo m5Ceo m5Ceo mA * SG * SG * RC * ST * SG * RG * ST * ST * RAn001Tn001 mG * S mA * S mC * S mU * S mC | 3181 | SOOOSSRSSRSSRnXnXSSSS |
| WV-8582 | mU * SGeo m5Ceo m5Ceo mA * SG * SG * SC * ST * SG * SG * ST * ST * RA * ST * S mG * S mA * S mC * S mU * S mC | 3182 | SOOOSSSSSSSRSSSSSS |
| WV-15359 | mU * SGeo m5Ceo m5Ceo mA * SG * SG * SC * ST * SG * SG * ST * STn001An001Tn001 mG * S mA * S mC * S mU * S mC | 3183 | SOOOSSSSSSSnXnXnXSSSS |
| WV-15360 | mU * SGeo m5Ceo m5Ceo mA * SG * SG * SC * ST * SG * SG * ST * STn001A * ST * S mG * S mA * S mC * S mU * S mC | 3184 | SOOOSSSSSSSnXSSSSSS |
| WV-15361 | mU * SGeo m5Ceo m5Ceo mA * SG * SG * SC * ST * SG * SG * ST * ST * RA * STn001 mGn001 mA * S mC * S mU * S mC | 3185 | SOOOSSSSSSSRSnXnXSSS |
| WV-15362 | mU * SGeo m5Ceo m5Ceo mA * SG * SG * SC * ST * SG * SG * ST * ST * RAn001T * S mG * S mA * S mC * S mU * S mC | 3186 | SOOOSSSSSSSRnXSSSSS |
| WV-15363 | mU * SGeo m5Ceo m5Ceo mA * SG * SG * SC * ST * SG* SG * ST * ST * RA * STn001 mG * S mA * S mC * S mU * S mC | 3187 | SOOOSSSSSSSRSnXSSSS |
| WV-14556 | mUn001Geon001 m5Ceon001 m5Ceo mA * SG * SG * RC * ST * SG * RG * ST * ST * RA * ST * S mG * S mA * S mC * S mU * S mC | 3188 | nXnXnXOSSRSSRSSRSSSSS |
| WV-14557 | mUn001Geon001 m5Ceo m5Ceon001 mA * SG * SG * RC * ST * SG * RG * ST * ST * RA * ST * S mG * S mA * S mC * S mU * S mC | 3189 | nXnXOnXSSRSSRSSRSSSSS |
| WV-14558 | mUn001Geon001 m5Ceo m5Ceo mAn001G * SG * RC * ST * SG * RG * ST * ST * RA * ST * S mG * S mA * S mC * S mU * S mC | 3190 | nXnXOOnXSRSSRSSRSSSSS |
| WV-14559 | mUn001Geo m5Ceon001 m5Ceon001 mA * SG * SG * RC * ST * SG * RG * ST * ST * RA * ST * S mG * S mA * S mC * S mU * S mC | 3191 | nXOnXnXSSRSSRSSRSSSSS |
| WV-14560 | mUn001Geo m5Ceon001 m5Ceo mAn001G * SG * RC * ST * SG * RG * ST * ST * RA * ST * S mG * S mA * S mC * S mU * S mC | 3192 | nXOnXOnXSRSSRSSRSSSSS |
| WV-14561 | mUn001Geo m5Ceo m5Ceon001 mAn001G * SG * RC * ST * SG * RG * ST * ST * RA * ST * S mG * S mA * S mC * S mU * S mC | 3193 | nXOnXOnXSRSSRSSRSSSSS |
| WV-11533 | mU * SGeon001 m5Ceon001 m5Ceon001 mA * SG * SG * RC * ST * SG * RG * ST * ST * RA * ST * S mG * S mA * S mC * S mU * S mC | 3194 | SnXnXnXSSRSSRSSRSSSSS |
| WV-14562 | mU * SGeon001 m5Ceon001 m5Ceo mAn001G * SG * RC * ST * SG * RG * ST * ST * RA * ST * S mG * S mA * S mC * S mU * S mC | 3195 | SnXnXOnXSRSSRSSRSSSSS |
| WV-14563 | mU * SGeon001 m5Ceo m5Ceon001 mAn001G * SG * RC * ST * SG * RG * ST * ST * RA * ST * S mG * S mA * S mC * S mU * S mC | 3196 | SnXOnXnXSRSSRSSRSSSSS |
| WV-14564 | mU * SGeo m5Ceon001 m5Ceon001 mAn001G * SG * RC * ST * SG * RG * ST * ST * RA * ST * S mG * S mA * S mC * S mU * S mC | 3197 | SOnXnXnXSRSSRSSRSSSSS |
| WV-14349 | Mod098L001 mU * SGeo m5Ceo m5Ceo mA * SG * SG * RC * ST * SG * RG * ST * ST * RA * ST * S mG * S mA * S mC * S mU * S mC | 3198 | OSOOOSSRSSRSSRSSSSSS |

All of the oligonucleotides in this table have the base sequence of UGCCAGGCTGGTTATGACUC (SEQ ID NO: 3172).

TABLE 22D

| Data of Malat1 oligonucleotides | | | | | | | | | |
|---|---|---|---|---|---|---|---|---|---|
| | 0.004 uM | | | 0.02 uM | | | 0.1 uM | | |
| WV-8587 | 1.23 | 1.21 | 0.94 | 0.95 | 0.84 | 0.81 | 0.54 | 0.53 | 0.61 |
| WV-14733 | 1.81 | 1.06 | 1.36 | 1.47 | 1.12 | 1.17 | 0.98 | 0.97 | 0.72 |
| WV-15351 | 1.27 | 0.92 | 1.00 | 0.89 | 0.95 | 0.92 | 0.74 | 0.66 | 0.71 |
| WV-15352 | 1.49 | 1.78 | 1.52 | 0.88 | 0.83 | 0.91 | 0.50 | 0.52 | 0.73 |
| WV-15353 | 0.85 | 0.91 | 1.10 | 0.65 | 0.59 | 0.68 | 0.44 | 0.42 | 0.40 |
| WV-15354 | 1.31 | 1.00 | 0.90 | 0.69 | 0.94 | 0.79 | 0.56 | 0.87 | 0.74 |
| WV-15356 | 0.77 | 0.87 | 0.68 | 0.49 | 0.67 | 0.63 | 0.30 | 0.35 | 0.31 |
| WV-15357 | 0.91 | 1.02 | 1.13 | 0.66 | 0.75 | 0.79 | 0.37 | 0.32 | 0.36 |
| WV-15358 | 0.80 | 0.82 | 0.90 | 0.83 | 0.85 | 0.85 | 0.36 | 0.45 | 0.43 |
| WV-8582 | 1.11 | 1.06 | 1.15 | 1.30 | 1.15 | 1.14 | 0.67 | 0.85 | 1.06 |
| WV-15359 | 1.16 | 1.26 | 1.02 | 0.92 | 0.83 | 0.83 | 0.85 | | 0.90 |
| WV-15360 | 1.57 | 1.38 | 1.31 | 1.05 | 0.99 | 0.83 | 1.03 | 0.91 | 0.80 |
| WV-15361 | 0.92 | 1.11 | 1.00 | 0.71 | 0.63 | 0.68 | 0.74 | 1.09 | 0.73 |
| WV-15362 | 1.23 | 1.22 | 1.07 | 0.90 | 0.83 | 0.82 | 0.99 | 0.97 | 0.80 |
| WV-15363 | 1.16 | 1.03 | 0.85 | 0.89 | 0.87 | 0.90 | 1.10 | 1.18 | 1.01 |
| WV-14556 | 0.81 | 0.84 | 0.91 | 0.46 | 0.42 | 0.58 | 0.15 | 0.23 | 0.17 |
| WV-14557 | 0.75 | 1.10 | 0.96 | 0.46 | 0.40 | 0.54 | 0.19 | 0.19 | 0.21 |
| WV-14558 | 0.96 | 1.11 | 0.90 | 0.77 | 1.08 | 0.78 | 1.27 | 0.40 | 0.45 |
| WV-14559 | 0.80 | 0.62 | 0.75 | 0.35 | 0.36 | 0.37 | 0.12 | 0.17 | 0.13 |
| WV-14560 | 1.11 | 0.99 | 1.03 | 0.44 | 0.48 | 0.60 | 0.29 | 0.31 | 0.15 |
| WV-14561 | 0.71 | 0.73 | 1.04 | 0.47 | 0.41 | 0.48 | 0.22 | 0.24 | 0.16 |
| WV-11533 | 0.74 | 0.75 | 0.87 | 0.40 | 0.37 | 0.41 | 0.14 | 0.14 | 0.09 |
| WV-14562 | 0.79 | 0.60 | 0.60 | 0.53 | 0.45 | 0.64 | 0.22 | 0.33 | 0.24 |
| WV-14563 | 0.76 | 0.96 | 0.79 | 0.57 | 0.51 | 0.53 | 0.23 | 0.23 | 0.24 |
| WV-14564 | 0.72 | 0.65 | 0.70 | 0.58 | 0.47 | 0.50 | 0.17 | 0.20 | 0.21 |
| WV-9491 | 1.02 | 0.96 | 1.28 | 0.82 | 0.93 | 1.27 | 0.88 | 0.91 | 1.06 |
| WV-14349 | 1.07 | 1.34 | 1.03 | 0.86 | 0.77 | 1.11 | 0.63 | 0.60 | 0.79 |

Numbers represent knockdown of Malat1 mRNA relative to HPRT1, wherein 1.000 would represent no (0.0%) knockdown and 0.000 represents 100.0% knockdown; results from replicate experiments are shown. WV-9491 is a negative control that is not designed to target Malat1.

Various Malat1 oligonucleotides were designed, constructed and tested which comprise one or more non-negatively charged internucleotidic linkages in a core. In various embodiments of a Malat1 oligonucleotide, a phosphorothioate in the Rp configuration is replaced by a non-negatively charged internucleotidic linkage.

TABLE 22E

| Data of Malat1 oligonucleotides | | | | | | |
|---|---|---|---|---|---|---|
| | WV-8587 | WV-15351 | WV-15352 | WV-15353 | WV-15354 | WV-9491 |
| 0.004 uM | 1.23 | 1.27 | 1.49 | 0.85 | 1.31 | 1.02 |
| | 1.21 | 0.92 | 1.78 | 0.91 | 1.00 | 0.96 |
| | 0.94 | 1.00 | 1.52 | 1.10 | 0.90 | 1.28 |
| 0.02 uM | 0.95 | 0.89 | 0.88 | 0.65 | 0.69 | 0.82 |
| | 0.84 | 0.95 | 0.83 | 0.59 | 0.94 | 0.93 |
| | 0.81 | 0.92 | 0.91 | 0.68 | 0.79 | 1.27 |
| 0.1 uM | 0.54 | 0.74 | 0.50 | 0.44 | 0.56 | 0.88 |
| | 0.53 | 0.66 | 0.52 | 0.42 | 0.87 | 0.91 |
| | 0.61 | 0.71 | 0.73 | 0.40 | 0.74 | 1.06 |

Numbers represent knockdown of Malat1 mRNA relative to HPRT1, wherein 1.000 would represent no (0.0%) knockdown and 0.000 represents 100.0% knockdown; results from replicate experiments are shown.

Various Malat1 oligonucleotides were designed, constructed and tested which comprise a non-negatively charged internucleotidic linkage. Various Malat1 oligonucleotides comprise 1 or more non-negatively charged internucleotidic linkages.

TABLE 22F

| Data of certain oligonucleotides. | | | | | |
|---|---|---|---|---|---|
| | WV-8587 | WV-15356 | WV-15357 | WV-15358 | WV-9491 |
| 0.004 uM | 1.23 | 0.77 | 0.91 | 0.80 | 1.02 |
| | 1.21 | 0.87 | 1.02 | 0.82 | 0.96 |
| | 0.94 | 0.68 | 1.13 | 0.90 | 1.28 |
| 0.02 uM | 0.95 | 0.49 | 0.66 | 0.83 | 0.82 |
| | 0.84 | 0.67 | 0.75 | 0.85 | 0.93 |
| | 0.81 | 0.63 | 0.79 | 0.85 | 1.27 |
| 0.1 uM | 0.54 | 0.30 | 0.37 | 0.36 | 0.88 |
| | 0.53 | 0.35 | 0.32 | 0.45 | 0.91 |
| | 0.61 | 0.31 | 0.36 | 0.43 | 1.06 |

Numbers represent knockdown of Malat1 mRNA relative to HPRT1, wherein 1.000 would represent no (0.0%) knockdown and 0.000 represents 100.0% knockdown; results from replicate experiments are shown.

Various Malat1 oligonucleotides were designed, constructed and tested which comprise a non-negatively charged internucleotidic linkage. Various Malat1 oligonucleotides comprise 1 or more non-negatively charged internucleotidic linkages. In various tables and throughout the text herein, the presence or absence of a hyphen in the designation of an oligonucleotide is irrelevant. For example, WV8582 is equivalent to WV-8582.

TABLE 22G

| Data of certain oligonucleotides. | | | | | | | |
|---|---|---|---|---|---|---|---|
| | WV-8582 | WV-15359 | WV-15360 | WV-15361 | WV-15362 | WV-15363 | WV-9491 |
| 0.004 uM | 1.11 | 1.16 | 1.57 | 0.92 | 1.23 | 1.16 | 1.02 |
| | 1.06 | 1.26 | 1.38 | 1.11 | 1.22 | 1.03 | 0.96 |
| | 1.15 | 1.02 | 1.31 | 1.00 | 1.07 | 0.85 | 1.28 |
| 0.02 uM | 1.30 | 0.92 | 1.05 | 0.71 | 0.90 | 0.89 | 0.82 |
| | 1.15 | 0.83 | 0.99 | 0.63 | 0.83 | 0.87 | 0.93 |
| | 1.14 | 0.83 | 0.83 | 0.68 | 0.82 | 0.90 | 1.27 |

TABLE 22G-continued

| Data of certain oligonucleotides. | WV-8582 | WV-15359 | WV-15360 | WV-15361 | WV-15362 | WV-15363 | WV-9491 |
|---|---|---|---|---|---|---|---|
| 0.1 uM | 0.67 | 0.85 | 1.03 | 0.74 | 0.99 | 1.10 | 0.88 |
| | 0.85 | | 0.91 | 1.09 | 0.97 | 1.18 | 0.91 |
| | 1.06 | 0.90 | 0.80 | 0.73 | 0.80 | 1.01 | 1.06 |

Numbers represent knockdown of Malat1 mRNA relative to HPRT1, wherein 1.000 would represent no (0.0%) knockdown and 0.000 represents 100.0% knockdown; results from replicate experiments are shown.

Various Malat1 oligonucleotides were designed, constructed and tested which comprise a non-negatively charged internucleotidic linkage. Various Malat1 oligonucleotides comprise 1 or more non-negatively charged internucleotidic linkages.

TABLE 22H

Data of certain oligonucleotides.

| | 0.004 uM | | | 0.02 uM | | |
|---|---|---|---|---|---|---|
| WV-11533 | 0.74 | 0.75 | 0.87 | 0.40 | 0.37 | 0.41 |
| WV-14556 | 0.81 | 0.84 | 0.91 | 0.46 | 0.42 | 0.58 |
| WV-14557 | 0.75 | 1.10 | 0.96 | 0.46 | 0.40 | 0.54 |
| WV-14558 | 0.96 | 1.11 | 0.90 | 0.77 | 1.08 | 0.78 |
| WV-14559 | 0.80 | 0.62 | 0.75 | 0.35 | 0.36 | 0.37 |
| WV-14560 | 1.11 | 0.99 | 1.03 | 0.44 | 0.48 | 0.60 |
| WV-14561 | 0.71 | 0.73 | 1.04 | 0.47 | 0.41 | 0.48 |
| WV-14562 | 0.79 | 0.60 | 0.60 | 0.53 | 0.45 | 0.64 |
| WV-14563 | 0.76 | 0.96 | 0.79 | 0.57 | 0.51 | 0.53 |
| WV-14564 | 0.72 | 0.65 | 0.70 | 0.58 | 0.47 | 0.50 |
| WV-9491 | 1.02 | 0.96 | 1.28 | 0.82 | 0.93 | 1.27 |

| | 0.1 uM | | |
|---|---|---|---|
| WV-11533 | 0.14 | 0.14 | 0.09 |
| WV-14556 | 0.15 | 0.23 | 0.17 |
| WV-14557 | 0.19 | 0.19 | 0.21 |
| WV-14558 | 1.27 | 0.40 | 0.45 |
| WV-14559 | 0.12 | 0.17 | 0.13 |
| WV-14560 | 0.29 | 0.31 | 0.15 |
| WV-14561 | 0.22 | 0.24 | 0.16 |
| WV-14562 | 0.22 | 0.33 | 0.24 |
| WV-14563 | 0.23 | 0.23 | 0.24 |
| WV-14564 | 0.17 | 0.20 | 0.21 |
| WV-9491 | 0.88 | 0.91 | 1.06 |

Numbers represent knockdown of Malat1 mRNA relative to HPRT1, wherein 1.000 would represent no (0.0%) knockdown and 0.000 represents 100.0% knockdown; results from replicate experiments are shown.

In some embodiments, oligonucleotides were designed, constructed and tested in vitro against suitable reference oligonucleotides which do not comprise any non-negatively charged internucleotidic linkages, e.g., in iCell Astrocytes, at several suitable doses (e.g., 0, 0.014, 0.041, 0.123, 0.37, 1.11, 3.33, 10 uM) gymnotic for a suitable period of time, e.g., 2 days.

Tables 23, 24 and 25 present experimental results.

TABLE 23

Data of certain oligonucleotides.

| Dose (uM) | Oliogonucleotide tested (Relative fold change Malat1/HPRT1) WV-8587 | | | WV-9696 | | |
|---|---|---|---|---|---|---|
| 0 | 0.924 | 0.970 | 1.106 | 1.162 | 1.040 | 0.799 |
| 0.013717 | 0.833 | 0.930 | 0.730 | 0.997 | 0.844 | 0.918 |
| 0.041152 | 1.186 | 0.868 | 0.874 | 1.076 | 0.957 | 0.844 |
| 0.123457 | 0.772 | 0.827 | 0.658 | 0.970 | 0.756 | 0.821 |
| 0.37037 | 0.610 | 0.610 | 0.553 | 0.821 | 0.520 | 0.681 |
| 1.111111 | 0.394 | 0.360 | 0.425 | 0.431 | 0.419 | 0.402 |
| 3.333333 | 0.157 | 0.136 | 0.162 | 0.225 | 0.214 | 0.220 |
| 10 | 0.051 | 0.052 | 0.065 | 0.090 | 0.086 | 0.091 |

| Dose (uM) | Oliogonucleotide tested (Relative fold change Malat1/HPRT1) WV-11114 | | | WV-11533 | | |
|---|---|---|---|---|---|---|
| 0 | 0.761 | 0.881 | 1.212 | 0.958 | 0.985 | 1.056 |
| 0.013717 | 1.048 | 1.027 | 1.187 | 0.900 | 0.932 | 1.020 |
| 0.041152 | 0.912 | 0.958 | 1.108 | 0.453 | 0.503 | 0.479 |
| 0.123457 | 0.971 | 1.063 | 1.238 | 0.356 | 0.387 | 0.332 |
| 0.37037 | 0.706 | 0.846 | 0.692 | 0.105 | 0.107 | 0.096 |
| 1.111111 | 0.429 | 0.486 | 0.574 | 0.048 | 0.051 | 0.049 |
| 3.333333 | 0.181 | 0.196 | 0.203 | 0.033 | 0.032 | 0.030 |
| 10 | 0.080 | 0.075 | 0.087 | 0.026 | 0.034 | 0.031 |

Numbers represent knockdown of Malat1 mRNA, wherein 1.000 would represent no (0.0%) knockdown and 0.000 represents 100.0% knockdown; results from replicate experiments are shown.

TABLE 24

IC50 of certain Malat1 oligonucleotides.

| Oligonucleotide | IC50 |
|---|---|
| WV-8587 | 757 nM |
| WV-9696 | 806 nM |
| WV-11114 | 894 nM |
| WV-11533 | 49 nM |

Among other things, the present disclosure demonstrates that oligonucleotides comprising one or more non-negatively charged internucleotidic linkages can provide dramatically improved activities—as illustrated in Table 24, more than 15-fold improvement can be achieved in terms of IC50.

In another experiment, several Malat1 oligonucleotides including WV-11533, which comprises three neutral internucleotidic linkages, were assessed for knockdown of Malat1, measured by a decrease in the abundance of a Malat1 RNA, WV-7772, which is complementary to the tested oligonucleotides, in the presence of RNaseH.

| Oligo-nucleotide | Description | SEQ ID NO: | Naked Sequence | Linkage/ Stereochemistry |
|---|---|---|---|---|
| WV-11533 | mU * SGeon001m5Ceo n001m5Ceo n001mA * SG * SG * RC * ST * SG * RG * ST * ST * RA * ST * SmG * SmA * SmC * SmU * SmC | 3199 | UGCCAGGCTG GTTATGACUC | SnXnXnXSSRSSRS SRSSSSSS |
| WV-8556 | mU * Geom5Ceom5CeomA * G * G * C * T * G *G * T * T * A * T * mG * mA * mC * mU * mC | 3200 | UGCCAGGCTGG TTATGACUC | XOOOXXXXXX XXXXXXXXX |
| WV-8587 | mU * SGeom5Ceom5CeomA * SG * SG * RC * ST * SG * RG * ST * ST * RA * ST * SmG * SmA * SmC * SmU * SmC | 3201 | UGCCAGGCTGG TTATGACUC | SOOOSSRSSRSS RSSSSSS |
| WV-7772 | rC rU rG rA rG rU rC rA rU rA rA rC rC rA rG rC rC rU rG rG rC rA | 3202 | CUGAGUCAUAAC CAGCCUGGCA | OOOOOOOOOOOO OOOOOOOOO |
| WV -9696 | L001mU * SGeom5Ceom5CeomA * SG * SG * RC * ST * SG * RG * ST * ST * RA * ST * SmG * SmA * SmC * SmU * SmC | 3203 | UGCCAGGCT GGTTATGACUC | OSOOOSSRSSRS SRSSSSSS |
| WV-11114 | Mod091L001mU * SGeom5Ceom5CeomA * SG * SG * RC * sT * SG * RG * ST * ST * RA * ST * SmG * SmA * SmC * SmU * SmC | 3204 | UGCCAGGCT GGTTATGACUC | OSOOOSSRSSRS SRSSSSSS |

At a time point of 45 minutes, less than 20% of the Malat1 RNA remained in the presence of RNase H and WV-11533 or WV-8587, indicating greater than 80% knockdown; and about 60% of the Malat1 RNA remained in the presence of RNase H and WV-8556, which is stereorandom and does not comprise a neutral backbone. Among other things, the present disclosure demonstrates that oligonucleotides comprising non-negatively charged internucleotidic linkages and/or chirally controlled internucleotidic linkages showed significantly improved activities in reducing levels of target nucleic acids, e.g., through RNase H-mediated knockdown.

Certain oligonucleotides were also tested for stability in rat liver homogenate at 0, 1 and 2 days. For both WV-11533 and WV-8587, over 80% of the full-length oligonucleotide remained at 2 days; about 40% of the stereorandom WV-8556 remained.

Oligonucleotides were also tested for Tm with the Malat1 RNA, WV-7772. One example set of test conditions: 1 μM Duplex in 1×PBS (pH 7.2); Temperature Range: 15° C.-90° C.; Temperature Rate: 0.5° C./min; Measurement Interval: 0.5° C. The results showed the following duplex Tm (° C.) with WV-7772: WV-8556, 73.52; WV-8587, 69.57; and WV-11533, 68.67.

In some embodiments, oligonucleotides comprising non-negatively charged internucleotidic linkages provide improved splicing modulation activities. Various oligonucleotides for mediating skipping of an exon in DMD were prepared and/or tested, wherein the oligonucleotides comprise non-negatively charged internucleotidic linkages. Certain oligonucleotides comprising non-negatively charged internucleotidic linkages are listed in Table A1.

TABLE 25 A

Example data of certain oligonucleotides.

| Oligonucleotide | 10 uM | | 3 uM | |
|---|---|---|---|---|
| WV-9898 | 27.13 | 13.38 | 11.27 | 9.69 |
| WV-9897 | 33.61 | 31.46 | 11.82 | 9.52 |
| WV-9517 | 20.21 | 12.08 | 6.72 | 6.89 |
| WV-11342 | 44.84 | 41.17 | 19.22 | 18.43 |
| WV-11341 | 38.85 | 44.85 | 18.95 | 20.63 |
| WV-11340 | 41.51 | 43.08 | 17.79 | 16.4 |
| PMO | 3.89 | 4.05 | 2.08 | 1.52 |
| Mock | 0.49 | 0.53 | 0.45 | 0.52 |

Numbers indicate the level of exon skipping; e.g., 27.13 in column 2, row 2, represents 27.13% skipping of a DMD exon. Oligonucleotides were tested in vitro on cells at 10 or 3 uM.

TABLE 25B

Example data of certain oligonucleotides.

| | Mock | WV-11237 | WV-3152 | WV-3516 | PMO |
|---|---|---|---|---|---|
| 10 um | 1 | 49 | 35 | 7 | 3 |
| 3 uM | 1 | 22 | 16 | 3 | 2 |

Numbers indicate the level of exon skipping relative to control; numbers are approximate.

Oligonucleotides were tested in vitro on cells at 10 or 3 uM. PMO indicates an all-PMO oligonucleotide.

Various DMD oligonucleotides for skipping exon 23 in mouse were constructed, several of which comprise a non-negatively charged internucleotidic linkage, including WV-11343, WV-11344, WV-11345, WV-11346, and WV-11347. These oligonucleotides were tested and demonstrated skipping of exon 23, as shown in the table below.

TABLE 25C.1

Example data of certain oligonucleotides.

| | 10 uM | 3.3 uM |
|---|---|---|
| WV-7684 | 5 | 2 |
| WV-10256 | 25 | 13 |
| WV-11343 | 44 | 33 |
| WV-10257 | 16 | 10 |
| WV-11344 | 42 | 29 |
| WV-10258 | 22 | 20 |
| WV-11345 | 48 | 39 |
| WV-10259 | 24 | 10 |
| WV-11346 | 43 | 32 |
| WV-10260 | 23 | 14 |
| WV-11347 | 43 | 32 |

Numbers represent exon 23 skipping level relative to control.

In some experiments, del45-52 cells (patient derived myoblasts) were treated with various oligonucleotides, including WV-13405 (PMO), WV-9517 and WV-9898, in muscle differentiation medium at 15, 10, 3.3, 1.1, 0.3, 0.1 and 0 uM under free uptake conditions for 6 days before being collected and analyzed for dystrophin protein restoration by Western blot. WV-9517 and WV-9898 demonstrated significant DMD production at concentrations of 3.3 uM and higher; WV-13405 did not show significant DMD product at a concentration of 3.3 uM, but did show DMD production at concentrations of 10 and 15 uM. Control was Vinculin.

As shown in Table 25D, additional oligonucleotides were constructed which were capable of mediating skipping of exon 53 and which comprise at least one neutral internucleotidic linkage.

Various additional DMD oligonucleotides for skipping exon 23 in mouse were constructed. These oligonucleotides were tested and demonstrated skipping of exon 23, as shown in the table below.

TABLE 25C.2

Example data of certain oligonucleotides.

| | WV-11345 | | WV-24092 | | WV-24098 | | Mock | |
|---|---|---|---|---|---|---|---|---|
| 10 uM | 37.8 | 39.8 | 30.2 | 32.4 | 41.5 | 40.2 | 0 | 0 |
| 3.3 uM | 22.4 | 22.9 | 13.4 | 14.5 | 24.3 | 23.5 | 0 | 0 |
| 1.1 uM | 9.2 | 8.1 | 3 | 3.1 | 10.5 | 9.9 | 0 | 0 |

DMD oligonucleotides were tested in vitro for their ability to skip DMD exon 23 in H2K murine cells. Oligonucleotide delivery was gymnotic, and 4 day treatment was used. Numbers represent exon 23 skipping level relative to control. 100.0 would represent 100% of transcripts skipped; 0 would represent 0% of transcripts skipped. Data from replicates are shown.

TABLE 25C.3

Example data of certain oligonucleotides.

| | 10 uM | 3.3 uM | 1.1 uM |
|---|---|---|---|
| WV-10258 | 22.9 | 11.6 | 3.8 |
| WV-12885 | 34.2 | 17.8 | 6.1 |
| | 32.4 | 18.6 | 6.9 |
| WV-23576 | 23.7 | 10.6 | 3.8 |
| | 25.6 | 11.5 | 3.3 |
| WV-23577 | 23.3 | 13.9 | 6.6 |
| WV-23578 | 22 | 11.8 | 4.9 |
| | 16.1 | 13.9 | 7.1 |
| WV-23579 | 19.2 | 8.3 | 6.7 |
| | 20.7 | 29.8 | 5.5 |
| WV-23937 | 18.8 | 9.2 | 3.5 |
| | 6.3 | 4.2 | 1.3 |
| WV-23938 | 26.4 | 16 | 6.9 |
| | 30.3 | 16.7 | 7.3 |
| WV-23939 | 35.2 | 23.3 | 11.8 |
| | 33.6 | 22 | 12.9 |
| Mock | 0 | 0 | 0 |
| | 0 | 0 | 0 |

DMD oligonucleotides were tested in vitro for their ability to skip DMD exon 23 in H2K murine cells. Oligonucleotide delivery was gymnotic, and 4 day treatment was used. Numbers represent exon 23 skipping level relative to control. 100.0 would represent 100% of transcripts skipped; 0 would represent 0% of transcripts skipped. Data from replicates are shown.

TABLE 25C.4

Example data of certain oligonucleotides.

| | WV-10258 | WV-25536 | | WV-25537 | | WV-25539 | | Mock | |
|---|---|---|---|---|---|---|---|---|---|
| 10 uM | 22.9 | 2.3 | 10.7 | 11.8 | 15.1 | 12.5 | 8.1 | 0 | 0 |
| 3.3 uM | 11.6 | 1.5 | 3.6 | 7.3 | 9.9 | 5.6 | 3.8 | 0 | 0 |
| 1.1 uM | 3.8 | 1.1 | 1.3 | 2.7 | 4.2 | 1.8 | 2.3 | 0 | 0 |

DMD oligonucleotides were tested in vitro for their ability to skip DMD exon 23 in H2K murine cells. Oligonucleotide delivery was gymnotic, and 4 day treatment was used. Some of the tested oligonucleotides comprise one or more LNA. Numbers represent exon 23 skipping level relative to control. 100.0 would represent 100% of transcripts skipped; 0 would represent 0% of transcripts skipped. Data from replicates are shown.

TABLE 25C.5

Example data of certain oligonucleotides.

| | 10 uM | 3.3 uM | 1.1 uM |
|---|---|---|---|
| WV- | 22.9 | 11.6 | 3.8 |
| 10258 | | | |
| WV- | 37.8 | 22.4 | 9.2 |
| 11345 | 39.8 | 22.9 | 8.1 |
| WV- | 34.2 | 17.8 | 6.1 |
| 12885 | 32.4 | 18.6 | 6.9 |
| WV- | 23.7 | 10.6 | 3.8 |
| 23576 | 25.6 | 11.5 | 3.3 |
| WV- | 23.3 | 13.9 | 6.6 |
| 23577 | | | |
| WV- | 22 | 11.8 | 4.9 |
| 23578 | 16.1 | 13.9 | 7.1 |
| WV- | 19.2 | 8.3 | 6.7 |
| 23579 | 20.7 | 29.8 | 5.5 |
| WV- | 18.8 | 9.2 | 3.5 |
| 23937 | 6.3 | 4.2 | 1.3 |
| WV- | 26.4 | 16 | 6.9 |
| 23938 | 30.3 | 16.7 | 7.3 |
| WV- | 35.2 | 23.3 | 11.8 |
| 23939 | 33.6 | 22 | 12.9 |
| WV- | 30.2 | 13.4 | 3 |
| 24092 | 32.4 | 14.5 | 3.1 |
| WV- | 41.5 | 24.3 | 10.5 |
| 24098 | 40.2 | 23.5 | 9.9 |
| WV- | 2.3 | 1.5 | 1.1 |
| 25536 | 10.7 | 3.6 | 1.3 |
| WV- | 11.8 | 7.3 | 2.7 |
| 25537 | 15.1 | 9.9 | 4.2 |
| WV- | 12.5 | 5.6 | 1.8 |
| 25539 | 8.1 | 3.8 | 2.3 |
| Mock | 0 | 0 | 0 |
| | 0 | 0 | 0 |

DMD oligonucleotides were tested in vitro for their ability to skip DMD exon 23 in H2K murine cells. Oligonucleotide delivery was gymnotic, and 4 day treatment was used. Some of the tested oligonucleotides comprise one or more non-negatively charged internucleotidic linkage.

Numbers represent exon 23 skipping level relative to control. 100.0 would represent 100% of transcripts skipped; 0 would represent 0% of transcripts skipped. Data from replicates are shown.

TABLE 25C.6

Example data of certain oligonucleotides.

| Conc. | WV-24104 | | WV-24109 | |
|---|---|---|---|---|
| −4.70927 | 0.891 | 0.837 | 0.814 | 1.059 |
| −4.40824 | 0.942 | 1.052 | 0.765 | 1.208 |
| −4.10721 | 0.948 | 1.030 | 0.754 | 1.104 |
| −3.80618 | 0.855 | 1.143 | 0.792 | 1.059 |
| −3.50515 | 1.067 | 1.234 | 0.831 | 0.891 |
| −3.20412 | 0.797 | 0.968 | 0.760 | 1.045 |
| −2.90309 | 0.968 | 0.825 | 0.675 | 1.067 |
| −2.60206 | 0.825 | 1.016 | 0.765 | 1.135 |
| −2.30103 | 1.059 | 0.872 | 0.648 | 0.613 |
| −2 | 0.988 | 1.067 | 0.413 | 0.548 |
| −1.70927 | 0.754 | 0.955 | 0.357 | 0.362 |
| −1.69897 | 0.922 | 0.797 | 0.313 | 0.340 |
| −1.40824 | 0.666 | 0.739 | 0.220 | 0.227 |
| −1.10721 | 0.548 | 0.604 | 0.162 | 0.170 |
| −0.80618 | 0.404 | 0.427 | 0.096 | 0.098 |

TABLE 25C.6-continued

| Example data of certain oligonucleotides. | | | | |
|---|---|---|---|---|
| Conc. | WV-24104 | | WV-24109 | |
| −0.50515 | 0.352 | 0.427 | 0.062 | 0.053 |
| −0.20412 | 0.272 | 0.206 | 0.027 | 0.027 |
| 0.09691 | 0.132 | 0.103 | 0.013 | 0.014 |
| 0.39794 | 0.061 | 0.058 | 0.008 | 0.011 |
| 0.69897 | 0.028 | 0.032 | 0.007 | 0.008 |
| 1 | 0.018 | 0.019 | 0.008 | 0.009 |
| 1.30103 | 0.016 | 0.015 | 0.009 | 0.010 |

Oligonucleotides targeting Malat-1, wherein the oligonucleotides comprise a non-negatively charged internucleotidic linkage, were tested for their ability to knock down Malat-1 in GABA neurons in vitro, with 4 day treatment. Numbers represent Malat-1 level relative to HPRT1 control and water, wherein 1.0 would represent 100% Malat-1 level (0% knockdown) and 0 would represent 0% Malat-1 level (100% knockdown). Concentrations (Conc.) tested are provided as [Log (dose uM)].

Data from replicates are shown.

IC50 of WV-24104 was 132 nM; and IC50 of WV-24109 was 12 nM.

TABLE 25D

| Example data of certain oligonucleotides. | | | | | | | | |
|---|---|---|---|---|---|---|---|---|
| | 10 uM | | | | 3 uM | | | |
| mock | 0.9 | 1.0 | 0.5 | 0.8 | 0.9 | 0.9 | 1.0 | 1.0 |
| WV-9517 | 20.1 | 18.9 | 18.3 | 19.3 | 9.0 | 8.9 | 7.7 | 7.6 |
| WV-11340 | 28.9 | 29.4 | 26.7 | 26.7 | 12.8 | 12.6 | 11.5 | 11.4 |
| WV-11342 | 18.7 | 17.9 | 20.4 | 20.0 | 8.3 | 8.3 | 7.6 | 7.7 |
| WV-12553 | 17.0 | 19.2 | 20.0 | 18.6 | 8.1 | 8.1 | 7.8 | 8.3 |
| WV-12123 | 21.7 | 22.7 | 21.6 | 22.4 | 9.5 | 9.6 | 9.9 | 9.6 |
| WV-12124 | 17.6 | 17.5 | 16.5 | 17.6 | 6.7 | 6.9 | 7.2 | 7.0 |
| WV-12125 | 39.5 | 38.6 | 40.6 | 39.4 | 18.5 | 16.8 | 17.9 | 17.6 |
| WV-12126 | 31.2 | 31.1 | 32.3 | 32.2 | 14.7 | 14.3 | 14.1 | 14.7 |
| WV-12127 | 36.8 | 38.0 | 37.0 | 38.3 | 17.4 | 16.9 | 17.0 | 16.9 |
| WV-12128 | 27.0 | 26.3 | 26.3 | 26.8 | 10.1 | 10.8 | 10.1 | 10.0 |
| WV-12129 | 32.9 | 33.5 | 35.1 | 35.3 | 14.8 | 14.9 | 16.0 | 16.0 |
| Mock | 1.6 | 1.5 | 1.8 | 1.8 | 1.7 | 1.6 | 1.5 | 1.7 |
| WV-9517 | 30.3 | 31.1 | 32.4 | 29.2 | 14.1 | 13.9 | 13.5 | 14.5 |
| WV-11340 | 48.7 | 50.3 | 45.1 | 44.6 | 24.0 | 25.8 | 23.8 | 23.3 |
| WV-12553 | 28.7 | 27.8 | 27.5 | 27.0 | 13.5 | 13.6 | 13.1 | 13.8 |
| WV-9897 | 39.7 | 38.5 | 37.3 | 35.6 | 18.8 | 19.1 | 18.0 | 17.7 |
| WV-11341 | 47.1 | 47.4 | | | 21.8 | 22.5 | 22.5 | 23.1 |
| WV-12555 | 55.7 | 54.7 | 55.7 | 54.6 | 27.1 | 27.7 | 26.0 | 26.0 |
| WV-12558 | 36.0 | 35.8 | 49.9 | 47.3 | 21.2 | 19.8 | 22.1 | 22.1 |
| WV-9898 | 43.6 | 41.7 | 38.0 | 38.8 | 21.1 | 20.6 | | |
| WV-11342 | 43.7 | 44.3 | 42.1 | 41.8 | 22.5 | 20.9 | 19.0 | 20.1 |
| WV-12556 | 46.1 | 46.4 | 45.6 | 44.0 | 24.2 | 23.1 | 21.3 | 21.0 |
| WV-12559 | 47.4 | 45.1 | 45.6 | 47.2 | 21.0 | 21.7 | 24.5 | 22.6 |
| Mock | 1.7 | 1.6 | 1.8 | 1.7 | 1.7 | 1.7 | 1.6 | 1.5 |
| WV-9517 | 29.8 | 29.8 | 28.7 | 29.2 | 15.6 | 15.4 | 16.0 | 16.2 |
| WV-11340 | 45.7 | 44.5 | 46.1 | 47.3 | 25.7 | 24.0 | 23.8 | 24.4 |
| WV-11342 | 44.6 | 46.6 | 45.3 | 44.2 | 21.5 | 21.0 | 19.8 | 20.3 |
| WV-12876 | 42.4 | 43.3 | 41.2 | 41.0 | 26.2 | 26.3 | 24.5 | 26.0 |
| WV-12877 | 53.7 | 53.8 | 52.4 | 52.3 | 37.8 | 36.5 | 34.3 | 32.9 |
| WV-12878 | 48.5 | 48.3 | 45.1 | 46.2 | 31.4 | 30.9 | 29.3 | 30.0 |
| WV-12879 | 34.1 | 34.9 | 33.2 | 34.0 | 19.7 | 19.8 | 21.4 | 21.1 |
| WV-12880 | 50.4 | 50.1 | 51.4 | 52.1 | 33.0 | 32.5 | 32.9 | 32.0 |
| WV-12881 | 41.6 | 42.9 | 38.8 | 39.4 | 26.1 | 25.6 | 24.3 | 22.7 |
| WV-12882 | 29.6 | 29.7 | 32.3 | 31.3 | 15.3 | 15.1 | 15.5 | 15.2 |
| WV-12129 | 57.8 | 57.0 | 55.5 | 55.6 | 33.1 | 32.2 | | |

D45-52 myoblasts were treated for 4 days with 10 and 3 uM oligonucleotide.

Numbers in this and various other tables indicate amount of skipping relative to control.

Various DMD oligonucleotides comprising a chirally controlled neutral backbone were constructed, including WV-12555, which comprises a neutral internucleotidic linkage in the Rp configuration, and WV-12558, which comprises a neutral internucleotidic linkage in the Sp configuration. These were also tested for skipping a DMD exon, as shown in Table 25E.

TABLE 25E

| Example data of certain oligonucleotides. | | | | | | | |
|---|---|---|---|---|---|---|---|
| | MOCK | WV-9517 | WV-11340 | WV-9897 | WV-11341 | WV-12555 | WV-12558 |
| 10 uM | 1.6 | 30.3 | 48.7 | 39.7 | 47.1 | 55.7 | 36.0 |
| | 1.5 | 31.1 | 50.3 | 38.5 | 47.4 | 54.7 | 35.8 |
| | 1.8 | 32.4 | 45.1 | 37.3 | | 55.7 | 49.9 |
| | 1.8 | 29.2 | 44.6 | 35.6 | | 54.6 | 47.3 |
| 3 uM | 1.7 | 14.1 | 24.0 | 18.8 | 21.8 | 27.1 | 21.2 |
| | 1.6 | 13.9 | 25.8 | 19.1 | 22.5 | 27.7 | 19.8 |
| | 1.5 | 13.5 | 23.8 | 18.0 | 22.5 | 26.0 | 22.1 |
| | 1.7 | 14.5 | 23.3 | 17.7 | 23.1 | 26.0 | 22.1 |

D45-52 myoblasts were treated for 4 days with 10 and 3 uM oligonucleotide. Oligonucleotides were delivered gymnotically. Numbers represent amount of skipping relative to control.

In some embodiments, >2 fold increase in exon skipping efficiency was achieved.

TABLE 25F

| Example data of certain oligonucleotides. | | | | |
|---|---|---|---|---|
| | MDX mouse Muscle | Human Liver | Human Muscle | Human Kidney |
| WV-9517 | 82.4 | 77.8 | 84 | 73.7 |
| | 3.08 | 7.9 | 2.01 | 3.59 |
| WV-9897 | 88.3 | 82 | 96.1 | 75.2 |
| | 9.12 | 4.2 | 5.5 | 3.8 |
| WV-9898 | 74 | 75.8 | 96.8 | 81.5 |
| | 5.07 | 6.4 | 8.9 | 5 |
| WV-3473 | 69.8 | 69.8 | ND | 24 |
| | 5.91 | 5.91 | ND | 0.15 |

Various DMD oligonucleotides for skipping exon 53 or 51 were incuted in tissue lysate for 5-days; full length oligonucleotides detected by LC-MS. Numbers represent percentage of full-length oligonucleotide remaining. Greater than 75% oligonucleotide remains in human and MDX muscle lysates at 5d incubation. Data was from a previous experiment performed for WV-3473, with 2d incubation in MDX muscle lysate. ND: Not determined; WV-3473 stability in human muscle lysate was not performed.

In some embodiments, an oligonucleotide comprising a neutral internucleotidic linkage (e.g., a cyclic guanidine type) demonstrated a higher level of exon skipping than a corresponding oligonucleotide which did not comprise such a neutral internucleotidic linkage.

In some embodiments, the present disclosure pertains to an oligonucleotide or an oligonucleotide composition which is capable of mediating single-stranded RNA interference, wherein the oligonucleotide or oligonucleotide composition comprises a non-negatively charged internucleotidic linkage.

As described herein, various oligonucleotides comprising a non-negatively charged internucleotidic linkage and targeting any of several different genes, with different base sequences, patterns of sugar modifications, backbone chemistry, and patterns of stereochemistry of backbone internucleotidic linkages were constructed, including but not limited to various oligonucleotides which target C9orf72 (a different gene than DMD, or Malat1).

Described herein are various non-limiting examples of oligonucleotides which target C9orf72 (which is a gene different from the other genes mentioned herein) and which comprise a non-negatively charged internucleotidic linkage.

A hexanucleotide repeat expansion in the C9orf72 gene (Chromosome 9, open reading frame 72) is reportedly the most frequent genetic cause of amyotrophic lateral sclerosis (ALs) and frontotemporal dementia (FTD). C9orf72 gene variants comprising the repeat expansion and/or products thereof are also associated with other C9orf72-related disorders, such as corticobasal degeneration syndrome (CBD), atypical Parkinsonian syndrome, olivopontocerebellar degeneration (OPCD), primary lateral sclerosis (PLs), progressive muscular atrophy (PMA), Huntington's disease (HD) phenocopy, Alzheimer's disease (AD), bipolar disorder, schizophrenia, and other non-motor disorders. Various oligonucleotides were designed and constructed which comprise a neutral internucleotidic linkage and which target a C9orf72 target (e.g., a C9orf72 oligonucleotide) and are capable of knocking down or decreasing expression, level and/or activity of the C9orf72 target gene and/or a gene product thereof (a transcript, particularly a repeat expansion containing transcript, a protein, etc.).

Various oligonucleotides designed to target C9orf72 and comprising a non-negatively charged internucleotidic linkage include, but are not limited to: WV-11532, WV-13305, WV-13307, WV-13309, WV-13311, WV-13312, WV-13313, WV-13803, WV-13804, WV-13805, WV-13806, WV-13807, WV-13808, WV-14553, and WV-14555. These are described below in Table 25G.

TABLE 25G

Oligonucleotides targeting C9orf72 comprising a neutrai intemucleotidic linkage.

| Oligo-nucleo-tide | Sequence | SEQ ID NO: | Naked Sequence | Stereochemistry |
|---|---|---|---|---|
| WV-11532 | mC * Sm5Ceon001 Teon001 m5Ceon001 mA * SC * ST * SC * RA * SC * SC * RC * SA * Se * ST * SmC * SmG * SmC * SmC * SmA | 3205 | CCTCACTCACCC ACTCGCCA | SnXnXnXSSSRSSR SSSSSSSS |
| WV-13305 | m5Ceo * Rm5Ceon001 Teon001 m5Ceon001 Aeo * RC * ST * sC * RA * SC * SC * RC * SA * SC * ST * SmC* SmG * SmC * SmC * SmA | 3206 | CCTCACTCACCC ACTCGCCA | RnXnXnXRSSRSSR SSSSSSSS |
| WV_13307 | m5Ceo * Sm5Ceon001 Teon001 m5Ceon001 Aeo * RC * ST * SC * RA * SC * SC * RC * SA * Sc * ST * SmC * SmG * SmC * SmC * SmA | 3207 | CCTCACTCACCC ACTCGCCA | SnXnXnXRSSRSSR SSSSSSSS |
| WV_13309 | m5Ceo * Rm5Ceon001 Teon001 m5Ceon001 Aeo * RC * ST * SC * RA * SC * Sc * SC * RA * SC * ST * SmC * SmG * SmC * SmC * SmA | 3208 | CCTCACTCACCC ACTCGCCA | RnXnXnXRSSRSSS RSSSSSSS |
| WV-13311 | m5Ceo * Sm5Ceon001 Teon001 m5Ceon001 Aeo * RC * ST * SC * RA * SC * SC * SC * RA * SC * ST * SmC * SmG * SmC * SmC * SmA | 3209 | CCTCACTCACCC ACTCGCCA | SnXnXnX.RSSRSSS RSSSSSSS |
| WV-13312 | mC * Sm5Ceon001 Teon001 m5Ceon001 mA * SC * ST * SC * RA * SC * SC * SC * SA * SC * ST * SmC * SmG * SmC * SmC * SmA | 3210 | CCTCACTCACCC ACTCGCCA | SnXnXnXSSSR SSSSSSSSSSS |
| WV-13313 | m5Ceo * Rm5Ceon001 Teon001 m5Ceon001 Aeo * RC * ST * SC * RA * Sc * SC * SC * SA * SC * ST * SmC * SmG | 3211 | CCTCACTCACCC ACTCGCCA * SmC * SmC * | RnXnXnXRSSR SSSSSSSSSSS SmA |
| WV-13803 | Teo * Geon001 m5Ceon001 m5Ceon001 Geo*C*C*T*C*C*I*C*A* T * mC * mA * mC * mC * mC | 3212 | TGCCGCCTCCT CACTCACCC | XnXnXnXXXXXXX XXXXXXXXX |
| WV-13804 | Teo * Geom5Ccom 5CcoGeo * C * C * T * C * C * T * C * A * C * T *mCn001 mAn001 mCn001 mC * mC | 3213 | TGCCGCCTCCT CACTCACCC | XOOOXXXXXXXXX XXnXnXnXX |
| WV-13805 | Teo * Geon001 m5Ceon001 m5Ceon001 Geo * C * C * T * C * C * T * C * A * C * T * mCn001 mAn001 mCn001 mC * mC | 3214 | TGCCGCCTCCT CACTCACCC | XnXnXnXXXXXXXX XXXXnXnXnXX |
| WV-13806 | Geo * m5Ceon001 Geon001 m5Ceon001 Geo * A * C * T * C * C * T * G* A * G * T * Teom5Ceom5CeoAeo * Geo | 3215 | GCGCGACTCCT GAGTTCCAG | XnXnXnXXXXXXXX XXXXOOOX |
| WV-13807 | Geo * m5CeoGeom5CeoGeo * A * C * T * C * C * T * G * A * G * T * Teon001 m5Ceon001 m5Ceon001 Aeo * Geo | 3216 | GCGCGACTCCT GAGTTCCAG | XOOOXXXXXXXXXX XnXnXnXX |
| WV-13808 | Geo * m5Ceon001 Geon001 m5Ceon001 Geo * A * C * T * C * C * T * G * A * G * T * Teon001 m5Ceon001 m5Ceon001 Aeo * Geo | 3217 | GCGCGACTCCT GAGTTCCAG | XnXnXnXXXXXXXXX XXXnXnXnXX |
| WV-14553 | m5Ceo* Rm5Ceon001 Teon001 m5Ceon001 Aeo * RC * ST * SC * RA * SC * SC * RC * SA * SC* ST * Rm5Ceo * SmG * SmC * SmC * SmA | 3218 | CCTCACTCACCC ACTCGCCA | RnXnXnXRSSRSSR SSSRSSSS |
| WV-14555 | m5Ceo* Rm5Ceon001 Teon001 m5Ceon001 Aeo * RC * ST * SC * RA * | 3219 | CCTCACTCACCC ACTCGCCA | RnXnXnXRSSRSSS RSSRSSSS |

TABLE 25G-continued

| Oligonucleotides targeting C9orf72 comprising a neutrai intemucleotidic linkage. | | | |
|---|---|---|---|
| Oligo-nucleo-tide | Sequence | SEQ ID NO: | Naked Sequence Stereochemistry |
| | SC * SC * SC * RA * SC * ST * Rm5Ceo * SmG * SmC * SmC * SmA | | |

Several variants of a C9orf72 mRNA are produced from the C9orf72 gene: V2 (which does not comprise the deleterious hexanucleotide repeat and which comprises about 90% of all transcripts); V3 (which comprises the hexanucleotide repeat and comprises about 9% of all transcripts); and V1 (which comprises the hexanucleotide repeat and comprises about 1% of all transcripts).

Hexanucleotide repeats reportedly elicit gain of function toxicities, at least partially mediated by the dipeptide repeat proteins and foci formation by, for example, repeat-expansion containing transcripts and/or spliced-out repeat-expansion containing introns and/or antisense transcription of the repeat-expansion containing region and various nucleic-acid binding proteins.

Both WV-8008 and WV-11532 have the same base sequence (or naked sequence), CCTCACTCACCCACTCGCCA (SEQ ID NO: 3220). They differ, inter alia, in that the latter comprises 3 contiguous neutral internucleotidic linkages (Xn), but the former does not comprise any neutral internucleotic linkages. The structures of these oligonucleotides is provided below, in Table 25H.

TABLE 25I

| Activity of various c9orf72 oligonucleotides (residual level of all V C9orf72 transcripts) | | | | | | |
|---|---|---|---|---|---|---|
| Conc. | WV-8008 | | | WV-11532 | | |
| −2.495 | 0.999 | 0.958 | 0.913 | 1.006 | 0.894 | 0.900 |
| −1.796 | 0.965 | 0.864 | 0.882 | 0.972 | 0.829 | 0.858 |
| −1.097 | 1.006 | 0.900 | 0.932 | 0.907 | 0.888 | 0.858 |
| −0.398 | 0.800 | 0.742 | 0.806 | 0.795 | 0.747 | 0.742 |
| 0.301 | 0.624 | 0.611 | 0.687 | 0.562 | 0.554 | 0.554 |
| 1 | 0.524 | 0.500 | 0.521 | 0.409 | 0.411 | 0.387 |

TABLE 25J

| Activity of various c9orf72 oligonucleotides (residual level of V3 C9orf72 transcripts) | | | | | | |
|---|---|---|---|---|---|---|
| Conc. | WV-8008 | | | WV-11532 | | |
| −2.495 | 0.947 | 0.871 | 1.014 | 0.927 | 0.853 | 0.908 |

TABLE 25H

| C9orf72 oligonucleotides. | | |
|---|---|---|
| Oligo-nucleotide | Sequence | Stereochemistry |
| WV-8008 | m5Ceo * Rm5CeoTeom5CeoAeo * RC * ST * SC * RA * SC * RC * SA * SC * ST * SmC * SmG * SmC * SmC * SmA (SEQ ID NO: 3221) | SCROOORSSRSSRSSSSSSS |
| WV-11532 | mC * Sm5Ceon001Teon001m5Ceon001mA * SC * ST * SC * RA * SC * SC * RC * SA * SC * ST * SmC * SmG * SmC * SmC * SmA (SEQ ID NO: 3222) | SnXnXnXSSSRSS RSSSSSSSS |

WV-8008 and WV-11532 were tested for their ability to knock down expression of hexanucleotide-comprising (i.e., disease-associated) transcript V3 compared to total transcripts (all V), as shown below in Table 25I.

Table 25I and J. Activity of various c9orf72 oligonucleotides.

In Tables 25I to 25J, various c9orf72 oligonucleotides were tested in motor neurons, with oligonucleotides delivered gymnotically at concentrations from 0.003 to 10 μM (Concentrations are provided as exp10). Tested c9orf72 oligonucleotide WV-11532 comprises three neutral internucleotidic linkages. In Tables 14A and 14B, shown are residual levels of c9orf72 transcriptions [e.g., all transcripts (all V) or only V3] relative to HPRT1, after treatment with c9orf72 oligonucleotides, wherein 1.000 would represent 100% relative transcript level (no knockdown) and 0.000 would represent 0% relative transcript level (e.g., 100% knockdown). Results from replicate experiments are shown.

TABLE 25J-continued

| Activity of various c9orf72 oligonucleotides (residual level of V3 C9orf72 transcripts) | | | | | | |
|---|---|---|---|---|---|---|
| Conc. | WV-8008 | | | WV-11532 | | |
| −1.796 | 0.877 | 0.841 | 0.908 | 0.836 | 0.769 | 0.841 |
| −1.097 | 0.665 | 0.743 | 0.871 | 0.620 | 0.633 | 0.717 |
| −0.398 | 0.555 | 0.427 | 0.707 | 0.421 | 0.415 | 0.427 |
| 0.301 | 0.210 | 0.178 | 0.304 | 0.096 | 0.105 | 0.094 |
| 1 | 0.056 | 0.071 | 0.083 | 0.012 | 0.015 | 0.015 |

As described herein and in data not shown, various oligonucleotides comprising a non-negatively charged internucleotidic linkage and targeting different genes, with different base sequences, patterns of sugar modifications, backbone chemistries, and patterns of stereochemistry of backbone internucleotidic linkages were constructed, including but not limited to various oligonucleotides which target DMD, Malat1, or C9orf72.

Oligonucleotides comprising a non-negatively charged internucleotidic linkage were also constructed to target six other genes not described herein (wherein the six genes were not DMD, Malat1, or C9orf72); these oligonucleotides include oligonucleotides designed to target these genes and reduce the expression, level and/or activity of the gene or its gene product. These and various oligonucleotides comprising a neutral internucleotidic linkage described herein are capable of performing various functions, including reducing the level, expression and/or activity of a gene or its gene product (e.g., via a RNaseH- or steric-hindrance-mediated mechanism, or via a single-stranded RNA interference-mediated mechanism) and inducing skipping of an exon (e.g., skipping modulation).

Without wishing to be bound by any particular theory, Applicant notes that a non-negatively charged and/or neutral internucleotidic linkage can improve an oligonucleotide's entry into a cell and/or escape from an endosome.

Oligonucleotides which Comprise a Non-Negatively Charged Internucleotidic Linkage can Provide Desired Levels of TLR9 Activation Among other things, oligonucleotides comprising non-negatively charged internucleotidic linkages can provide desired levels of properties and/or activities, e.g., TLR9 antagonist or agonist activities. In some embodiments, oligonucleotides comprising non-negatively charged internucleotidic linkages demonstrate lower levels of TLR9 activation in human and/or an animal model (e.g., a mouse) compared to certain comparable oligonucleotides of the same base sequences but having no non-negatively charged internucleotidic linkages. In some embodiments, oligonucleotides comprising non-negatively charged internucleotidic linkages have lower toxicity compared to certain oligonucleotides of the same base sequences but having no non-negatively charged internucleotidic linkages. In some embodiments, a non-negatively charged internucleotidic linkage is within a CpG motif and is the internucleotidic linkage between the C and G.

In an experiment, several oligonucleotides to target gene C were constructed. Gene C is a different gene than DMD, or SMalat-1. The sequence of these oligonucleotides comprises a CpG, a motif known to activate TLR9. Table 25K.

This experiment represents a test of induction of human TLR9 or mouse TLR9 in HEK293 cells. Numbers represent relative inductive relative to negative control, water. Concentrations tested: 0.93 uM, 2.77 uM, 8.33 uM, 25 uM, 75 uM. Positive control: WV-BZ21. The experiment was performed in biological duplicates.

TABLE 25K

Oligonucleotides used in this study

| Oligo-nucleotide | Sequence | SEQ ID NO: | Stereochemistry |
|---|---|---|---|
| WV-HZ12 | mN * Sm5NeoNeom5NeomN * SN * SN * SN * RN * SN * SN * RN * SN * SN * SN * SmC * SmG * SmN * SmN * SmN | 3223 | SOOOS SSRSS RSSSSSSSS |
| WV-BZ761 | mN * Sm5NeoNeom5NeomN * SN * SN * SN * RN * SN * SN * RN * SN * SN * SN * SmCmG * SmN * SmN * SmN | 3224 | SOOOS SSRSS RSSSSOSSS |
| WV-BZ762 | mN * Sm5NeoNeom5NeomN * SN * SN * SN * RN * SN * SN * RN * SN * SN * SN * Sm5CeomG * SmN * SmN * SmN | 3225 | SOOOS SSRSS RSSSSOSSS |
| WV-BZ763 | mN * Sm5NeoNeom5NeomN * SN * SN * SN * RN * SN * SN * RN * SN * SN * SN * Sm5Ceo * SmG * SmN * SmN * SmN | 3226 | SOOOS SSRSS RSSSSSSSS |
| WV-BZ764 | mN * Sm5NeoNeom5NeomN * SN * SN * SN * RN * SN * SN * RN * SN * SN * SN * Rm5CeomG * SmN * SmN * SmN | 3227 | SOOOS SSRSS RSSSROSSS |
| WV-BZ765 | mN * Sm5NeoNeom5NeomN * SN * SN * SN * RN * SN * SN * RN * SN * SN * SN * Rm5Ceo * SmG * SmN * SmN * SmN | 3228 | SOOOS SSRSS RSSSRSSSS |
| WV-BZ766 | mN * Sm5NeoNeom5NeomN * SN * SN * SN * RN * SN * SN * RN * SN * SN * SN * Sm5mC * StnG * SmN * SmN * SmN | 3229 | SOOOS SSRSS RSSSSSSSS |
| WV-BA207 | mN * Sm5NeoNeom5NeomN * SN * SN * SN * RN * SN * SN * SN * RN * SN * SN * SmCn001mG * SmN * SmN * SmN | 3230 | SOOOS SSRSS SRSSSnXSSS |
| WV-BA208 | m5Neo * Rm5NeoNeom5NeoNeo * RN * SN * SN * RN * SN * SN * RN * SN * SN * SN * SmCn001mG * SmN * SmN * SmN | 3231 | ROOOR SSRSS RSSSSnXSSS |
| WV-BA209 | m5Neo * Rm5NeoNeom5NeoNeo * RN * SN * SN * RN * SN * SN * SN * RN * SN * SN * SmCn001mG * SmN * SmN * SmN | 3232 | ROOOR SSRSS SRSSSnXSSS |
| WV-BZ21 | T * C * G * T * C * G * T * T * T * T * G * T * C * G * T * T * T * T * G * T * C * G * T * T | 3233 | XXXXX XXXXX XXXXX XXXXX XXX |

TABLE 25L

Activity of certain oligonucleotides.

| | 0.93 uM | 2.77 uM | 8.33 uM | 25 uM | 75 uM |
|---|---|---|---|---|---|
| WV-HZ12 | 1.0 | 1.0 | 1.0 | 1.0 | 0.9 |
| | 1.1 | 1.0 | 1.1 | 1.0 | 1.0 |
| WV-BZ761 | 1.0 | 1.0 | 1.0 | 1.0 | 1.0 |
| | 1.1 | 1.0 | 1.1 | 1.0 | 0.9 |
| WV-BZ762 | 1.0 | 1.0 | 1.0 | 1.1 | 1.0 |
| | 1.0 | 1.1 | 1.0 | 1.0 | 1.0 |
| WV-BZ763 | 1.0 | 1.0 | 1.1 | 1.1 | 1.1 |
| | 1.1 | 1.1 | 1.1 | 1.1 | 1.0 |
| WV-BZ764 | 1.0 | 1.0 | 1.0 | 0.9 | 1.0 |
| | 1.0 | 1.0 | 1.0 | 1.0 | 1.0 |
| WV-BZ765 | 1.0 | 0.9 | 1.1 | 1.0 | 1.0 |
| | 1.0 | 1.1 | 1.0 | 0.9 | 0.9 |
| WV-BZ766 | 1.1 | 1.3 | 1.5 | 1.5 | 1.5 |
| | 1.2 | 1.3 | 1.3 | 1.4 | 1.4 |
| WV-BA207 | 1.0 | 1.0 | 1.0 | 1.0 | 1.0 |
| | 1.1 | 1.1 | 1.0 | 1.0 | 1.0 |
| WV-BA208 | 1.0 | 1.0 | 1.0 | 1.0 | 1.0 |
| | 1.0 | 1.1 | 1.0 | 0.9 | 1.0 |
| WV-BA209 | 1.0 | 1.0 | 1.0 | 0.9 | 1.0 |
| | 1.1 | 1.0 | 0.9 | 1.0 | 1.0 |
| WV-BZ21 | 10.0 | 12.0 | 12.0 | 11.4 | 11.0 |
| (positive control) | 9.4 | 10.4 | 11.4 | 11.5 | 11.1 |

All the tested oligonucleotides (WV-HZ12, WV-BZ761, WV-BZ762, WV-BZ763, WV-BZ764, WV-BZ765, WV-BZ766, WV-BA207, WV-BA208, and WV-BA209) target gene C and all have the same base sequence, wherein each base is indicated generically by N, except that the single CpG motif is indicated. WV-BZ21, positive control, has a base sequence of TCGTCGTTTTGTCGTTTTGTCGTT (SEQ ID NO: 3234), which comprises several CpG motifs, and is not designed to target gene C. Numbers indicate relative induction of hTLR9 activity relative to water.

TABLE 25M

Activity of certain oligonucleotides.

| | 0.93 uM | 2.77 uM | 8.33 uM | 25 uM | 75 uM |
|---|---|---|---|---|---|
| WV-HZ12 | 2.9 | 4.4 | 4.7 | 5.0 | 4.9 |
| | 3.0 | 4.1 | 4.8 | 5.1 | 5.2 |
| WV-BZ761 | 1.2 | 1.5 | 1.8 | 2.1 | 2.1 |
| | 1.2 | 1.4 | 1.8 | 2.1 | 2.2 |
| WV-BZ762 | 1.0 | 1.0 | 1.0 | 1.0 | 1.0 |
| | 1.0 | 1.1 | 1.1 | 0.9 | 1.0 |
| WV-BZ763 | 1.0 | 1.1 | 1.1 | 1.1 | 1.0 |
| | 1.1 | 1.0 | 1.1 | 1.1 | 1.1 |
| WV-BZ764 | 1.0 | 1.1 | 1.1 | 1.1 | 1.1 |
| | 1.0 | 1.1 | 1.1 | 1.1 | 1.1 |
| WV-BZ765 | 1.0 | 1.2 | 1.3 | 1.3 | 1.2 |
| | 1.1 | 1.2 | 1.3 | 1.3 | 1.3 |
| WV-BZ766 | 1.1 | 1.3 | 1.4 | 1.6 | 1.6 |
| | 1.1 | 1.2 | 1.4 | 1.6 | 1.6 |
| WV-BA207 | 1.1 | 1.1 | 1.1 | 1.1 | 1.1 |
| | 1.0 | 1.0 | 1.1 | 1.1 | 1.2 |
| WV-BA208 | 1.0 | 1.1 | 1.1 | 1.2 | 1.1 |
| | 1.0 | 1.0 | 1.1 | 1.2 | 1.2 |
| WV-BA209 | 1.0 | 1.2 | 1.1 | 1.2 | 1.1 |
| | 1.0 | 1.1 | 1.2 | 1.2 | 1.3 |
| WV-BZ21 | 21.4 | 22.4 | 22.9 | 21.2 | 18.1 |
| (positive control) | 22.9 | 24.0 | 23.8 | 22.3 | 18.9 |

These oligonucleotides were also tested for induction of mouse TLR9.

Numbers indicate relative induction of mTLR9 activity relative to water.

In some embodiments, it was observed that in some instances certain oligonucleotides that did not induce appreciable TLR9 activation, or induced very low level of TLR9 activation above mock against human or mouse TLR9.

Example Oligonucleotides Comprising Additional Moieties

In some embodiments, the present disclosure provides oligonucleotides comprising one or more additional moieties, e.g., targeting moieties, carbohydrate moieties, etc. In some embodiments, the present disclosure provides oligonucleotides comprising one or more sulfonamide moieties. In some embodiments, a provided oligonucleotide comprise one or two or more sulfonamide moieties. In some embodiments, the present disclosure provides oligonucleotides that can modulate splicing, e.g., DMD oligonucleotides that can modulate exon skipping, wherein the oligonucleotides comprise one or more sulfonamide moieties. In some embodiments, the present disclosure provides oligonucleotides that mediate skipping of DMD exon 23, 45, 51 or 53, or multiple DMD exons, wherein the oligonucleotides comprise one or more sulfonamide moieties.

In some embodiments, a sulfonamide moiety has or comprises the structure of $-L-SO_2N(R^1)_2$. In some embodiments, a sulfonamide moiety has or comprises the structure of $—SO_2N(R^1)_2$. In some embodiments, a sulfonamide moiety has or comprises the structure of $—Cy—SO_2N(R^1)_2$. In some embodiments, —Cy— is aromatic. In some embodiments, —Cy— is an optionally substituted phenyl ring. In some embodiments, —Cy— is

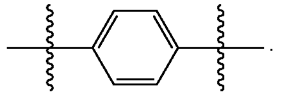 [SMILES: *c1ccc(*)cc1]

In some embodiments, —Cy— is an optionally substituted heteroaryl ring. In some embodiments, —Cy— is an optionally substituted 5-6 membered heteroaryl ring having 1-4 heteroatoms. In some embodiments, —Cy— is

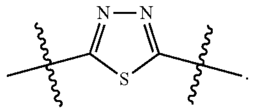 [SMILES: *c1nnc(*)s1]

In some embodiments, each $R^1$ is —H.

A sulfonamide moiety can be connected to an oligonucleotide chain via various suitable linkers in accordance with the present disclosure, such as those described herein and/or in WO/2017/062862, linkers of which is incorporated herein by reference. Example sulfonamides moieties, including mono-, bi-, and tri-sulfonamide moieties, are described below:

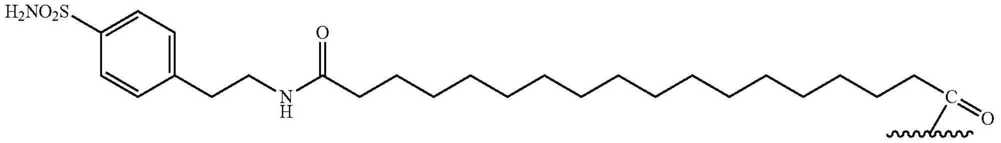

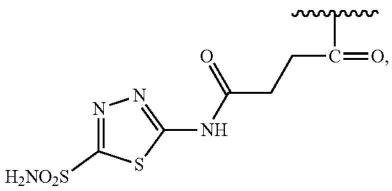 , 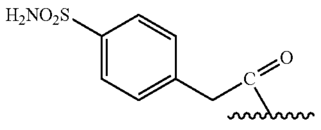 , 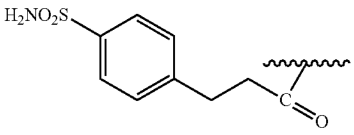 ,

-continued

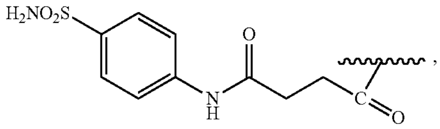

,

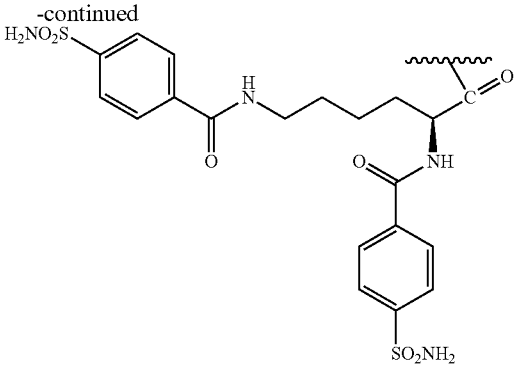

and

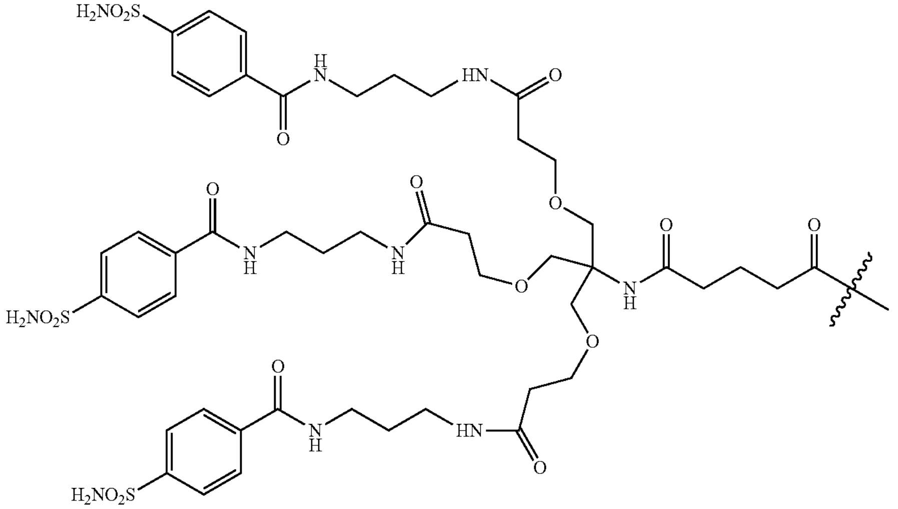

.

In some embodiments, an oligonucleotide comprise a modified internucleotidic linkage and a sulfonamide moiety optionally through a linker. In some embodiments, an oligonucleotide comprising a modified internucleotidic linkage and a sulfonamide moiety is a siRNA, double-straned siRNA, single-stranded siRNA, gapmer, skipmer, blockmer, antisense oligonucleotide, antagomir, microRNA, pre-microRNs, antimir, supermir, ribozyme, Ul adaptor, RNA activator, RNAi agent, decoy oligonucleotide, triplex forming oligonucleotide, aptamer or adjuvant. In some embodiments, the present disclosure provides an oligonucleotide which comprises a modified internucleotidic linkage which comprises a sulfonamide. In some embodiments, an oligonucleotide comprises a sulfonamide and a chirally controlled internucleotidic linkage. In some embodiments, an oligonucleotide comprises a sulfonamide and a chirally controlled internucleotidic linkage which is a phosphorothioate internucleotidic linkage.

In some embodiments, the present disclosure pertains to an oligonucleotide which comprises a sulfonamide moiety or a derivative or variant thereof. In some embodiments, the present disclosure pertains to an oligonucleotide composition, wherein the oligonucleotide comprises a sulfonamide moiety or a derivative or variant thereof and the oligonucleotide comprises at least one chirally controlled internucleotidic linkage.

In some embodiments, the present disclosure pertains to an oligonucleotide which comprises a sulfonamide moiety or a derivative or variant thereof, wherein the oligonucleotide is capable of mediating a decrease in the expression, level and/or activity of a target gene or gene product thereof.

In some embodiments, the present disclosure pertains to an oligonucleotide which comprises a sulfonamide moiety or a derivative or variant thereof, wherein the oligonucleotide is capable of mediating modulation of exon skipping of a target gene. In some embodiments, the present disclosure pertains to an oligonucleotide which comprises a sulfonamide moiety or a derivative or variant thereof, wherein the oligonucleotide is capable of increasing skipping of an exon of a target gene.

Example oligonucleotides that can be utilized for splicing modulation, e.g., exon skipping, that comprise a sulfonamide moiety include WV-3548, WV-3366, etc. Other oligonucleotides comprising a sulfonamide moiety were designed, constructed and/or tested for various activities. For example, oligonucleotides comprising a "mono-sulfonamide" moiety, such as WV-2836, WV-7419, WV-7421, WV-7422, WV-7408, WV-7409, WV-7427, WV-7863, and WV-7864; oligonucleotide comprising a "bi-sulfonamide", WV-7423; and oligonucleotide comprising a "tri-sulfonamide", WV-7417.

TABLE 26A

Certain Malat1 oligonucleotides.

| Oligo-nucleotide | Description | SEQ ID NO: | Naked Sequence | Linkage/ Stereochemistry |
|---|---|---|---|---|
| WV-2735 | Geo * Geo * Geo * Teo * m5Ceo * A * G*C*T*G*C*C*A*A*T* Geo * m5Ceo * Teo * Aeo * Geo | 3235 | GGGTCAGCTG CCAATGCTAG | XXXXXXXXXXX XXXXXXXX |
| WV-2835 | Mod027L001 * Geo * Geo * Geo * Teo * m5Ceo *A*G*C*T*G*C*C*A * A * T * Geo * m5Ceo * Teo * Aeo * Geo | 3236 | GGGTCAGCTGC CAATGCTAG | XXXXXXXXXXX XXXXXXXXX |
| WV-2836 | Mod028L001 * Geo * Geo * Geo * Teo * m5Ceo * A * G * C * T * G * C * C * A * A * T * Geo * m5Ceo * Teo * Aeo * Geo | 3237 | GGGTCAGCTGC C AATGCTAG | XXXXXXXXXXX XXXXXXXXX |
| WV-3174 | mU * mG * mC * mC * mA * G * G * C * T * G * G * T * T * A * T * mG * mA * mC * mU * mC | 3238 | UGCCAGGCTGG T TATGACUC | XXXXXXXXXXX XXXXXXXX |
| WV-7301 | Teo * Geo * m5Ceo * m5Ceo * Aeo * G * G * C * T * G * G * T * T * A * T * Geo * Aeo * m5Ceo * Teo * m5Ceo | 3239 | TGCCAGGCTGG T TATGACTC | XXXXXXXXXXX XXXXXXXX |
| WV-7408 | Mod027L001Geo * Geo * Geo * Teo * m5Ceo * A * G * C * T * G * C * C * A * A * T * Geo * m5Ceo * Teo * Aeo * Geo | 3240 | GGGTCAGCTGC CAATGCTAG | OXXXXXXXXXX X XXXXXXXX |
| WV-7409 | Mod028L001Geo * Geo * Geo * Teo * m5Ceo * A * G * C * T * G * C * C * A * A * T * Geo * m5Ceo * Teo * Aeo * Geo | 3241 | GGGTCAGCTGC C AATGCTAG | OXXXXXXXXXX X XXXXXXXX |
| WV-7417 | Mod029L001 * Geo * Geo * Geo * Teo * m5Ceo * A * G * C * T * G * C * C * A * A * T * Geo * m5Ceo * Teo * Aeo * Geo | 3242 | GGGTCAGCTGC CAATGCTAG | XXXXXXXXXXX XXXXXXXXX |
| WV-7419 | Mod045L001 * Geo * Geo * Geo * Teo * m5Ceo * A * G * C * T * G * C * C * A A * T * Geo * m5Ceo * Teo * Aeo * Geo | 3243 | GGGTCAGCTGC CAATGCTAG | XXXXXXXXXXX XXXXXXXXX |
| WV-7421 | Mod047L001 * Geo * Geo * Geo * Teo * m5Ceo * A * G * C * T * G * C * C * A * A * T * Geo * m5Ceo * Teo * Aeo * Geo | 3244 | GGGTCAGCTGC CAATGCTAG | XXXXXXXXXXX XXXXXXXXX |
| WV-7422 | Mod048L001 * Geo * Geo * Geo * Teo * m5Ceo * A * G * C * T * G * C * C * A * A * T * Geo * m5Ceo * Teo * Aeo * Geo | 3245 | GGGTCAGCTG CCAATGCTAG | XXXXXXXXXXX XXXXXXXXX |
| WV-7423 | Mod049L001 * Geo * Geo * Geo * Teo * m5Ceo * A * G * C * T * G * C * C * A * A * T * Geo * m5Ceo * Teo * Aeo * Geo | 3246 | GGGTCAGCTG CCAATGCTAG | XXXXXXXXXXX XXXXXXXXX |
| WV-7427 | Mod045L001Geo * Geo * Geo * Teo * m5Ceo * A * G * C * T * G * C * C * A * A * T * Geo * m5Ceo * Teo * Aeo * Geo | 3247 | GGGTCAGCTG CCAATGCTAG | OXXXXXXXXXX XXXXXXXXX |
| WV-7863 | Mod046L001Geo * Geo * Geo * Teo * m5Ceo *A * G * C * T * G * C * C A A * T * Geo * m5Ceo * Teo * Aeo * Geo | 3248 | GGGTCAGCTG CCAATGCTAG | OXXXXXXXXXX XXXXXXXXX |
| WV-7864 | Mod054L001Geo * Geo * Geo * Teo * m5Ceo * A * G * C * T * G * C * C * A * A * T * Geo * m5Ceo * Teo * Aeo * Geo | 3249 | GGGTCAGCTG CCAATGCTAG | OXXXXXXXXXX X XXXXXXXX |
| WV-9430 | Mod029L001mU * mG * mC * mC * mA * G * G * C * T * G * G * T * T * A * T * mG * mA * mC * mU * mC | 3250 | UGCCAGGCTG GTTATGACUC | OXXXXXXXXX XXXXXXXXXX |
| WV-7420 | Mod046L001 * Geo * Geo * Geo * Teo * m5Ceo * A * G * C * T * G * C * C * A * A * T * Geo * m5Ceo * Teo * Aeo * Geo | 3251 | GGGTCAGCTG CCAATGCTAG | XXXXXXXXX XXXXXXXXXXX |

For this Table, descriptions match those of Table A1, and

Mod045

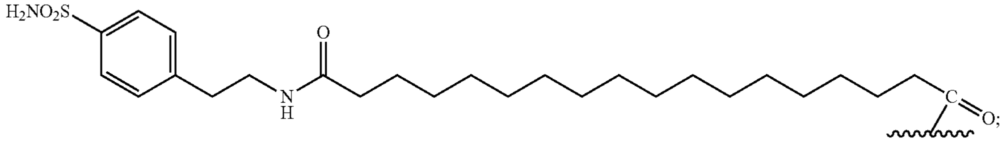

Mod046

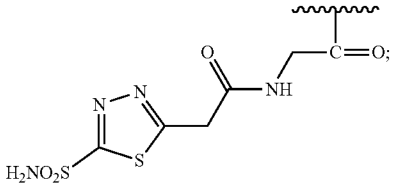

Mod047

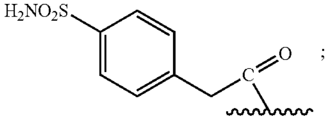

Mod048

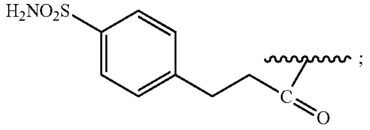

Mod049

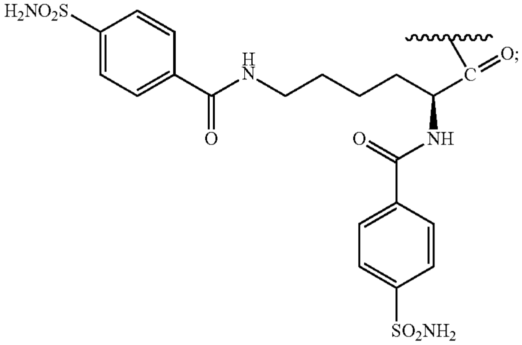

Mod054

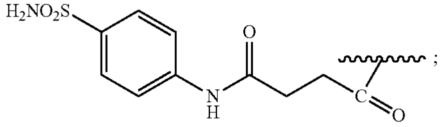

In these Mods, —C(O)— connects to —NH— of a linker (e.g., L001).

Oligonucleotides comprising a sulfonamide moiety were tested for their ability to knockdown Malat1. Tested oligonucleotides were gymnotically delivered to A48-50 patient derived myotubes, which were dosed at 3,1, 0.3 and 0.1 µM concentrations. Cells were allowed to differentiate for 4 days (e.g., this experiment was 4 days post-differentiation). qPCR was used to evaluate knockdown of Malat-1. The results are shown in Table 26B.

TABLE 26B

Example data of Malat1 oligonucleotides.

| | WV-3174 | WV-8927 | WV-8929 | WV-8930 | WV-8931 | WV-8934 | WV-9385 | WV-9390 | Mock |
|---|---|---|---|---|---|---|---|---|---|
| 3 µM | 10 | | 11 | 10 | 11 | 9 | 8 | 33 | 95 |
| 1 µM | 18 | | 2.8 | 24 | 22 | 19 | 20 | 49 | 100 |
| 0.3 µM | 39 | 56 | 50 | 67 | 46 | 42 | 43 | 67 | 95 |
| 0.1 µM | 63 | 73 | 68 | 81 | 68 | 69 | 56 | 81 | 100 |

Numbers represent relative Malat-1 mRNA level.

Various Malat1 oligonucleotides, many comprising a sulfonamide moiety, were tested for their ability to knockdown Malat1 in pre-differentiated myotubes. Certain data are shown in Table 26C. Δ48-50 patient derived myoblasts were differentiated for 4 days prior to dosing with at 1 and 0.1 µM concentrations. RNA was harvested 48 hours post-treatment for measurement.

TABLE 26C

Example data of Malat1 oligonucleotides.

| | WV-3174 | WV-8927 | WV-8929 | WV-8930 | WV-8931 | WV-8934 | WV-9385 | WV-9390 |
|---|---|---|---|---|---|---|---|---|
| 1 µM | | 31 | 25 | 25 | 36 | 24 | 18 | 45 |
| 0.1 µM | 62 | 70 | 79 | 72 | 78 | 55 | 59 | 66 |

| | WV-8448 | WV-7558 | WV-7559 | WV-7560 | MOCK |
|---|---|---|---|---|---|
| 1 µM | 33 | 34 | 22 | 23 | 98 |
| 0.1 µM | 68 | 72 | 69 | 82 | 98 |

Numbers represent relative Malat-1 mRNA level. Numbers are approximate.

In some experiments, animals were dosed with oligonucleotides, including some which comprise a sulfonamide moiety, and the animals were later sacrificed and their tissues tested for the level of the ligonucleotides.

In some experiments, the following protocol was used: Animals: 32 male Mdx mice and 32 male C57BL/6 mice (all 8-10 week-old). Test animals were acclimated to the facility for at least 3 days upon arrival. Dosing: S.C. (subcutaneous)

dosing on days 1, 3 and 5 (5 mL/kg). Necropsy: animals were euthanized 72 hours after the last SC injection. All animals were perfused with PBS. The following tissues were collected: brain, sciatic nerves, spinal cord, eyes, liver, kidney, spleen, heart, diaphragm, gastrocnemius, quadriceps and triceps, white fat, brown fat. Fresh tissues will be rinsed briefly with PBS, gently blotted dry, weighed and snap frozen in Liquid Nitrogen in 2-mL tubes and stored at −80C(on dry ice). Histology: Quadricep and Kidney post-fixed in 10% Formalin and processed to slides (paraffin embedded sections). In some experiments, suitable variants of this protocol were used.

Certain results are shown in Tables 27, 28 and 29.

TABLE 27

Knock-down and oligonucleotide presence in various tissues.

| Malat1 Sequence | Quadriceps pD Mean ± SD | Triceps pD Mean ± SD | Gastro pD Mean ± SD | Diaphragm pD Mean ± SD | Heart pD Mean ± SD | Heart pK Mean ± SD (ug/g) |
|---|---|---|---|---|---|---|
| PBS | 1.000 ± 0.142 | 1.000 ± 0.265 | 1.000 ± 0.042 | 1.000 ± 0.276 | 1.000 ± 0.074 | 0.000 ± 0.000 |
| WV-2735 | 0.776 ± 0.122 | 0.699 ± 0.150 | 0.731 ± 0.107 | 0.879 ± 0.158 | 0.707 ± 0.173 | 1.631 ± 0.692 |
| WV-2835 | 0.639 ± 0.119 | 0.588 ± 0.036 | 0.417 ± 0.065 | 0.895 ± 0.116 | 0.510 ± 0.066 | 1.987 ± 0.203 |
| WV-2836 | 0.621 ± 0.124 | 0.834 ± 0.206 | 0.616 ± 0.169 | 0.769 ± 0.229 | 0.619 ± 0.389 | 7.001 ± 1.331 |

Numbers indicate Malat1 mRNA levels relative to mHprt (mHPRT or mHPRT1), and presence of oligonucleotide (ug/g). Experimental procedure: Study Species: 5-6 wks MDX mice; Route: Subcutaneous; # Doses: QD for 3 days; Time Point Post Last Dose: 2 days; Daily Dose Level (ug): 12.5 mg/kg.

TABLE 28

Knock-down and oligonucleotide presence in various tissues.

| Oligo-nucleotide | Quadriceps pD Mean ± SD | Triceps pD Mean ± SD | Gastro pD Mean ± SD | Diaphragm pD Mean ± SD | Heart pD Mean ± SD |
|---|---|---|---|---|---|
| PBS | 1.000 ± 0.266 | 1.000 ± 0.207 | 1.000 ± 0.138 | 1.000 ± 0.191 | 1.000 ± 0.221 |
| WV-2735 | 0.952 ± 0.232 | 0.876 ± 0.180 | 0.998 ± 0.072 | 0.651 ± 0.046 | 1.032 ± 0.541 |
| WV-2835 | 0.593 ± 0.167 | 0.877 ± 0.180 | 0.645 ± 0.124 | 0.563 ± 0.091 | 1.032 ± 0.240 |
| WV-2836 | 0.556 ± 0.172 | 0.739 ± 0.047 | 0.695 ± 0.102 | 0.614 ± 0.120 | 0.544 ± 0.109 |
| WV-3174 | 0.610 ± 0.109 | 1.009 ± 0.047 | 0.809 ± 0.137 | 0.698 ± 0.069 | 0.588 ± 0.258 |
| WV-7301 | 0.624 ± 0.074 | 0.846 ± 0.172 | 0.837 ± 0.141 | 0.453 ± 0.031 | 0.887 ± 0.142 |

| Oligo-nucleotide | Quadriceps pK Mean ± SD (ug/g) | Diaphragm pK Mean ± SD (ug/g) | Heart pK Mean ± SD (ug/g) |
|---|---|---|---|
| PBS | 0.000 ± 0.000 | 0.096 ± 0.015 | 0.000 ± 0.000 |
| WV-2735 | 5.616 ± 2.724 | 3.207 ± 1.465 | 0.342 ± 0.169 |
| WV-2835 | 8.421 ± 3.374 | 5.734 ± 1.465 | 0.777 ± 0.203 |
| WV-2836 | 11.221 ± 7.877 | 6.142 ± 1.006 | 0.664 ± 0.441 |
| WV-3174 | 9.792 ± 8.339 | 4.609 ± 1.006 | 0.619 ± 0.122 |
| WV-7301 | 6.659 ± 3.858 | 5.728 ± 2.092 | 0.707 ± 0.191 |

Numbers indicate Malat1 mRNA levels relative to mHprt, and presence of oligonucleotide (ug/g). Experimental procedure: Study Species: 10-12 wks MDX mice; Route: Subcutaneous; # Doses: QD for 3 days; Time Point Post Last Dose: 3 days; and Daily Dose Level (ug): 12 mg/kg.

TABLE 29

Knock-down and oligonucleotide presence in various tissues.

| Oligo-nucleotide | Quadriceps pD Mean ± SD | Triceps pD Mean ± SD | Gastro pD Mean ± SD | Diaphragm pD Mean ± SD | Heart pD Mean ± SD |
|---|---|---|---|---|---|
| PBS | 1.000 ± 0.266 | 1.000 ± 0.191 | 1.000 ± 0.249 | 1.000 ± 0.191 | 1.000 ± 0.147 |
| WV-2735 | 0.753 ± 0.230 | 0.667 ± 0.132 | 0.756 ± 0.136 | 0.651 ± 0.046 | 0.596 ± 0.140 |
| WV-2835 | 0.611 ± 0.165 | 0.549 ± 0.077 | 0.656 ± 0.101 | 0.563 ± 0.091 | 0.546 ± 0.092 |
| WV-2836 | 0.640 ± 0.186 | 0.596 ± 0.114 | 0.812 ± 0.216 | 0.614 ± 0.120 | 0.774 ± 0.168 |

TABLE 29-continued

Knock-down and oligonucleotide presence in various tissues.

| | | | | | |
|---|---|---|---|---|---|
| WV-3174 | 0.796 ± 0.142 | 0.610 ± 0.111 | 0.870 ± 0.081 | 0.698 ± 0.069 | 0.703 ± 0.099 |
| WV-7301 | 0.456 ± 0.116 | 0.498 ± 0.097 | 0.753 ± 0.113 | 0.453 ± 0.031 | 0.368 ± 0.031 |

| Oligo-nucleotide | Quadriceps pK Mean ± SD (ug/g) | Diaphragm pK Mean ± SD (ug/g) | Heart pK Mean ± SD (ug/g) |
|---|---|---|---|
| PBS | 0.000 ± 0.000 | 0.108 ± 0.016 | 0.000 ± 0.000 |
| WV-2735 | 2.787 ± 0.734 | 9.219 ± 3.234 | 0.428 ± 0.084 |
| WV-2835 | 2.700 ± 0.891 | 9.895 ± 2.466 | 0.726 ± 0.207 |
| WV-2836 | 2.273 ± 0.621 | 9.751 ± 6.912 | 0.670 ± 0.242 |
| WV-3174 | 2.142 ± 0.778 | 7.568 ± 1.807 | 0.612 ± 0.172 |
| WV-7301 | 2.868 ± 0.334 | 6.174 ± 2.456 | 0.975 ± 0.216 |

Numbers indicate Malat1 mRNA levels relative to mHprt, and presence of oligonucleotide (ug/g). Experimental procedure: Study Species: 10-12 wks wt mice; Route: Subcutaneous; # Doses: QD for 3 days; Time Point Post Last Dose: 3 days; and Daily Dose Level (ug): 12 mg/kg.

TABLE 30

Knock-down and oligonucleotide presence in various tissues.

| Malat1 Sequence | Quadriceps pD Mean ± SD | Gastro pD Mean ± SD | Diaphragm pD Mean ± SD | Heart pD Mean ± SD |
|---|---|---|---|---|
| PBS | 1.000 ± 0.256 | 1.000 ± 0.309 | 1.000 ± 0.345 | 1.000 ± 0.432 |
| WV-3174 | 0.752 ± 0.118 | 0.833 ± 0.160 | 0.647 ± 0.058 | 0.599 ± 0.120 |
| WV-3174 | 0.603 ± 0.118 | 0.678 ± 0.145 | 0.421 ± 0.092 | 0.582 ± 0.185 |
| WV-3174 | 0.454 ± 0.112 | 0.523 ± 0.104 | 0.380 ± 0.081 | 0.415 ± 0.062 |
| WV-3174 | 0.342 ± 0.033 | 0.505 ± 0.119 | 0.322 ± 0.077 | 0.340 ± 0.055 |

| Malat1 Sequence | Quadriceps pK Mean ± SD (ug/g) | Gastro pK Mean ± SD (ug/g) | Diaphragm pK Mean ± SD (ug/g) | Heart pK Mean ± SD (ug/g) |
|---|---|---|---|---|
| PBS | 0.011 ± 0.025 | 0.000 ± 0.000 | 0.000 ± 0.000 | 0.000 ± 0.000 |
| WV-3174 | 1.388 ± 0.677 | 1.704 ± 0.524 | 2.502 ± 0.919 | 1.781 ± 0.668 |
| WV-3174 | 6.651 ± 5.930 | 4.563 ± 1.705 | 7.366 ± 3.939 | 2.532 ± 0.487 |
| WV-3174 | 12.374 ± 4.081 | 14.574 ± 8.235 | 12.075 ± 3.739 | 4.611 ± 1.050 |
| WV-3174 | 15.227 ± 4.925 | 14.124 ± 2.285 | 22.734 ± 4.484 | 12.660 ± 2.437 |

Numbers indicate Malat1 mRNA levels relative to mHprt, and presence of oligonucleotide (ug/g). Experimental procedure: Study Species: 5-6 wks wt mice; Route: Subcutaneous; # Doses: QD for 1 days; Time Point Post Last Dose: 3 days; and Daily Dose Level (ug): 200 mg/kg.

Example Methods for Preparing Oligonucleotides and Compositions

Among other things, the present disclosure provides technologies (methods, reagents, conditions, purification processes, etc.) for prepaing oligonucleotides and oligonucleotide compositions, including chirally controlled oligonucleotides and chirally controlled oligonucleotide nucleotides. Various technologies (methods, reagents, conditions, purification processes, etc.), as described herein, can be utilized to prepare provided oligonucleotides and compositions thereof in accordance with the present disclosure, including but not limited to those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the preparation technologies of each of which are incorporated herein by reference.

In some embodiments, the present disclosure provides chirally controlled oligonucleotides. In some embodiments, a provided chirally controlled oligonucleotide is over 50% pure. In some embodiments, a provided chirally controlled oligonucleotide is over about 55% pure. In some embodiments, a provided chirally controlled oligonucleotide is over about 60% pure. In some embodiments, a provided chirally controlled oligonucleotide is over about 65% pure. In some embodiments, a provided chirally controlled oligonucleotide is over about 70% pure. In some embodiments, a provided chirally controlled oligonucleotide is over about 75% pure. In some embodiments, a provided chirally controlled oligonucleotide is over about 80% pure. In some embodiments, a provided chirally controlled oligonucleotide is over about 85% pure. In some embodiments, a provided chirally controlled oligonucleotide is over about 90% pure. In some embodiments, a provided chirally controlled oligonucleotide is over about 91% pure. In some embodiments, a provided chirally controlled oligonucleotide is over about 92% pure. In some embodiments, a provided chirally controlled oligonucleotide is over about 93% pure. In some embodiments, a provided chirally controlled oligonucleotide is over about 94% pure. In some embodiments, a provided chirally controlled oligonucleotide is over about 95% pure. In some embodiments, a provided chirally controlled oligonucleotide is over about 96% pure. In some embodiments, a provided chirally controlled oligonucleotide is over about 97% pure. In some embodiments, a provided chirally controlled oligonucleotide is over about 98% pure. In some embodiments, a provided chirally controlled oligonucleotide is over about 99% pure. In some embodiments, a provided chirally controlled oligonucleotide is over about 99.5% pure. In some embodiments, a provided chirally controlled oligonucleotide is over about 99.6% pure. In some embodiments, a provided chirally controlled oligonucleotide is over about 99.7% pure. In some embodiments, a provided chirally controlled oligonucleotide is over about 99.8% pure. In some embodiments, a provided chirally controlled oligonucleotide is over about 99.9% pure. In some embodiments, a provided chirally controlled oligonucleotide is over at least about 99% pure.

In some embodiments, a chirally controlled oligonucleotide composition is a composition designed to comprise a single oligonucleotide type. In certain embodiments, such compositions are about 50% diastereomerically pure. In some embodiments, such compositions are about 50% diastereomerically pure. In some embodiments, such compositions are about 50% diastereomerically pure. In some embodiments, such compositions are about 55% diastereomerically pure. In some embodiments, such compositions are about 60% diastereomerically pure. In some embodiments, such compositions are about 65% diastereomerically pure. In some embodiments, such compositions are about 70% diastereomerically pure. In some embodiments, such compositions are about 75% diastereomerically pure. In some embodiments, such compositions are about 80% diastereomerically pure. In some embodiments, such compositions are about 85% diastereomerically pure. In some embodiments, such compositions are about 90% diastereomerically pure. In some embodiments, such compositions are about 91% diastereomerically pure. In some embodiments, such compositions are about 92% diastereomerically pure. In some embodiments, such compositions are about 93% diastereomerically pure. In some embodiments, such compositions are about 94% diastereomerically pure. In some embodiments, such compositions are about 95% diastereomerically pure. In some embodiments, such compositions are about 96% diastereomerically pure. In some embodiments, such compositions are about 97% diastereomerically pure. In some embodiments, such compositions are about 98% diastereomerically pure. In some embodiments, such compositions are about 99% diastereomerically pure. In some embodiments, such compositions are about 99.5% diastereomerically pure. In some embodiments, such compositions are about 99.6% diastereomerically pure. In some embodiments, such compositions are about 99.7% diastereomerically pure. In some embodiments, such compositions are about 99.8% diastereomerically pure. In some embodiments, such compositions are about 99.9% diastereomerically pure. In some embodiments, such compositions are at least about 99% diastereomerically pure.

Among other things, the present disclosure recognizes the challenge of stereoselective (rather than stereorandom or racemic) preparation of oligonucleotides. Among other things, the present disclosure provides methods and reagents for stereoselective preparation of oligonucleotides comprising multiple (e.g., more than 5, 6, 7, 8, 9, or 10) internucleotidic linkages, and particularly for oligonucleotides comprising multiple (e.g., more than 5, 6, 7, 8, 9, or 10) chiral internucleotidic linkages. In some embodiments, in a stereorandom or racemic preparation of oligonucleotides, at least one chiral internucleotidic linkage is formed with less than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 95:5 diastereoselectivity. In some embodiments, for a stereoselective or chirally controlled preparation of oligonucleotides, each chiral internucleotidic linkage is formed with greater than 96:4 diastereoselectivity. In some embodiments, for a stereoselective or chirally controlled preparation of oligonucleotides, each chiral internucleotidic linkage is formed with greater than 97:3 diastereoselectivity. In some embodiments, for a stereoselective or chirally controlled preparation of oligonucleotides, each chiral internucleotidic linkage is formed with greater than 98:2 diastereoselectivity. In some embodiments, for a stereoselective or chirally controlled preparation of oligonucleotides, each chiral internucleotidic linkage is formed with greater than 99:1 diastereoselectivity. In some embodiments, diastereoselectivity of a chiral internucleotidic linkage in an oligonucleotide may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage.

In some embodiments, a chirally controlled oligonucleotide composition is a composition designed to comprise multiple oligonucleotide types. In some embodiments, methods of the present disclosure allow for the generation of a library of chirally controlled oligonucleotides such that a pre-selected amount of any one or more chirally controlled oligonucleotide types can be mixed with any one or more other chirally controlled oligonucleotide types to create a chirally controlled oligonucleotide composition. In some embodiments, the pre-selected amount of an oligonucleotide type is a composition having any one of the above-described diastereomeric purities.

In some embodiments, the present disclosure provides methods for making a chirally controlled oligonucleotide comprising steps of:

(1) coupling;
(2) capping;
(3) optionally modifying;
(4) deblocking; and
(5) repeating steps (1)-(4) until a desired length is achieved.

In some embodiments, the present disclosure provides a method, e.g., for preparing an oligonucleotide, comprising one or more cycles, each of which independently comprises:

(1) a coupling step;
(2) optionally a pre-modification capping step;
(3) a modification step;
(4) optionally a post-modification capping step; and
(5) optionally a de-blocking step.

In some embodiments, a cycle comprises one or more pre-modification capping steps. In some embodiments, a cycle comprises one or more post-modification capping steps. In some embodiments, a cycle comprises one or more pre- and post-modification capping steps. In some embodiments, a cycle comprises one or more de-blocking steps. In some embodiments, a cycle comprises a coupling step, a pre-modification capping step, a modification step, a post-modification capping step, and a de-blocking step. In some embodiments, a cycle comprises a coupling step, a pre-modification capping step, a modification step, and a de-blocking step. In some embodiments, a cycle comprises a coupling step, a modification step, a post-modification capping step and a de-blocking step. In some embodiments, comprise a coupling step, a pre-modification capping step, a modification step, a post-modification capping step, and a de-blocking step. In some embodiments, one or more cycles comprise a coupling step, a pre-modification capping step, a modification step, and a de-blocking step. In some embodiments, one or more cycles comprise a coupling step, a modification step, a post-modification capping step and a de-blocking step.

When describing the provided methods, the word "cycle" has its ordinary meaning as understood by a person of ordinary skill in the art. In some embodiments, one round of steps (1)-(4) is referred to as a cycle. In some embodiments, some cycles comprise modifying. In some embodiments, some cycles do not comprise modifying. In some embodiments, some cycles comprise and some cycles do not comprise modifying. In some embodiments, each cycle independently comprises a modifying step. In some embodiments, each cycle does not comprise a cycling step.

In some embodiments, to form a chirally controlled internucleotidic linkage, a chirally pure phosphoramidite comprising a chiral auxiliary is utilized to stereoselectively form the chirally controlled internucleotidic linkage. Various phosphoramidite and chiral auxiliaries, e.g., those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the phosphoramidite and chiral auxiliaries of each of which are incorporated herein by reference, may be utilized in accordance with the present disclosure.

In some embodiments, a coupling step provides an oligonucleotide comprises an internucleotidic linkage of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, etc., or a salt form thereof, wherein $P^L$ is P. In some embodiments, such an internucleotidic linkage is a chirally controlled internucleotidic linkage. In some embodiments, such an internucleotidic linkage comprises a chiral auxiliary moiety.

In some embodiments, a modifying step provides an oligonucleotide comprises an internucleotidic linkage of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, etc., or a salt form thereof, wherein $P^L$ is P═W. In some embodiments, a modifying step provides an oligonucleotide comprises an internucleotidic linkage of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, etc., or a salt form thereof, wherein $P^L$ is P═W. In some embodiments, W is S. In some embodiments, W is O. In some embodiments, such an internucleotidic linkage is a chirally controlled internucleotidic linkage. In some embodiments, such an internucleotidic linkage comprises a chiral auxiliary moiety. In some embodiments, a modifying step provides a non-negatively charged internucleotidic linkage. In some embodiments, a non-negatively charged internucleotidic linkage has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, etc., or a salt form thereof. In some embodiments, such an internucleotidic linkage is a neutral internucleotidic linkage. In some embodiments, such an internucleotidic linkage is a chirally controlled internucleotidic linkage. In some embodiments, such an internucleotidic linkage comprises a chiral auxiliary moiety. In some embodiments, such an internucleotidic linkage comprises no chiral auxiliary moiety. In some embodiments, a chiral auxiliary moiety falls off during modification.

Provided technologies provide various advantages. Among other things, as demonstrated herein, provided technologies can greatly improve oligonucleotide synthesis crude purity and yield, particularly for modified and/or chirally pure oligonucleotides that provide a number of properties and activities that are critical for therapeutic purposes. With the capability to provide unexpectedly high crude purity and yield for therapeutically important oligonucleotides, provided technologies can significantly reduce manufacturing costs (through, e.g., simplified purification, greatly improved overall yields, etc.). In some embodiments, provided technologies can be readily scaled up to produce oligonucleotides in sufficient quantities and qualities for clinical purposes. In some embodiments, provided technologies comprising chiral auxiliaries that comprise electron-withdrawing groups in $G^2$ (e.g., PSM chiral auxiliaries) are particularly useful for preparing chirally controlled internucleotidic linkages comprising P—N bonds (e.g., non-negatively charged internucleotidic linkages such as n001, n002, n003, n004, n005, n006, n007, n008, n009, n010, etc.) and can significantly simplify manufacture operations, reduce cost, and/or facilitate downstream formation.

In some embodiments, provided technologies provides improved reagents compatibility. For example, as demonstrated in the present disclosure, provided technologies provide flexibility to use different reagent systems for oxidation, sulfurization and/or azide reactions, particularly for chirally controlled oligonucleotide synthesis.

Among other things, the present disclosure provides oligonucleotide compositions of high crude purity. In some embodiments, the present disclosure provides chirally controlled oligonucleotide composition of high crude purity. In some embodiments, the present disclosure provides chirally controlled oligonucleotide of high crude purity. In some embodiments, the present disclosure provides oligonucleotide of high crude purity and/or high stereopurity.

Support and Linkers

In some embodiments, oligonucleotides can be prepared in solution. In some embodiments, oligonucleotides can be prepared using a support. In some embodiments, oligonucleotides are prepared using a solid support. Suitable support that can be utilized in accordance with the present disclosure include, e.g., solid support described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the solid support of each of which is incorporated herein by reference.

In some embodiments, a linker moiety is utilized to connect an oligonucleotide chain to a support during synthesis. Suitable linkers are widely utilized in the art, and include those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the linker of each of which is incorporated herein by reference In some embodiments, the linking moiety is a succinamic acid linker, or a succinate linker (—CO—$CH_2$—$CH_2$—CO—), or an oxalyl linker (—CO—CO—). In some embodiments, the linking moiety and the nucleoside are bonded together through an ester bond. In some embodiments, a linking moiety and a nucleoside are bonded together through an amide bond. In some embodiments, a linking moiety connects a nucleoside to another nucleotide or nucleic acid. Suitable linkers are disclosed in, for example, Oligonucleotides And Analogues A Practical Approach, Ekstein, F. Ed., IRL Press, N.Y., 1991, Chapter 1 and Solid-Phase Supports for Oligonucleotide Synthesis, Pon, R. T., Curr. Prot. Nucleic Acid Chem., 2000, 3.1.1-3.1.28. In some embodiments, a universal linker (UnyLinker) is used to attached the oligonucleotide to the solid support (Ravikumar et al., Org. Process Res. Dev., 2008, 12 (3), 399-410). In some embodiments, other universal linkers are used (Pon, R. T., Curr. Prot. Nucleic Acid Chem., 2000, 3.1.1-3.1.28). In some embodiments, various orthogonal linkers (such as disulfide linkers) are used (Pon, R. T., Curr. Prot. Nucleic Acid Chem., 2000, 3.1.1-3.1.28).

Among other things, the present disclosure recognizes that a linker can be chosen or designed to be compatible with a set of reaction conditions employed in oligonucleotide synthesis. In some embodiments, to avoid degradation of oligonucleotides and to avoid desulfurization, auxiliary groups are selectively removed before de-protection. In some embodiments, DPSE group can selectively be removed by $F^-$ ions. In some embodiments, the present disclosure provides linkers that are stable under a DPSE de-protection condition, e.g., 0.1M TBAF in MeCN, 0.5M $HF\text{-}Et_3N$ in THE or MeCN, etc. In some embodiments, a provided linker is a linker as exemplified below:

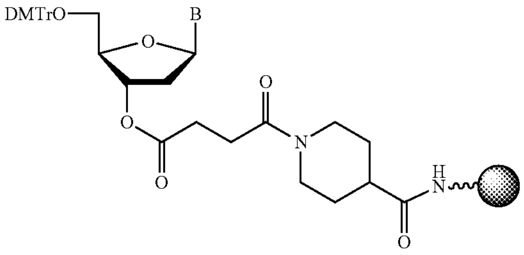

succinyl-piperidine (SP) linker

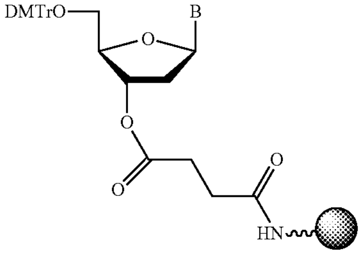

succinyl linker

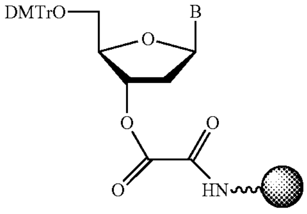

oxalyl linker

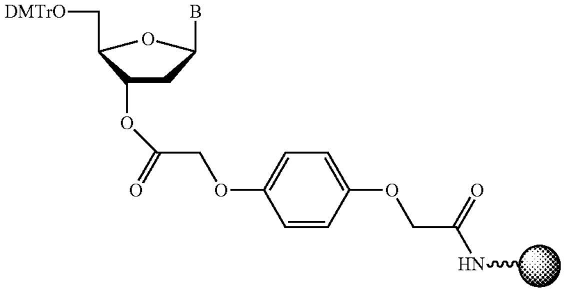

Q-linker

-continued

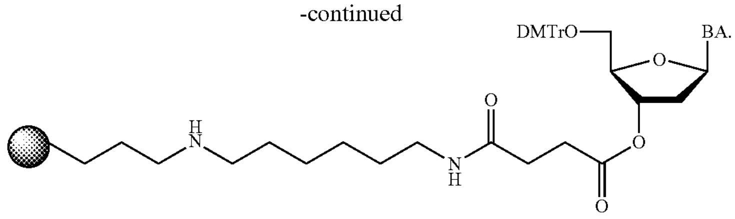

CNA linker (with succinyl linker)

Solvents

Syntheses of provided oligonucleotides are generally performed in aprotic organic solvents. In some embodiments, a solvent is a nitrile solvent such as, e.g., acetonitrile. In some embodiments, a solvent is a basic amine solvent such as, e.g., pyridine. In some embodiments, a solvent is an ethereal solvent such as, e.g., tetrahydrofuran. In some embodiments, a solvent is a halogenated hydrocarbon such as, e.g., dichloromethane. In some embodiments, a mixture of solvents is used. In certain embodiments a solvent is a mixture of any one or more of the above-described classes of solvents.

In some embodiments, when an aprotic organic solvent is not basic, a base is present in the reacting step. In some embodiments where a base is present, the base is an amine base such as, e.g., pyridine, quinoline, or N,N-dimethylaniline. Example other amine bases include pyrrolidine, piperidine, N-methyl pyrrolidine, pyridine, quinoline, N,N-dimethylaminopyridine (DMAP), or N,N-dimethylaniline.

In some embodiments, a base is other than an amine base.

In some embodiments, an aprotic organic solvent is anhydrous. In some embodiments, an anhydrous aprotic organic solvent is freshly distilled. In some embodiments, a freshly distilled anhydrous aprotic organic solvent is a basic amine solvent such as, e.g., pyridine. In some embodiments, a freshly distilled anhydrous aprotic organic solvent is an ethereal solvent such as, e.g., tetrahydrofuran. In some embodiments, a freshly distilled anhydrous aprotic organic solvent is a nitrile solvent such as, e.g., acetonitrile.

Chiral Reagents/Chiral Auxiliaries

In some embodiments, chiral reagents (may also be referred to as chiral auxiliaries) are used to confer stereoselectivity in the production of chirally controlled oligonucleotides. Many chiral reagents, also referred to by those of skill in the art and herein as chiral auxiliaries, may be used in accordance with methods of the present disclosure. Examples of such chiral reagents are described herein and in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/098264, WO 2018/223056, WO 2018/237194, and/or WO 2019/055951, the chiral auxiliaries of each of which is incorporated by reference.

In some embodiments, a chiral reagent for use in accordance with the methods of the present disclosure is of Formula 3-I, below:

Formula 3-I

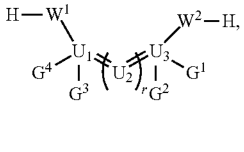

wherein:

$W^1$ and $W^2$ are any of —O—, —S—, —$NG^5$-, or —$NG^5$-O—;

$U_1$ and $U_3$ are carbon atoms which are bonded to $U_2$ if present, or to each other if r is 0, via a single, double or triple bond;

$U_2$ is —C—, —$CG^8$-, —$CG^8G^8$-, —$NG^8$-, —N—, —O—, or —S— where r is an integer of 0 to 5; and each of $G^1$, $G^2$, $G^3$, $G^4$, $G^5$, and $G^8$ is independently $R^1$ as described in the present disclosure.

In some embodiments, $W^1$ and $W^2$ are any of —O—, —S—, or —$NG^5$-, $U_1$ and $U_3$ are carbon atoms which are bonded to $U_2$ if present, or to each other if r is 0, via a single, double or triple bond. $U_2$ is —C—, —$CG^8$-, —$CG^8G^8$-, —$NG^8$-, —N—, —O—, or —S— where r is an integer of 0 to 5 and no more than two heteroatoms are adjacent. When any one of $U_2$ is C, a triple bond must be formed between a second instance of $U_2$, which is C, or to one of $U_1$ or $U_3$. Similarly, when any one of $U_2$ is $CG^8$, a double bond is formed between a second instance of $U_2$ which is —$CG^8$- or —N—, or to one of $U_1$ or $U_3$.

In some embodiments, —$U_1G^3G^4$-$(U_2)_r$—$U_3G^1G^2$- is —$CG^3G^4$-$CG^1G^2$-. In some embodiments, —$U_1$—$(U_2)_r$—$U_3$— is —$CG^3$=$CG^1$-. In some embodiments, —$U_1$—$(U_2)_r$—$U_3$— is —C≡C—. In some embodiments, —$U_1$—$(U_2)_r$—$U_3$— is —$CG^3$-$CG^8$-$CG^1G^2$-. In some embodiments, —$U_1$—$(U_2)_r$—$U_3$— is —$CG^3G^4$-O—$CG^1G^2$-. In some embodiments, —$U_1$—$(U_2)_r$—$U_3$— is —$CG^3G^4$-$NG^8$-$CG^1G^2$-. In some embodiments, —$U_1$—$(U_2)_r$—$U_3$— is —$CG^3G^4$-N—$CG^2$-. In some embodiments, —$U_1$—$(U_2)_r$—$U_3$— is —$CG^3G^4$-N═$CG^8$-$CG^1G^2$-.

In some embodiments, $G^1$, $G^2$, $G^3$, $G^4$, $G^5$, and $G^8$ are independently $R^1$ as described in the present disclosure. In some embodiments, $G^1$, $G^2$, $G^3$, $G^4$, $G^5$, and $G^8$ are independently R as described in the present disclosure. In some embodiments, $G^1$, $G^2$, $G^3$, $G^4$, $G^5$, and $G^8$ are independently hydrogen, or an optionally substituted group selected from aliphatic, alkyl, aralkyl, cycloalkyl, cycloalkylalkyl, heteroaliphatic, heterocyclyl, heteroaryl, and aryl; or two of $G^1$, $G^2$, $G^3$, $G^4$, and $G^5$ are $G^6$ (taken together to form an optionally substituted, saturated, partially unsaturated or unsaturated carbocyclic or heteroatom-containing ring of up to about 20 ring atoms which is monocyclic or polycyclic, and is fused or unfused). In some embodiments, a ring so formed is substituted by oxo, thioxo, alkyl, alkenyl, alkynyl, heteroaryl, or aryl moieties. In some embodiments, when a ring formed by taking two $G^6$ together is substituted, it is substituted by a moiety which is bulky enough to confer stereoselectivity during the reaction.

In some embodiments, a ring formed by taking two of $G^6$ together is optionally substituted cyclopentyl, pyrrolyl, cyclopropyl, cyclohexenyl, cyclopentenyl, tetrahydropyranyl, or piperazinyl. In some embodiments, a ring formed by taking two of $G^6$ together is optionally substituted cyclopentyl, pyrrolyl, cyclopropyl, cyclohexenyl, cyclopentenyl, tetrahydropyranyl, pyrrolidinyl, or piperazinyl.

In some embodiments, $G^1$ is optionally substituted phenyl. In some embodiments, $G^1$ is phenyl. In some embodiments, $G^2$ is methyl or hydrogen. In some embodiments, $G^2$ is hydrogen. In some embodiments, $G^1$ is optionally substituted phenyl and $G^2$ is methyl. In some embodiments, $G^1$ is phenyl and $G^2$ is methyl. In some embodiments, $G^1$ is —$CH_2Si(R)_3$, wherein one R is optionally substituted $C_{1-6}$ aliphatic, and the other two R are each independently an optionally substituted 3-20 membered, monocyclic or polycyclic, saturated, partially unsaturated or aromatic ring having 0-5 heteroatoms. In some embodiments, the other two R are each independently optionally substituted phenyl. In some embodiments, $G^1$ is —$CH_2SiMePh_2$.

In some embodiments, r is 0.

In some embodiments, $W^1$ is —$NG^5$-O—. In some embodiments, $W^1$ is —$NG^5$-O—, wherein the —O— is bonded to —H. In some embodiments, $W^1$ is —$NG^5$-. In some embodiments, one of $G^3$ and $G^4$ is taken together with $G^5$ to form an optionally substituted 3-10 membered ring. In some embodiments, one of $G^3$ and $G^4$ is taken together with $G^5$ to form an optionally substituted pyrrolidinyl ring. In some embodiments, one of $G^3$ and $G^4$ is taken together with $G^5$ to form a pyrrolidinyl ring. In some embodiments, $G^5$ is optionally substituted $C_{1-6}$ aliphatic. In some embodiments, $G^5$ is methyl. In some embodiments, one of $G^1$ and $G^2$ and one of $G^3$ and $G^4$ are taken together with their intervening atoms to form an optionally substituted 3-10 membered ring having 0-3 heteroatoms. In some embodiments, a formed ring 3-membered. In some embodiments, a formed ring 4-membered. In some embodiments, a formed ring 5-membered. In some embodiments, a formed ring 6-membered. In some embodiments, a formed ring 7-membered. In some embodiments, a formed ring is substituted. In some embodiments, a formed ring is unsubstituted. In some embodiments, a formed ring has no heteroatom. In some embodiments, a formed ring is saturated. For example compounds, see WV-CA-293 and WV-CA-294.

In some embodiments, $W^2$ is —O—.

In some embodiments, a chiral reagent is a compound of Formula 3-AA:

Formula 3-AA

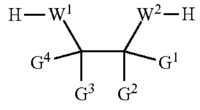

wherein each variable is independently as defined above and described herein.

In some embodiments of Formula 3AA, $W^1$ and $W^2$ are independently —$NG^5$-, —O—, or —S—; $G^1$, $G^2$, $G^3$, $G^4$, and $G^5$ are independently hydrogen, or an optionally substituted group selected from alkyl, aralkyl, cycloalkyl, cycloalkylalkyl, heteroaliphatic, heterocyclyl, heteroaryl, or aryl; or two of $G^1$, $G^2$, $G^3$, $G^4$, and $G^5$ are $G^6$ (taken together to form an optionally substituted saturated, partially unsaturated or unsaturated carbocyclic or heteroatom-containing ring of up to about 20 ring atoms which is monocyclic or polycyclic, fused or unfused), and no more than four of $G^1$, $G^2$, $G^3$, $G^4$, and $G^5$ are $G^6$. Similarly to the compounds of Formula 3-I, any of $G^1$, $G^2$, $G^3$, $G^4$, or $G^5$ are optionally substituted by oxo, thioxo, alkyl, alkenyl, alkynyl, heteroaryl, or aryl moieties. In some embodiments, such substitution induces stereoselectivity in chirally controlled oligonucleotide production. In some embodiments, a heteroatom-containing moiety, e.g., heteroaliphatic, heterocyclyl, heteroaryl, etc., has 1-5 heteroatoms. In some embodiments, the heteroatoms are selected from nitrogen, oxygen, sulfure and silicon. In some embodiments, at least one heteroatom is nitrogen.

In some embodiments, $W^1$ is —$NG^5$-O—. In some embodiments, $W^1$ is —$NG^5$-O—, wherein the —O— is bonded to —H. In some embodiments, $W^1$ is —$NG^5$-. In some embodiments, $G^5$ and one of $G^3$ and $G^4$ are taken together to form an optionally substituted 3-10 membered ring having 0-3 heteroatoms in addition to the nitrogen atom of $W^1$. In some embodiments, $G^5$ and $G^3$ are taken together to form an optionally substituted 3-10 membered ring having 0-3 heteroatoms in addition to the nitrogen atom of $W^1$. In some embodiments, $G^5$ and $G^4$ are taken together to form an optionally substituted 3-10 membered ring having 0-3 heteroatoms in addition to the nitrogen atom of $W^1$. In some embodiments, a formed ring is an optionally substituted 4, 5, 6, 7, or 8 membered ring. In some embodiments, a formed ring is an optionally substituted 4-membered ring. In some embodiments, a formed ring is an optionally substituted 5-membered ring. In some embodiments, a formed ring is an optionally substituted 6-membered ring. In some embodiments, a formed ring is an optionally substituted 7-membered ring.

In some embodiments, a provided chiral reagent has the structure of

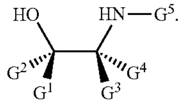

In some embodiments, a provided chiral reagent has the structure of

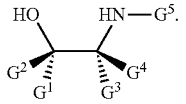

In some embodiments, a provided chiral reagent has the structure of

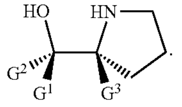

In some embodiments, a provided chiral reagent has the structure of

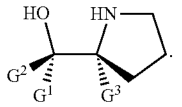

In some embodiments, a provided chiral reagent has the structure of

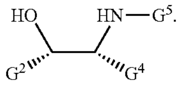

In some embodiments, a provided chiral reagent has the structure of

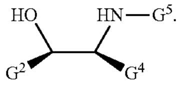

In some embodiments, a provided chiral reagent has the structure of

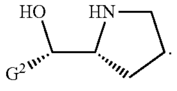

In some embodiments, a provided chiral reagent has the structure of

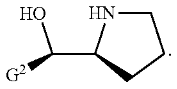

In some embodiments, $W^1$ is —$NG^5$, $W^2$ is O, each of $G^1$ and $G^3$ is independently hydrogen or an optionally substituted group selected from $C_{1-10}$ aliphatic, heterocyclyl, heteroaryl and aryl, $G^2$ is —$C(R)_2Si(R)_3$, and $G^4$ and $G^5$ are taken together to form an optionally substituted saturated, partially unsaturated or unsaturated heteroatom-containing ring of up to about 20 ring atoms which is monocyclic or polycyclic, fused or unfused. In some embodiments, each R is independently hydrogen, or an optionally substituted group selected from $C_1$-$C_6$ aliphatic, carbocyclyl, aryl, heteroaryl, and heterocyclyl. In some embodiments, $G^2$ is —$C(R)_2Si(R)_3$, wherein —$C(R)_2$— is optionally substituted —$CH_2$—, and each R of —$Si(R)_3$ is independently an optionally substituted group selected from $C_{1-10}$ aliphatic, heterocyclyl, heteroaryl and aryl. In some embodiments, at least one R of —$Si(R)_3$ is independently optionally substituted $C_{1-10}$ alkyl. In some embodiments, at least one R of —$Si(R)_3$ is independently optionally substituted phenyl. In some embodiments, one R of —$Si(R)_3$ is independently optionally substituted phenyl, and each of the other two R is independently optionally substituted $C_{1-10}$ alkyl. In some embodiments, one R of —$Si(R)_3$ is independently optionally substituted $C_{1-10}$ alkyl, and each of the other two R is independently optionally substituted phenyl. In some embodiments, $G^2$ is optionally substituted —$CH_2Si(Ph)(Me)_2$. In some embodiments, $G^2$ is optionally substituted —$CH_2Si(Me)(Ph)_2$. In some embodiments, $G^2$ is —$CH_2Si(Me)(Ph)_2$. In some embodiments, $G^4$ and $G^5$ are taken together to form an optionally substituted saturated 5-6 membered ring containing one nitrogen atom (to which $G^5$ is attached). In some embodiments, $G^4$ and $G^5$ are taken together to form an optionally substituted saturated 5-membered ring containing one nitrogen atom. In some embodiments, $G^1$ is hydrogen. In some embodiments, $G^3$ is hydrogen. In some embodiments, both $G^1$ and $G^3$ are hydrogen.

In some embodiments, $W^1$ is —$NG^5$, $W^2$ is O, each of $G^1$ and $G^3$ is independently $R^1$, $G^2$ is —$R^1$, and $G^4$ and $G^5$ are taken together to form an optionally substituted saturated, partially unsaturated or unsaturated heteroatom-containing ring of up to about 20 ring atoms which is monocyclic or polycyclic, fused or unfused. In some embodiments, each of $G^1$ and $G^3$ is independently R. In some embodiments, each of $G^1$ and $G^3$ is independently —H. In some embodiments, $G^2$ is connected to the rest of the molecule through a carbon atom, and the carbon atom is substituted with one or more electron-withdrawing groups. In some embodiments, $G^2$ is methyl substituted with one or more electron-withdrawing groups. In some embodiments, $G^2$ is methyl substituted with one and no more than one electron-withdrawing group. In some embodiments, $G^2$ is methyl substituted with two or more electron-withdrawing groups. Among other things, a chiral auxiliary having $G^2$ comprising an electron-withdrawing group can be readily removed by a base (base-labile, e.g., under an anhydrous condition substantially free of water; in many instances, preferably before oligonucleotides comprising internucleotidic linkages comprising such chiral auxiliaries are exposed to conditions/reagent systems comprising a substantial amount of water, particular in the presence of a base (e.g., cleavage conditions/reagent systems using $NH_4OH$)) and provides various advantages as described herein, e.g., high crude purity, high yield, high stereoselectivity, more simplified operation, fewer steps, further reduced manufacture cost, and/or more simplified downstream formulation (e.g., low amount of salt(s) after cleavage), etc. In some embodiments, as described in the Examples, such auxiliaries may provide alternative or additional chemical compatibility with other functional and/or protection groups. In some embodiments, as demonstrated in the Examples, base-labile chiral auxiliaries are particularly useful for construction of chirally controlled non-negatively charged internucleotidic linkages (e.g., neutral internucleotidic linkages such as n001); in some instances, as demonstrated in the Examples, they can provide significantly improved yield and/or crude purity with high stereoselectivity, e.g., when utilized with removal using a base under an anhydrous condition. In some embodiments, such a chiral auxiliary is bonded to a linkage phosphorus via an oxygen atom (e.g., which corresponds to a —OH group in a corresponding chiral auxiliary compound, e.g., a compound of formula I), the carbon atom in the chiral auxiliary to which the oxygen is bonded (the alpha carbon) also bonds to —H (in addition to other groups; in some embodiments, a secondary carbon), and the next carbon atom (the beta carbon) in the chiral auxiliary is boned to one or two electron-withdrawing groups. In some embodiments, —$W^2$—H is —OH. In some embodiments, $G^1$ is —H. In some embodiments, $G^2$ comprises one or two electron-withdrawing groups or can otherwise facilitate remove of the chiral auxiliary by a base. In some embodiments, $G^1$ is —H, $G^2$ comprises one or two electron-withdrawing groups, —$W^2$—His —OH. In some embodiments, $G^1$ is —H, $G^2$ comprises one or two electron-withdrawing groups, —$W^2$—H is —OH, —$W^1$—H is —$NG^5$-H, and one of $G^3$ and $G^4$ is taken together with $G^5$ to form with their intervening atoms a ring as described herein (e.g., an optionally substituted 3-20 membered monocyclic, bicyclic or polycyclic ring having in addition to the nitrogen atom to which $G^5$ is on, 0-5 heteroatoms (e.g., an optionally substituted 3, 4, 5, or 6-membered monocyclic saturated ring having in addition to the nitrogen atom to which $G^5$ is on no other heteroatoms)).

As appreciated by those skilled in the art, various electron-withdrawing groups are known in the art and can be utilized in accordance with the present disclosure. In some embodiments, an electronic-withdrawing group comprises and/or is connected to the carbon atom through, e.g., —S(O)—, —$S(O)_2$—, —P(O)($R^1$)—, —P(S)$R^1$—, or —C(O)—. In some embodiments, an electron-withdrawing group is —CN, —$NO_2$, halogen, —C(O)$R^1$, —C(O)OR', —C(O)N$(R')_2$, —S(O)$R^1$, —$S(O)_2R^1$, —P(W)$(R^1)_2$, —P(O)$(R^1)_2$, —P(O)$(OR')_2$, or —P(S)$(R^1)_2$. In some embodiments, an electron-withdrawing group is aryl or heteroaryl, e.g., phenyl, substituted with one or more of —CN, —$NO_2$, halogen, —C(O)$R^1$, —C(O)OR', —C(O)N$(R')_2$, —S(O)$R^1$, —$S(O)_2R^1$, —P(W)$(R^1)_2$, —P(O)$(R^1)_2$, —P(O)$(OR')_2$, or —P(S)$(R^1)_2$.

In some embodiments, $G^2$ is -L-R'. In some embodiments, $G^2$ is -L'-L"-R', wherein L' is —$C(R)_2$— or optionally substituted —$CH_2$—, and L" is —P(O)(R')—, —P(O)(R')O—, —P(O)(OR')—, —P(O)(OR')O—, —P(O)[N(R')]—, —P(O)[N(R')]O—, —P(O)[N(R')][N(R')]—, —P(S)(R')—, —$S(O)_2$—, —$S(O)_2$—, —$S(O)_2O$—, —S(O)—, —C(O)—, —C(O)N(R')—, or —S—. In some embodiments, L' is —$C(R)_2$—. In some embodiments, L' is optionally substituted —$CH_2$—.

In some embodiments, L' is —$C(R)_2$—. In some embodiments, each R is independently hydrogen, or an optionally substituted group selected from $C_1$-$C_6$ aliphatic, carbocyclyl, aryl, heteroaryl, and heterocyclyl. In some embodiments, L' is —$CH_2$—. In some embodiments, L" is —P(O)(R')—, —P(S)(R')—, —$S(O)_2$—. In some embodiments, $G^2$ is -L'—C(O)N$(R')_2$. In some embodiments, $G^2$ is -L'—P(O)$(R')_2$. In some embodiments, $G^2$ is -L'—P(S)$(R')_2$. In some embodiments, each R' is independently optionally substituted aliphatic, heteroaliphatic, aryl, or heteroaryl as described in the present disclosure (e.g., those embodiments described for R). In some embodiments, each R' is independently optionally substituted phenyl. In some embodiments, each R' is independently optionally substituted phenyl wherein one or more substituents are independently selected from —CN, —OMe, —Cl, —Br, and —F. In some embodiments, each R' is independently substituted phenyl wherein one or more substituents are independently selected from —CN, —OMe, —Cl, —Br, and —F. In some embodiments, each R' is independently substituted phenyl wherein the substituents are independently selected from —CN, —OMe, —Cl, —Br, and —F. In some embodiments, each R' is independently mono-substituted phenyl, wherein the substituent is independently selected from —CN, —OMe, —Cl, —Br, and —F. In some embodiments, two R' are the same. In some embodiments, two R' are different. In some embodiments, $G^2$ is -L'—S(O)R'. In some embodiments, $G^2$ is -L'—C(O)N$(R')_2$. In some embodiments, $G^2$ is -L'—$S(O)_2R'$. In some embodiments, R' is optionally substituted aliphatic, heteroaliphatic, aryl, or heteroaryl as described in the present disclosure (e.g., those embodiments described for R). In some embodiments, R' is optionally substituted phenyl. In some embodiments, R' is optionally substituted phenyl wherein one or more substituents are independently selected from —CN, —OMe, —Cl, —Br, and —F. In some embodiments, R' is substituted phenyl wherein one or more substituents are independently selected from —CN, —OMe, —Cl, —Br, and —F. In some embodiments, R' is substituted phenyl wherein each substituent is independently selected from —CN, —OMe, —Cl, —Br, and —F. In some embodiments, R' is mono-substituted phenyl. In some embodiments, R' is mono-substituted phenyl, wherein the substituent is independently selected from —CN, —OMe, —Cl, —Br, and —F. In some embodiments, a substituent is an electron-withdrawing group. In some embodiments, an electron-withdrawing group is —CN, —$NO_2$, halogen, —C(O)$R^1$, —C(O)OR', —C(O)N$(R')_2$, —S(O)$R^1$, —$S(O)_2R^1$, —P(W)$(R^1)_2$, —P(O)$(R^1)_2$, —P(O)$(OR')_2$, or —P(S)$(R^1)_2$.

In some embodiments, $G^2$ is optionally substituted —$CH_2$-L"-R, wherein each of L" and R is independently as described in the present disclosure. In some embodiments, $G^2$ is optionally substituted —CH(-L"-R)$_2$, wherein each of L" and R is independently as described in the present disclosure. In some embodiments, $G^2$ is optionally substituted —CH(—S—R)$_2$. In some embodiments, $G^2$ is optionally substituted —$CH_2$—S—R. In some embodiments, the two R groups are taken together with their intervening atoms to form a ring. In some embodiments, a formed ring is an optionally substituted 5,6,7-membered ring having 0-2 heteroatoms in addition to the intervening heteroatoms. In some embodiments, $G^2$ is optionally substituted

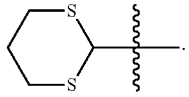 [SMILES: *C1SCCCS1]

In some embodiments, $G^2$ is

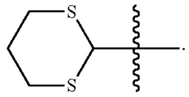

In some embodiments, —S— may be converted to —S(O)— or —$S(O)_2$—, e.g., by oxidation, e.g., to facilitate removal by a base.

In some embodiments, $G^2$ is -L'-R', wherein each variable is as described in the present disclosure. In some embodiments, $G^2$ is —$CH_2$—R'. In some embodiments, $G^2$ is —CH$(R')_2$. In some embodiments, $G^2$ is —C$(R')_3$. In some embodiments, R' is optionally substituted aryl or heteroaryl. In some embodiments, R' is substituted aryl or heteroaryl wherein one or more substituents are independently an electron-withdrawing group. In some embodiments, -L'- is optionally substituted —$CH_2$—, and R' is R, wherein R is optionally substituted aryl or heteroaryl. In some embodiments, R is substituted aryl or heteroaryl wherein one or more substituents are independently an electron-withdrawing group. In some embodiments, R is substituted aryl or heteroaryl wherein each substituent is independently an electron-withdrawing group. In some embodiments, R is aryl or heteroaryl substituted with two or more substituents, wherein each substituent is independently an electron-withdrawing group. In some embodiments, an electron-withdrawing group is —CN, —$NO_2$, halogen, —C(O)$R^1$, —C(O)OR', —C(O)N$(R')_2$, —S(O)$R^1$, —$S(O)_2R^1$, —P(W)$(R^1)_2$, —P(O)$(R^1)_2$, —P(O)$(OR')_2$, or —P(S)$(R^1)_2$. In some embodiments, R' is

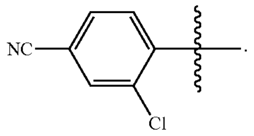

In some embodiments, R' is p-$NO_2$Ph-. In some embodiments, R' is

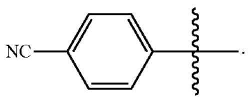 [SMILES: *c1ccc(C#N)cc1]

In some embodiments, R' is

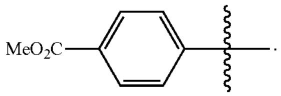

In some embodiments, R' is

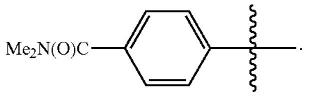

In some embodiments, R' is

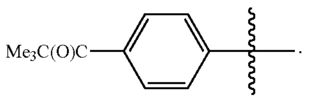

In some embodiments, R' is

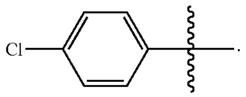

In some embodiments, $G^2$ is

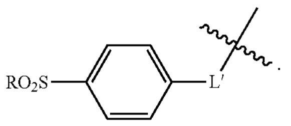

In some embodiments, R' is

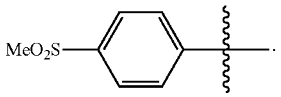

In some embodiments, R' is

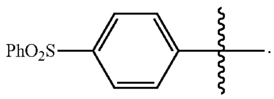

In some embodiments, R' is 2,4,6-trichlorophenyl. In some embodiments, R' is 2,4,6-trifluorophenyl. In some embodiments, $G^2$ is —CH(4-chlorophenyl)$_2$. In some embodiments, $G^2$ is —CH(R')$_2$, wherein each R' is

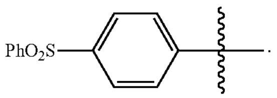

In some embodiments, $G^2$ is —CH(R')$_2$, wherein each R' is

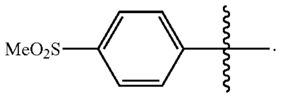 [SMILES: *c1ccc(S(C)(=O)=O)cc1]

In some embodiments, R' is —C(O)R. In some embodiments, R' is $CH_3C(O)$—.

In some embodiments, $G^2$ is -L'—S(O)$_2$R', wherein each variable is as described in the present disclosure. In some embodiments, $G^2$ is —$CH_2$—S(O)$_2$R'. In some embodiments, $G^2$ is -L'—S(O)R', wherein each variable is as described in the present disclosure. In some embodiments, $G^2$ is —$CH_2$—S(O)R'. In some embodiments, $G^2$ is -L'—C(O)$_2$R', wherein each variable is as described in the present disclosure. In some embodiments, $G^2$ is —$CH_2$—C(O)$_2$R'. In some embodiments, $G^2$ is -L'—C(O)R', wherein each variable is as described in the present disclosure. In some embodiments, $G^2$ is —$CH_2$—C(O)R'. In some embodiments, -L'- is optionally substituted —$CH_2$—, and R' is R. In some embodiments, R is optionally substituted aryl or heteroaryl. In some embodiments, R is optionally substituted aliphatic. In some embodiments, R is optionally substituted heteroaliphatic. In some embodiments, R is optionally substituted heteroaryl. In some embodiments, R is optionally substituted aryl. In some embodiments, R is optionally substituted phenyl. In some embodiments, R is not phenyl, or mono-, di- or tri-substituted phenyl, wherein each substituent is selected from —$NO_2$, halogen, —CN, —$C_{1-3}$ alkyl, and $C_{1-3}$ alkyloxy. In some embodiments, R is substituted aryl or heteroaryl wherein one or more substituents are independently an electron-withdrawing group. In some embodiments, R is substituted aryl or heteroaryl wherein each substituent is independently an electron-withdrawing group. In some embodiments, R is aryl or heteroaryl substituted with two or more substituents, wherein each substituent is independently an electron-withdrawing group. In some embodiments, an electron-withdrawing group is —CN, —$NO_2$, halogen, —C(O)$R^1$, —C(O)OR', —C(O)N(R')$_2$, —S(O)$R^1$, —S(O)$_2R^1$, —P(W)($R^1$)$_2$, —P(O)($R^1$)$_2$, —P(O)(OR')$_2$, or —P(S)($R^1$)$_2$. In some embodiments, R' is phenyl. In some embodiments, R' is substituted phenyl. In some embodiments, R' is

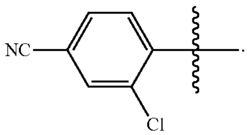 [SMILES: *c1ccc(C#N)cc1Cl]

In some embodiments, R' is

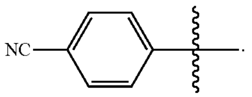 [SMILES: *c1ccc(C#N)cc1]

In some embodiments, R' is

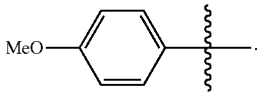 [SMILES: *c1ccc(OC)cc1]

In some embodiments, R' is optionally substituted $C_{1-6}$ aliphatic. In some embodiments, R' is t-butyl. In some embodiments, R' is isopropyl. In some embodiments, R' is methyl. In some embodiments, $G^2$ is —$CH_2C(O)OMe$. In some embodiments, $G^2$ is —$CH_2C(O)Ph$. In some embodiments, $G^2$ is —$CH_2C(O)$-tBu.

In some embodiments, $G^2$ is -L'—$NO_2$. In some embodiments, $G^2$ is —$CH_2$—$NO_2$. In some embodiments, $G^2$ is -L'—$S(O)_2N(R')_2$. In some embodiments, $G^2$ is —$CH_2$—$S(O)_2N(R')_2$. In some embodiments, $G^2$ is -L'—$S(O)_2NHR'$. In some embodiments, $G^2$ is —$CH_2$—$S(O)_2NHR'$. In some embodiments, R' is methyl. In some embodiments, $G^2$ is —$CH_2$—$S(O)_2NH(CH_3)$. In some embodiments, R' is —$CH_2Ph$. In some embodiments, $G^2$ is —$CH_2$—$S(O)_2NH(CH_2Ph)$. In some embodiments, $G^2$ is —$CH_2$—$S(O)_2N(CH_2Ph)_2$. In some embodiments, R' is phenyl. In some embodiments, $G^2$ is —$CH_2$—$S(O)_2NHPh$. In some embodiments, $G^2$ is —$CH_2$—$S(O)_2N(CH_3)Ph$. In some embodiments, $G^2$ is —$CH_2$—$S(O)_2N(CH_3)_2$. In some embodiments, $G^2$ is —$CH_2$—$S(O)_2NH(CH_2Ph)$. In some embodiments, $G^2$ is —$CH_2$—$S(O)_2NHPh$. In some embodiments, $G^2$ is —$CH_2$—$S(O)_2NH(CH_2Ph)$. In some embodiments, $G^2$ is —$CH_2$—$S(O)_2N(CH_3)_2$. In some embodiments, $G^2$ is —$CH_2$—$S(O)_2N(CH_3)Ph$. In some embodiments, $G^2$ is -L'—$S(O)_2N(R')(OR')$. In some embodiments, $G^2$ is —$CH_2$—$S(O)_2N(R')(OR')$. In some embodiments, each R' is methyl. In some embodiments, $G^2$ is —$CH_2$—$S(O)_2N(CH_3)(OCH_3)$. In some embodiments, $G^2$ is —$CH_2$—$S(O)_2N(Ph)(OCH_3)$. In some embodiments, $G^2$ is —$CH_2$—$S(O)_2N(CH_2Ph)(OCH_3)$. In some embodiments, $G^2$ is —$CH_2$—$S(O)_2N(CH_2Ph)(OCH_3)$. In some embodiments, $G^2$ is -L'—$S(O)_2OR'$. In some embodiments, $G^2$ is —$CH_2$—$S(O)_2OR'$. In some embodiments, $G^2$ is —$CH_2$—$S(O)_2OPh$. In some embodiments, $G^2$ is —$CH_2$—$S(O)_2OCH_3$. In some embodiments, $G^2$ is —$CH_2$—$S(O)_2OCH_2Ph$.

In some embodiments, $G^2$ is -L'—$P(O)(R')_2$. In some embodiments, $G^2$ is —$CH_2$—$P(O)(R')_2$. In some embodiments, $G^2$ is -L'—$P(O)[N(R')_2]_2$. In some embodiments, $G^2$ is —$CH_2$—$P(O)[N(R')_2]_2$. In some embodiments, $G^2$ is -L'—$P(O)[O(R')_2]_2$. In some embodiments, $G^2$ is —$CH_2$—$P(O)[O(R')_2]_2$. In some embodiments, $G^2$ is -L'—$P(O)(R')[N(R')_2]_2$. In some embodiments, $G^2$ is —$CH_2$—$P(O)(R')[N(R')_2]$. In some embodiments, $G^2$ is -L'—$P(O)(R')[O(R')]$. In some embodiments, $G^2$ is —$CH_2$—$P(O)(R')[O(R')]$. In some embodiments, $G^2$ is -L'—$P(O)(OR')[N(R')_2]$. In some embodiments, $G^2$ is —$CH_2$—$P(O)(OR')[N(R')_2]$. In some embodiments, $G^2$ is -L'—$C(O)N(R')_2$, wherein each variable is as described in the present disclosure. In some embodiments, $G^2$ is —$CH_2$—$C(O)N(R')_2$. In some embodiments, each R' is independently R. In some embodiments, one R' is optionally substituted aliphatic, and one R is optionally substituted aryl. In some embodiments, one R' is optionally substituted $C_{1-6}$ aliphatic, and one R is optionally substituted phenyl. In some embodiments, each R' is independently optionally substituted $C_{1-6}$ aliphatic. In some embodiments, $G^2$ is —$CH_2$—$P(O)(CH_3)Ph$. In some embodiments, $G^2$ is —$CH_2$—$P(O)(CH_3)_2$. In some embodiments, $G^2$ is —$CH_2$—$P(O)(Ph)_2$. In some embodiments, $G^2$ is —$CH_2$—$P(O)(OCH_3)_2$. In some embodiments, $G^2$ is —$CH_2$—$P(O)(CH_2Ph)_2$. In some embodiments, $G^2$ is —$CH_2$—$P(O)[N(CH_3)Ph]_2$. In some embodiments, $G^2$ is —$CH_2$—$P(O)[N(CH_3)_2]_2$. In some embodiments, $G^2$ is —$CH_2$—$P(O)[N(CH_2Ph)_2]_2$. In some embodiments, $G^2$ is —$CH_2$—$P(O)(OCH_3)_2$. In some embodiments, $G^2$ is —$CH_2$—$P(O)(OPh)_2$.

In some embodiments, $G^2$ is -L'—SR'. In some embodiments, $G^2$ is —$CH_2$—SR'. In some embodiments, R' is optionally substituted phenyl. In some embodiments, R' is phenyl.

In some embodiments, a provided chiral reagent has the structure of

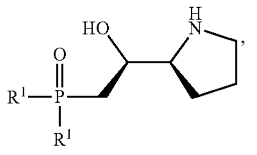

wherein each $R^1$ is independently as described in the present disclosure. In some embodiments, a provided chiral reagent has the structure of

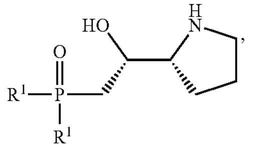

wherein each $R^1$ is independently as described in the present disclosure. In some embodiments, each $R^1$ is independently R as described in the present disclosure. In some embodiments, each $R^1$ is independently R, wherein R is optionally substituted aliphatic, aryl, heteroaliphatic, or heteroaryl as described in the present disclosure. In some embodiments, each $R^1$ is phenyl. In some embodiments, $R^1$ is -L-R'. In some embodiments, $R^1$ is -L-R', wherein L is —O—, —S—, or —N(R'). In some embodiments, a provided chiral reagent has the structure of

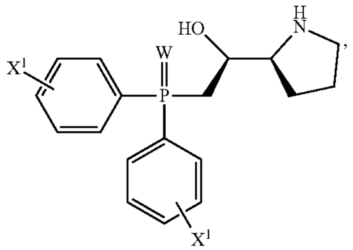

wherein each $X^1$ is independently —H, an electron-withdrawing group, —$NO_2$, —CN, —OR, —Cl, —Br, or —F, and W is O or S. In some embodiments, a provided chiral reagent has the structure of

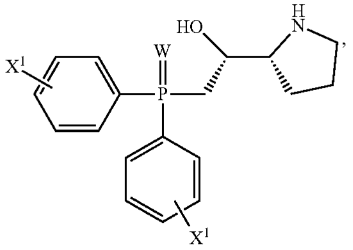

wherein each $X^1$ is independently —H, an electron-withdrawing group, —$NO_2$, —CN, —OR, —Cl, —Br, or —F, and W is O or S. In some embodiments, each $X^1$ is independently —CN, —OR, —Cl, —Br, or —F, wherein R is not —H. In some embodiments, R is optionally substituted $C_{1-6}$ aliphatic. In some embodiments, R is optionally substituted $C_{1-6}$ alkyl. In some embodiments, R is —$CH_3$. In some embodiments, one or more $X^1$ are independently electron-withdrawing groups (e.g., —CN, —$NO_2$, halogen, —C(O)$R^1$, —C(O)OR', —C(O)N(R')$_2$, —S(O)$R^1$, —S(O)$_2$ $R^1$, —P(W)($R^1$)$_2$, —P(O)($R^1$)$_2$, —P(O)(OR')$_2$, —P(S)($R^1$)$_2$, etc.).

In some embodiments, a provided chiral reagent has the structure of

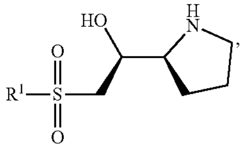

wherein $R^1$ is as described in the present disclosure. In some embodiments, a provided chiral reagent has the structure of

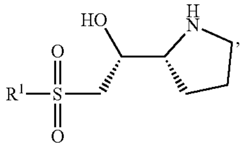

wherein $R^1$ is as described in the present disclosure. In some embodiments, $R^1$ is R as described in the present disclosure. In some embodiments, $R^1$ is R, wherein R is optionally substituted aliphatic, aryl, heteroaliphatic, or heteroaryl as described in the present disclosure. In some embodiments, $R^1$ is -L-R'. In some embodiments, $R^1$ is -L-R', wherein L is —O—, —S—, or —N(R'). In some embodiments, a provided chiral reagent has the structure of

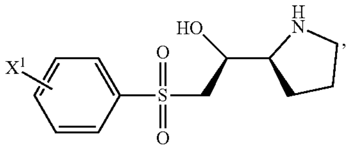

wherein $X^1$ is —H, an electron-withdrawing group, —$NO_2$, —CN, —OR, —Cl, —Br, or —F, and W is O or S. In some embodiments, a provided chiral reagent has the structure of

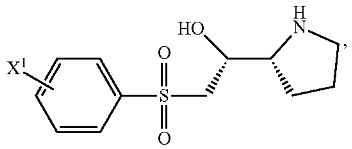

wherein $X^1$ is —H, an electron-withdrawing group, —$NO_2$, —CN, —OR, —Cl, —Br, or —F, and W is O or S. In some embodiments, $X^1$ is —CN, —OR, —Cl, —Br, or —F, wherein R is not —H. In some embodiments, R is optionally substituted $C_{1-6}$ aliphatic. In some embodiments, R is optionally substituted $C_{1-6}$ alkyl. In some embodiments, R is —$CH_3$. In some embodiments, $X^1$ is an electron-withdrawing group (e.g., —CN, —$NO_2$, halogen, —C(O)$R^1$, —C(O) OR', —C(O)N(R')$_2$, —S(O)$R^1$, —S(O)$_2R^1$, —P(W)($R^1$)$_2$, —P(O)($R^1$)$_2$, —P(O)(OR')$_2$, —P(S)($R^1$)$_2$, etc.). In some embodiments, $X^1$ is an electron-withdrawing group that is not —CN, —$NO_2$, or halogen. In some embodiments, $X^1$ is not —H, —CN, —$NO_2$, halogen, or $C_{1-3}$ alkyloxy.

In some embodiments, $G^2$ is —CH($R^{21}$)—CH($R^{22}$)═C ($R^{23}$)($R^{24}$), wherein each of $R^{21}$, $R^{22}$, $R^{23}$, and $R^{24}$ is independently R. In some embodiments, $R^{22}$ and $R^{23}$ are both R, and the two R groups are taken together with their intervening atoms to form an optionally substituted aryl or heteroaryl ring as described herein. In some embodiments, one or more substituents are independently electron-withdrawing groups. In some embodiments, $R^{21}$ and $R^{24}$ are both R, and the two R groups are taken together with their intervening atoms to form an optionally substituted ring as described herein. In some embodiments, $R^{21}$ and $R^{24}$ are both R, and the two R groups are taken together with their intervening atoms to form an optionally substituted saturated or partially saturated ring as described herein. In some embodiments, $R^{22}$ and $R^{23}$ are both R, and the two R groups are taken together with their intervening atoms to form an optionally substituted aryl or heteroaryl ring as described herein, and $R^{21}$ and $R^{24}$ are both R, and the two R groups are taken together with their intervening atoms to form an optionally substituted partially saturated ring as described herein. In some embodiments, $R^{21}$ is —H. In some embodiments, $R^{24}$ is —H. In some embodiments, $G^2$ is optionally substituted

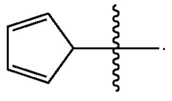

In some embodiments, $G^2$ is optionally substituted

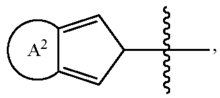

,

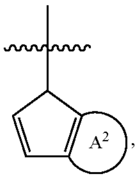

, or

-continued

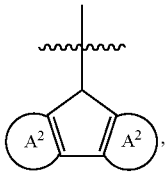
, wherein each Ring $A^2$ is independently a 3-15 membered monocyclic, bicyclic or polycyclic ring as described herein. In some embodiments, Ring $A^2$ is an optionally substituted 5-10 membered monocyclic aryl or heteroaryl ring having 1-5 heteroatoms as described herein. In some embodiments, Ring $A^2$ is an optionally substituted phenyl ring as described herein. In some embodiments, In some embodiments, $G^2$ is optionally substituted

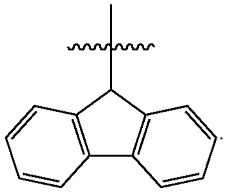 [SMILES: *C1c2ccccc2-c2ccccc21]
.

In some embodiments, $G^2$ is

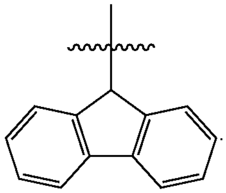 [SMILES: *C1c2ccccc2-c2ccccc21]
.

In some embodiments, $G^2$ is

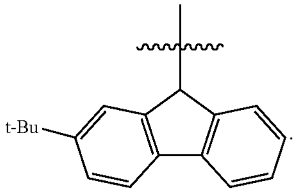 [SMILES: *C1c2ccccc2-c2ccc(C(C)(C)C)cc21]
.

In some embodiments, $G^2$ is

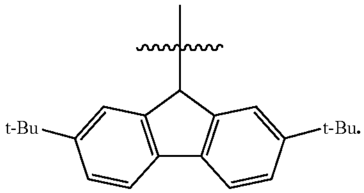 [SMILES: *C1c2cc(C(C)(C)C)ccc2-c2ccc(C(C)(C)C)cc21]
.

Certain useful example compounds for chiral auxiliaries are presented in, e.g., Tables CA-1 to CA-13. In some embodiments, a useful compound is an enantiomer of a compound in, e.g., Tables CA-1 to CA-13. In some embodiments, a useful compound is a diastereomer of a compound in, e.g., Tables CA-1 to CA-13. In some embodiments, a compound useful for chiral auxiliaries for removal under basic conditions (e.g., by a base under an anhydrous condition) is a compound of Tables CA-1 to CA-13, or an enantiomer or a diastereomer thereof. In some embodiments, such a compound is a compound of Table CA-1 or an enantiomer or a diastereomer thereof. In some embodiments, such a compound is a compound of Table CA-2 or an enantiomer or a diastereomer thereof. In some embodiments, such a compound is a compound of Table CA-3 or an enantiomer or a diastereomer thereof. In some embodiments, such a compound is a compound of Table CA-4 or an enantiomer or a diastereomer thereof. In some embodiments, such a compound is a compound of Table CA-5 or an enantiomer or a diastereomer thereof. In some embodiments, such a compound is a compound of Table CA-6 or an enantiomer or a diastereomer thereof. In some embodiments, such a compound is a compound of Table CA-7 or an enantiomer or a diastereomer thereof. In some embodiments, such a compound is a compound of Table CA-8 or an enantiomer or a diastereomer thereof. In some embodiments, such a compound is a compound of Table CA-9 or an enantiomer or a diastereomer thereof. In some embodiments, such a compound is a compound of Table CA-10 or an enantiomer or a diastereomer thereof. In some embodiments, such a compound is a compound of Table CA-11 or an enantiomer or a diastereomer thereof. In some embodiments, such a compound is a compound of Table CA-12 or an enantiomer or a diastereomer thereof. In some embodiments, such a compound is a compound of Table CA-13 or an enantiomer or a diastereomer thereof.

In some embodiments, when contacted with a base, a chiral auxiliary moiety, e.g., of an internucleotidic linkage, whose corresponding compound is a compound of Formula 3-I or 3-AA may be released as an alkene, which has the same structure as a product formed by elimination of a water molecule from the corresponding compound (elimination of $-W^2-H=-OH$ and an alpha-H of $G^2$). In some embodiments, such an alkene has the structure of (electron-withdrawing group)$_2$=C($R^1$)-L-N($R^5$)($R^6$), (electron-withdrawing group)H=C($R^1$)-L-N($R^5$)($R^6$), CH(-L"-R')=C($R^1$)-L-N($R^5$)($R^6$) wherein the CH group is optionally substituted, or $C^x$=C($R^1$)-L-N($R^5$)($R^6$), wherein $C^x$ is optionally substituted

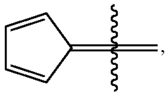 [SMILES: *=C1C=CC=C1]
, and may be optionally fused with one or more optionally substituted rings, and each other variable is independently as described herein. In some embodiments, $C^x$ is optionally substituted

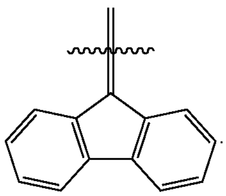 [SMILES: *=C1c2ccccc2-c2ccccc21]
.

In some embodiments, $C^{\alpha}$ is

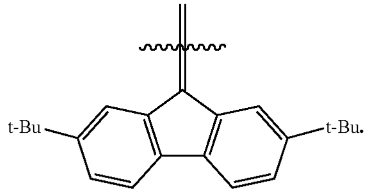 [SMILES: *=C1c2cc(C(C)(C)C)ccc2-c2ccc(C(C)(C)C)cc21]

In some embodiments, such an alkene is

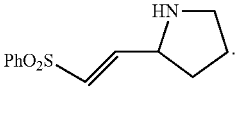

In some embodiments, such an alkene is

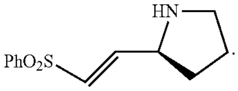

In some embodiments, such an alkene is

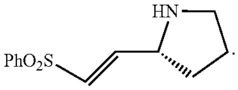

In some embodiments, a chiral reagent is an aminoalcohol. In some embodiments, a chiral reagent is an aminothiol. In some embodiments, a chiral reagent is an aminophenol. In some embodiments, a chiral reagent is (S)- and (R)-2-methylamino-1-phenylethanol, (1R,2S)-ephedrine, or (1R, 2S)-2-methylamino-1,2-diphenylethanol.

In some embodiments of the disclosure, a chiral reagent is a compound of one of the following formulae:

Formula O

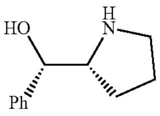

Formula P

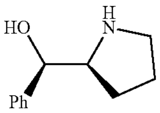

Formula Q

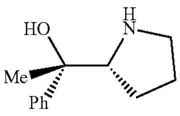

Formula R

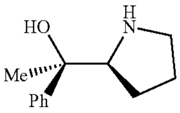

-continued

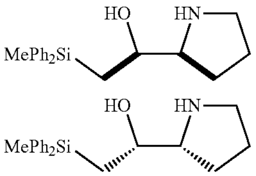

DPSE.

In some embodiments, a useful chiral reagent is a compound selected from the compounds below, or its related stereoisomer, particularly enantiomer (e.g., WV-CA-237 is a related stereoisomer of WV-CA-236 (a related diastereomer, having the same constitution, the same configuration at one chiral center but not the other); WV-CA-108 is a related enantiomer of WV-CA-236 (mirror image of each other)):

TABLE CA-1

| Example chiral auxiliaries. | |
|---|---|
| WV-CA-231 | 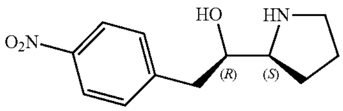 |
| WV-CA-232 | 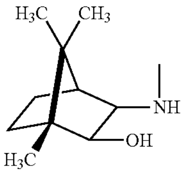 |
| WV-CA-233 | 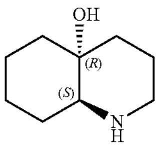 |
| WV-CA-234 | 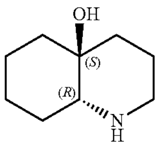 |
| WV-CA-235 | 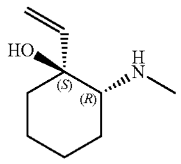 |
| WV-CA-236 | 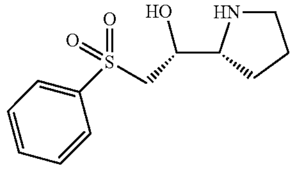 [SMILES: O=S(=O)(C[C@H](O)[C@H]1CCCN1)c1ccccc1] |

TABLE CA-1-continued
Example chiral auxiliaries.
WV-CA-237
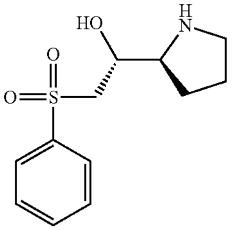 [SMILES: O=S(=O)(C[C@H](O)[C@@H]1CCCN1)c1ccccc1]
WV-CA-238
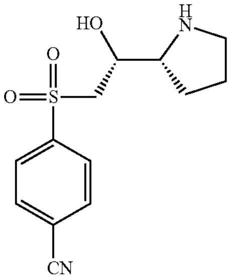 [SMILES: N#Cc1ccc(S(=O)(=O)C[C@H](O)[C@H]2CCCN2)cc1]
WV-CA-239
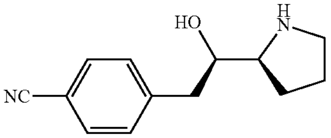 [SMILES: N#Cc1ccc(C[C@@H](O)[C@@H]2CCCN2)cc1]
WV-CA-240
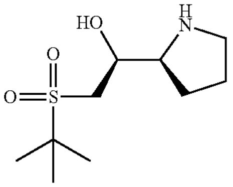
WV-CA-241
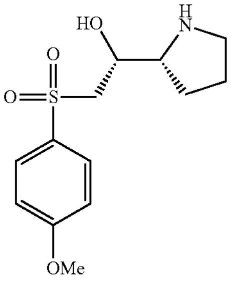 [SMILES: COc1ccc(S(=O)(=O)C[C@H](O)[C@H]2CCCN2)cc1]
WV-CA-242
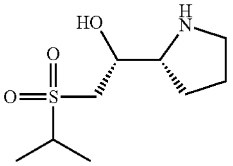
WV-CA-243
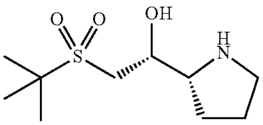
TABLE CA-1-continued
Example chiral auxiliaries.
WV-CA-244
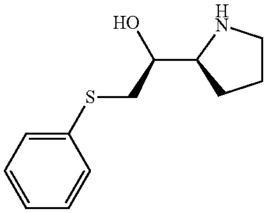 [SMILES: O[C@H](CSc1ccccc1)[C@@H]1CCCN1]
WV-CA-245
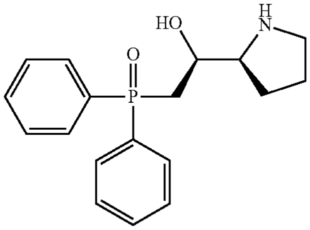 [SMILES: O=P(C[C@@H](O)[C@@H]1CCCN1)(c1ccccc1)c1ccccc1]
WV-CA-246
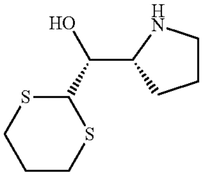 [SMILES: O[C@@H](C1SCCCS1)[C@H]1CCCN1]
WV-CA-247
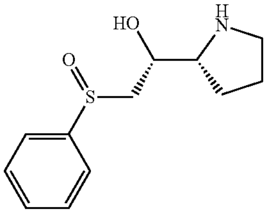 [SMILES: O=S(C[C@H](O)[C@H]1CCCN1)c1ccccc1]
WV-CA-248
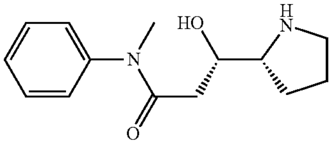 [SMILES: CN(C(=O)C[C@H](O)[C@H]1CCCN1)c1ccccc1]
WV-CA-249
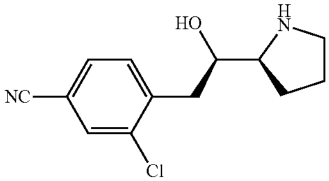 [SMILES: N#Cc1ccc(C[C@@H](O)[C@@H]2CCCN2)c(Cl)c1]
WV-CA-250
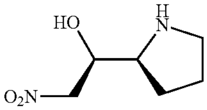 [SMILES: O=[N+]([O-])C[C@@H](O)[C@@H]1CCCN1]
WV-CA-251
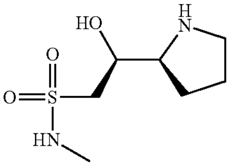

TABLE CA-1-continued
| Example chiral auxiliaries. | |
|---|---|
| WV-CA-252 | 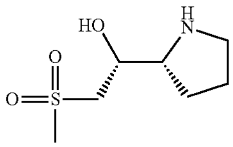 |
| WV-CA-253 | 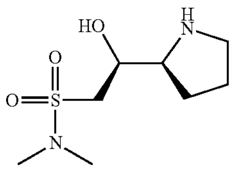 |
| WV-CA-254 | 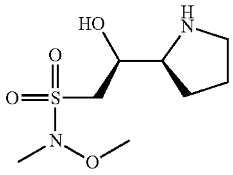 |
| WV-CA-255 | 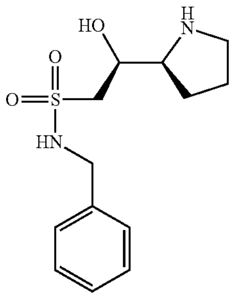 [SMILES: O=S(=O)(C[C@@H](O)[C@@H]1CCCN1)NCc1ccccc1] |
| WV-CA-256 | 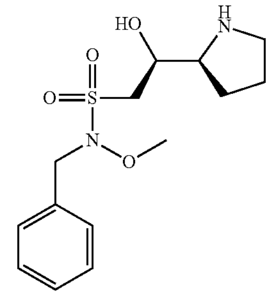 [SMILES: CON(Cc1ccccc1)S(=O)(=O)C[C@@H](O)[C@@H]1CCCN1] |
| WV-CA-257 | 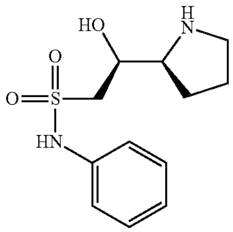 [SMILES: O=S(=O)(C[C@@H](O)[C@@H]1CCCN1)Nc1ccccc1] |
| WV-CA-258 | 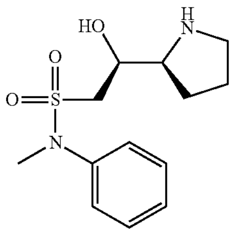 [SMILES: CN(c1ccccc1)S(=O)(=O)C[C@@H](O)[C@@H]1CCCN1] |
TABLE CA-1-continued
| Example chiral auxiliaries. | |
|---|---|
| WV-CA-259 | 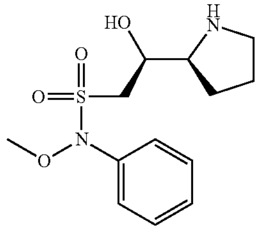 [SMILES: CON(c1ccccc1)S(=O)(=O)C[C@@H](O)[C@@H]1CCCN1] |
| WV-CA-260 | 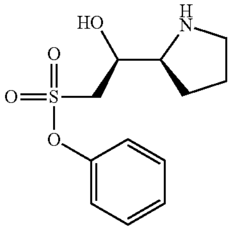 [SMILES: O=S(=O)(C[C@@H](O)[C@@H]1CCCN1)Oc1ccccc1] |
| WV-CA-261 | 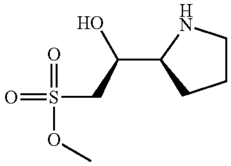 |
| WV-CA-262 | 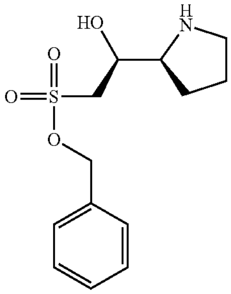 [SMILES: O=S(=O)(C[C@@H](O)[C@@H]1CCCN1)OCc1ccccc1] |
| WV-CA-263 | 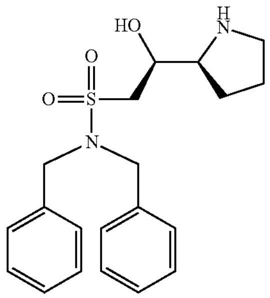 [SMILES: O=S(=O)(C[C@@H](O)[C@@H]1CCCN1)N(Cc1ccccc1)Cc1ccccc1] |
| WV-CA-264 | 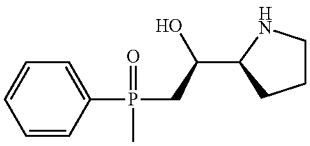 [SMILES: CP(=O)(C[C@@H](O)[C@@H]1CCCN1)c1ccccc1] |
| WV-CA-265 | 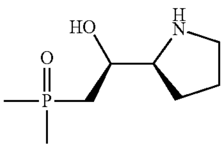 |

TABLE CA-1-continued
| Example chiral auxiliaries. | |
|---|---|
| WV-CA-266 | 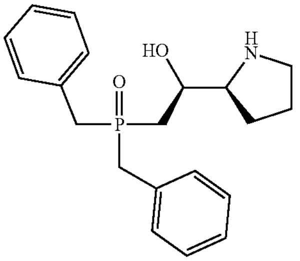 [SMILES: O=P(Cc1ccccc1)(Cc1ccccc1)C[C@@H](O)[C@@H]1CCCN1] |
| WV-CA-267 | 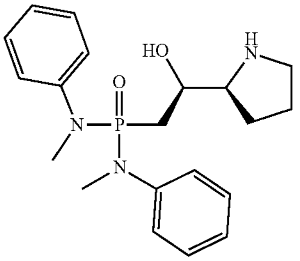 |
| WV-CA-268 | 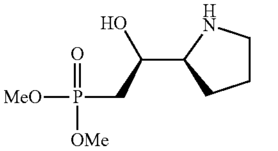 |
| WV-CA-269 | 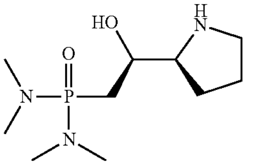 |
| WV-CA-270 | 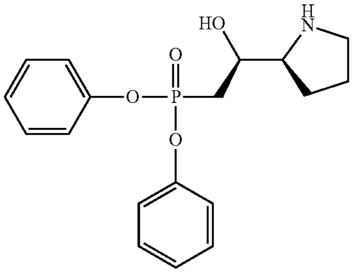 |
| WV-CA-271 | 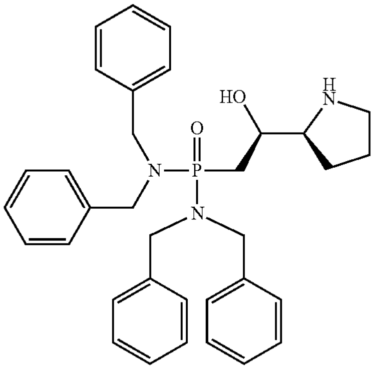 [SMILES: O=P(C[C@@H](O)[C@@H]1CCCN1)(N(Cc1ccccc1)Cc1ccccc1)N(Cc1ccccc1)Cc1ccccc1] |
TABLE CA-1-continued
| Example chiral auxiliaries. | |
|---|---|
| WV-CA-272 | 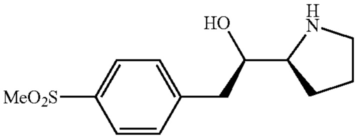 [SMILES: CS(=O)(=O)c1ccc(C[C@@H](O)[C@@H]2CCCN2)cc1] |
| WV-CA-273 | 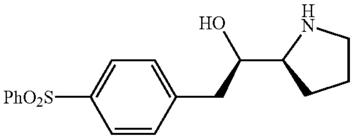 |
| WV-CA-274 | 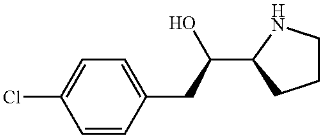 [SMILES: O[C@H](Cc1ccc(Cl)cc1)[C@@H]1CCCN1] |
| WV-CA-275 | 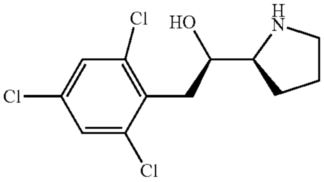 [SMILES: O[C@H](Cc1c(Cl)cc(Cl)cc1Cl)[C@@H]1CCCN1] |
| WV-CA-276 | 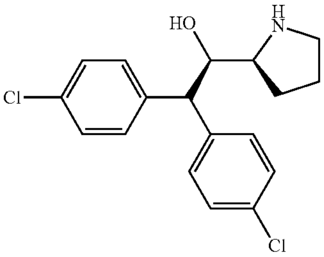 [SMILES: O[C@H](C(c1ccc(Cl)cc1)c1ccc(Cl)cc1)[C@@H]1CCCN1] |
| WV-CA-277 | 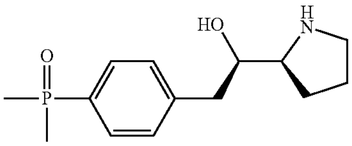 [SMILES: CP(C)(=O)c1ccc(C[C@@H](O)[C@@H]2CCCN2)cc1] |
| WV-CA-278 | 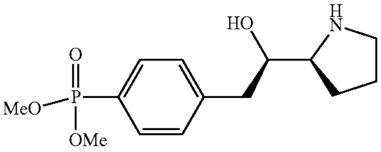 |
| WV-CA-279 | 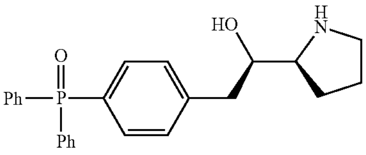 [SMILES: O=P(c1ccccc1)(c1ccccc1)c1ccc(C[C@@H](O)[C@@H]2CCCN2)cc1] |

TABLE CA-1-continued
| Example chiral auxiliaries. | |
|---|---|
| WV-CA-280 | 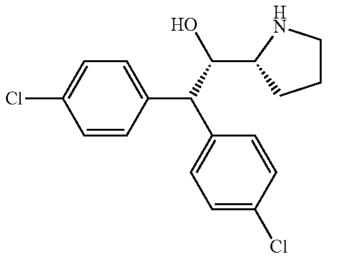 [SMILES: O[C@@H](C(c1ccc(Cl)cc1)c1ccc(Cl)cc1)[C@H]1CCCN1] |
| WV-CA-281 | 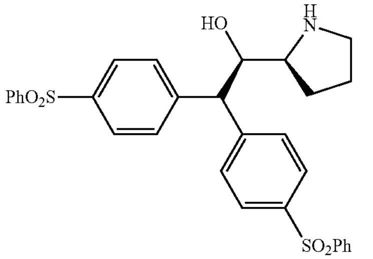 |
| WV-CA-282 | 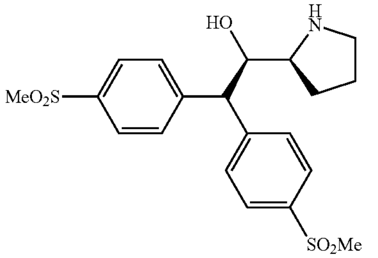 [SMILES: CS(=O)(=O)c1ccc(C(c2ccc(S(C)(=O)=O)cc2)[C@@H](O)[C@@H]2CCCN2)cc1] |
| WV-CA-283 | 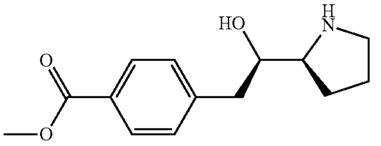 [SMILES: COC(=O)c1ccc(C[C@@H](O)[C@@H]2CCCN2)cc1] |
| WV-CA-284 | 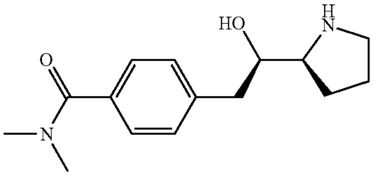 [SMILES: CN(C)C(=O)c1ccc(C[C@@H](O)[C@@H]2CCCN2)cc1] |
| WV-CA-285 | 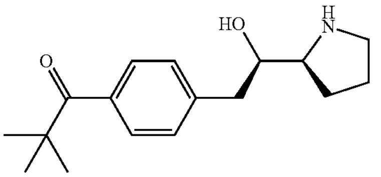 [SMILES: CC(C)(C)C(=O)c1ccc(C[C@@H](O)[C@@H]2CCCN2)cc1] |
| WV-CA-286 | 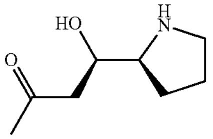 |
TABLE CA-1-continued
| Example chiral auxiliaries. | |
|---|---|
| WV-CA-287 | 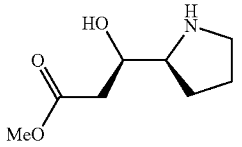 [SMILES: COC(=O)C[C@@H](O)[C@@H]1CCCN1] |
| WV-CA-288 | 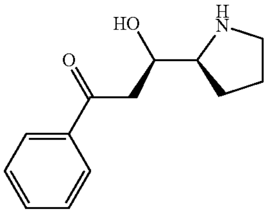 [SMILES: O=C(C[C@@H](O)[C@@H]1CCCN1)c1ccccc1] |
| WV-CA-289 | 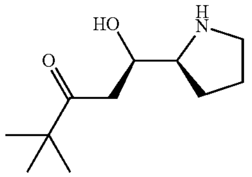 |
| WV-CA-290 | 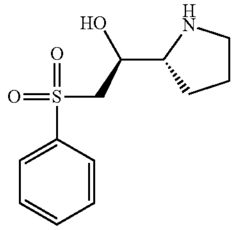 [SMILES: O=S(=O)(C[C@@H](O)[C@H]1CCCN1)c1ccccc1] |
| WV-CA-291 | 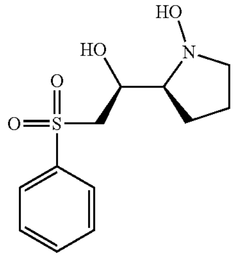 [SMILES: O=S(=O)(C[C@@H](O)[C@@H]1CCCN1O)c1ccccc1] |
| WV-CA-293 | 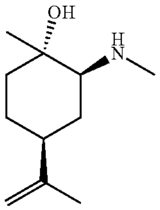 |
| WV-CA-294 | 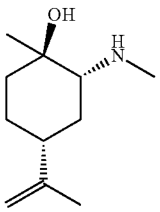 |
In some embodiments, a provided compound is an enantiomer of a compound selected from Table CA-1 or a salt thereof. In some embodiments, a provided compound is a diastereomer of a compound selected from Table CA-1 or a salt thereof.

In some embodiments, a useful chiral reagent is a compound selected from the compounds below, or its related stereoisomer, particularly enantiomer:

TABLE CA-2

| Example chiral auxiliaries. | |
|---|---|
| WV-CA-231 | 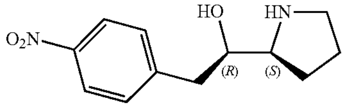 |
| WV-CA-239 | 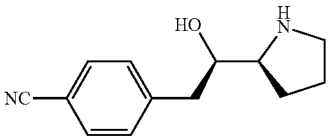 [SMILES: N#Cc1ccc(C[C@@H](O)[C@@H]2CCCN2)cc1] |
| WV-CA-249 | 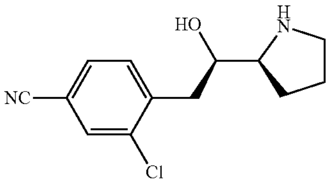 [SMILES: N#Cc1ccc(C[C@@H](O)[C@@H]2CCCN2)c(Cl)c1] |
| WV-CA-272 | 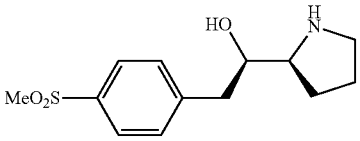 [SMILES: CS(=O)(=O)c1ccc(C[C@@H](O)[C@@H]2CCCN2)cc1] |
| WV-CA-273 | 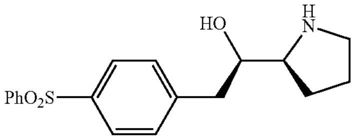 |
| WV-CA-274 | 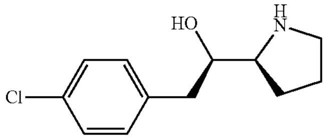 [SMILES: O[C@H](Cc1ccc(Cl)cc1)[C@@H]1CCCN1] |
| WV-CA-275 | 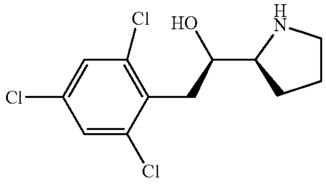 [SMILES: O[C@H](Cc1c(Cl)cc(Cl)cc1Cl)[C@@H]1CCCN1] |
| WV-CA-276 | 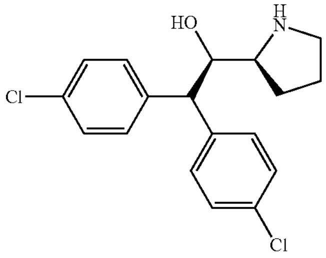 [SMILES: O[C@H](C(c1ccc(Cl)cc1)c1ccc(Cl)cc1)[C@@H]1CCCN1] |

TABLE CA-2-continued

| Example chiral auxiliaries. | |
|---|---|
| WV-CA-277 | 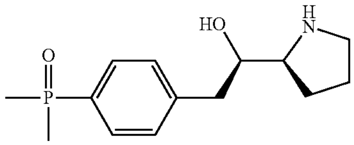 [SMILES: CP(C)(=O)c1ccc(C[C@@H](O)[C@@H]2CCCN2)cc1] |
| WV-CA-278 | 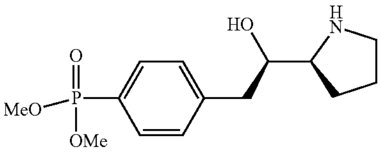 |
| WV-CA-279 | 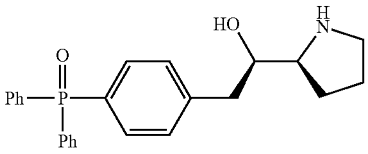 [SMILES: O=P(c1ccccc1)(c1ccccc1)c1ccc(C[C@@H](O)[C@@H]2CCCN2)cc1] |
| WV-CA-280 | 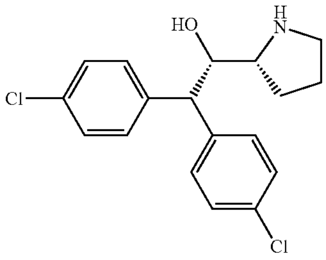 [SMILES: O[C@@H](C(c1ccc(Cl)cc1)c1ccc(Cl)cc1)[C@H]1CCCN1] |
| WV-CA-281 | 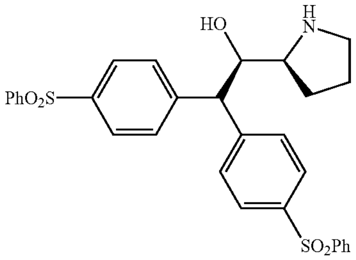 |
| WV-CA-282 | 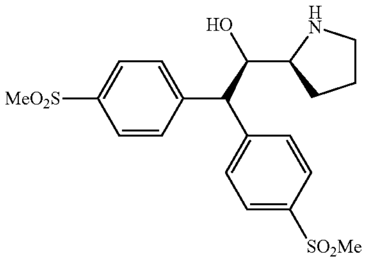 [SMILES: CS(=O)(=O)c1ccc(C(c2ccc(S(C)(=O)=O)cc2)[C@@H](O)[C@@H]2CCCN2)cc1] |
| WV-CA-283 | 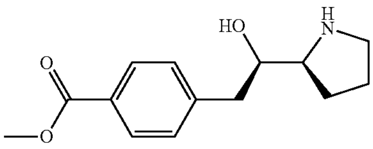 [SMILES: COC(=O)c1ccc(C[C@@H](O)[C@@H]2CCCN2)cc1] |

TABLE CA-2-continued

| Example chiral auxiliaries. | |
|---|---|
| WV-CA-284 | 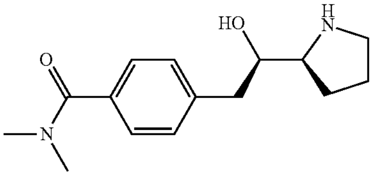 [SMILES: CN(C)C(=O)c1ccc(C[C@@H](O)[C@@H]2CCCN2)cc1] |
| WV-CA-285 | 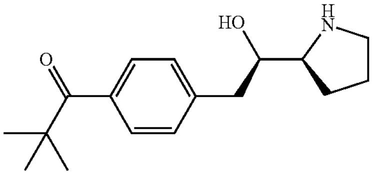 [SMILES: CC(C)(C)C(=O)c1ccc(C[C@@H](O)[C@@H]2CCCN2)cc1] |

In some embodiments, a provided compound is an enantiomer of a compound selected from Table CA-2 or a salt thereof. In some embodiments, a provided compound is a diastereomer of a compound selected from Table CA-2 or a salt thereof.

In some embodiments, a useful chiral reagent is a compound selected from the compounds below, or its related stereoisomer, particularly enantiomer:

TABLE CA-3

| Example chiral auxiliaries. | |
|---|---|
| WV-CA-236 | 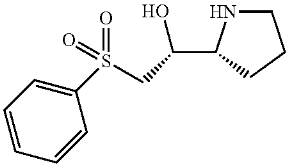 [SMILES: O=S(=O)(C[C@H](O)[C@H]1CCCN1)c1ccccc1] |
| WV-CA-237 | 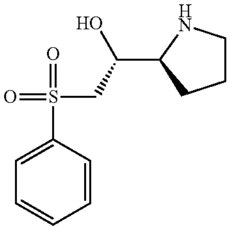 [SMILES: O=S(=O)(C[C@H](O)[C@@H]1CCCN1)c1ccccc1] |
| WV-CA-238 | 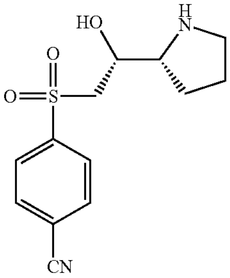 [SMILES: N#Cc1ccc(S(=O)(=O)C[C@H](O)[C@H]2CCCN2)cc1] |
| WV-CA-240 | 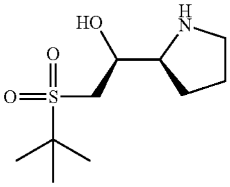 |

TABLE CA-3-continued

| Example chiral auxiliaries. | |
|---|---|
| WV-CA-241 | 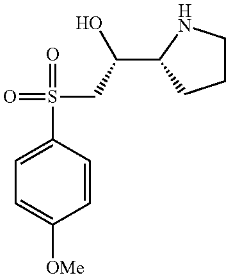 [SMILES: COc1ccc(S(=O)(=O)C[C@H](O)[C@H]2CCCN2)cc1] |
| WV-CA-242 | 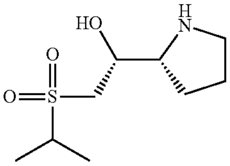 |
| WV-CA-243 | 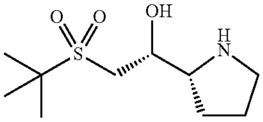 |
| WV-CA-252 | 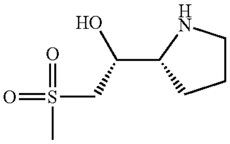 |
| WV-CA-290 | 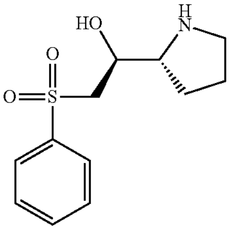 [SMILES: O=S(=O)(C[C@@H](O)[C@H]1CCCN1)c1ccccc1] |
| WV-CA-291 | 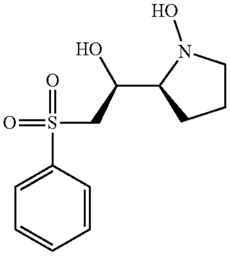 [SMILES: O=S(=O)(C[C@@H](O)[C@@H]1CCCN1O)c1ccccc1] |
| WV-CA-108 | 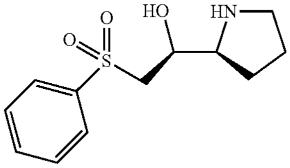 [SMILES: O=S(=O)(C[C@@H](O)[C@@H]1CCCN1)c1ccccc1] |

TABLE CA-3-continued

| Example chiral auxiliaries. | |
|---|---|
| WV-CA-183 | 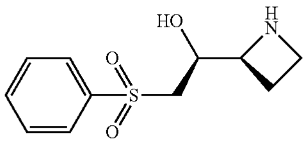 [SMILES: O=S(=O)(C[C@@H](O)[C@@H]1CCN1)c1ccccc1] |

In some embodiments, a provided compound is an enantiomer of a compound selected from Table CA-3 or a salt thereof. In some embodiments, a provided compound is a diastereomer of a compound selected from Table CA-3 or a salt thereof.

In some embodiments, a useful chiral reagent is a compound selected from the compounds below, or its related stereoisomer, particularly enantiomer:

TABLE CA-4

| Example chiral auxiliaries. | |
|---|---|
| WV-CA-251 | 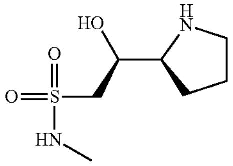 |
| WV-CA-253 | 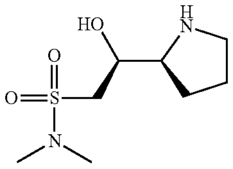 |
| WV-CA-255 | 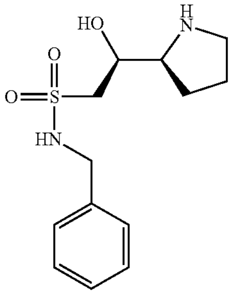 [SMILES: O=S(=O)(C[C@@H](O)[C@@H]1CCCN1)NCc1ccccc1] |
| WV-CA-257 | 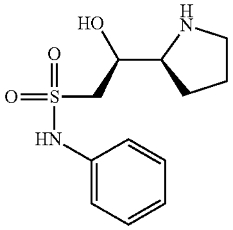 [SMILES: O=S(=O)(C[C@@H](O)[C@@H]1CCCN1)Nc1ccccc1] |

TABLE CA-4-continued

| Example chiral auxiliaries. | |
|---|---|
| WV-CA-258 | 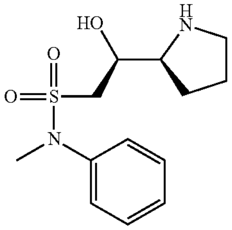 [SMILES: CN(c1ccccc1)S(=O)(=O)C[C@@H](O)[C@@H]1CCCN1] |
| WV-CA-263 | 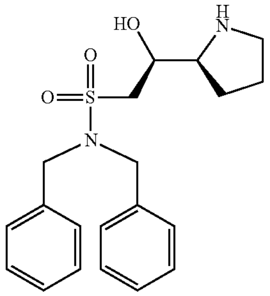 [SMILES: O=S(=O)(C[C@@H](O)[C@@H]1CCCN1)N(Cc1ccccc1)Cc1ccccc1] |

In some embodiments, a provided compound is an enantiomer of a compound selected from Table CA-4 or a salt thereof. In some embodiments, a provided compound is a diastereomer of a compound selected from Table CA-4 or a salt thereof.

In some embodiments, a useful chiral reagent is a compound selected from the compounds below, or its related stereoisomer, particularly enantiomer:

TABLE CA-5

| Example chiral auxiliaries. | |
|---|---|
| WV-CA-254 | 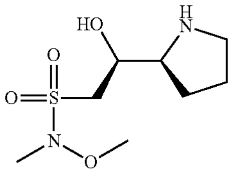 |
| WV-CA-256 | 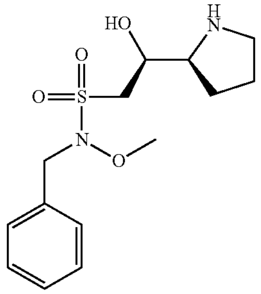 [SMILES: CON(Cc1ccccc1)S(=O)(=O)C[C@@H](O)[C@@H]1CCCN1] |
| WV-CA-259 | 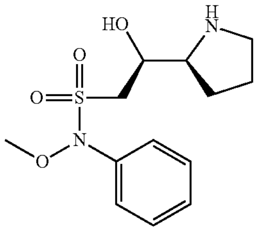 [SMILES: CON(c1ccccc1)S(=O)(=O)C[C@@H](O)[C@@H]1CCCN1] |

In some embodiments, a provided compound is an enantiomer of a compound selected from Table CA-5 or a salt thereof. In some embodiments, a provided compound is a diastereomer of a compound selected from Table CA-5 or a salt thereof.

In some embodiments, a useful chiral reagent is a compound selected from the compounds below, or its related stereoisomer, particularly enantiomer:

TABLE CA-6

| Example chiral auxiliaries. | |
|---|---|
| WV-CA-260 | 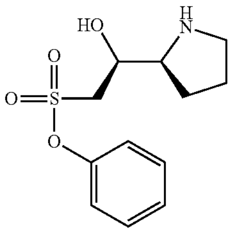 [SMILES: O=S(=O)(C[C@@H](O)[C@@H]1CCCN1)Oc1ccccc1] |
| WV-CA-261 | 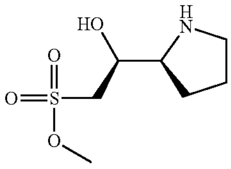 |
| WV-CA-262 | 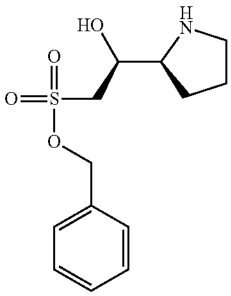 [SMILES: O=S(=O)(C[C@@H](O)[C@@H]1CCCN1)OCc1ccccc1] |

In some embodiments, a provided compound is an enantiomer of a compound selected from Table CA-6 or a salt thereof. In some embodiments, a provided compound is a diastereomer of a compound selected from Table CA-6 or a salt thereof.

In some embodiments, a useful chiral reagent is a compound selected from the compounds below, or its related stereoisomer, particularly enantiomer:

TABLE CA-7

| Example chiral auxiliaries. | |
|---|---|
| WV-CA-245 | 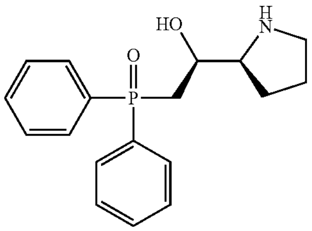 [SMILES: O=P(C[C@@H](O)[C@@H]1CCCN1)(c1ccccc1)c1ccccc1] |

TABLE CA-7-continued

| Example chiral auxiliaries. | |
|---|---|
| WV-CA-264 | 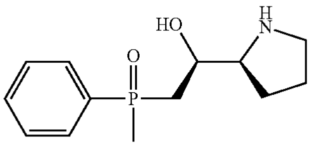 [SMILES: CP(=O)(C[C@@H](O)[C@@H]1CCCN1)c1ccccc1] |
| WV-CA-265 | 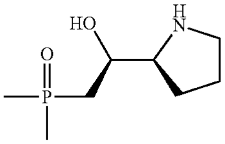 |
| WV-CA-266 | 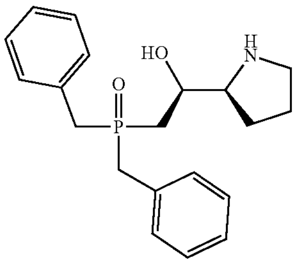 [SMILES: O=P(Cc1ccccc1)(Cc1ccccc1)C[C@@H](O)[C@@H]1CCCN1] |

In some embodiments, a provided compound is an enantiomer of a compound selected from Table CA-7 or a salt thereof. In some embodiments, a provided compound is a diastereomer of a compound selected from Table CA-7 or a salt thereof.

In some embodiments, a useful chiral reagent is a compound selected from the compounds below, or its related stereoisomer, particularly enantiomer:

TABLE CA-8

| Example chiral auxiliaries. | |
|---|---|
| WV-CA-267 | 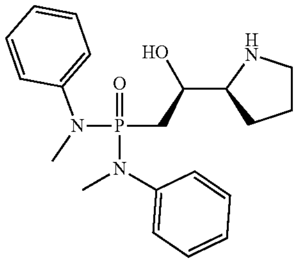 |
| WV-CA-269 | 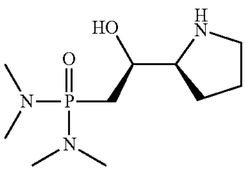 |

TABLE CA-8-continued

| Example chiral auxiliaries. | |
|---|---|
| WV-CA-271 | 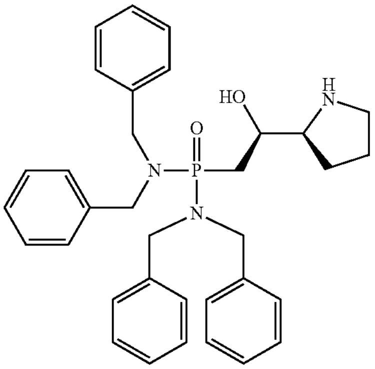 [SMILES: O=P(C[C@@H](O)[C@@H]1CCCN1)(N(Cc1ccccc1)Cc1ccccc1)N(Cc1ccccc1)Cc1ccccc1] |

In some embodiments, a provided compound is an enantiomer of a compound selected from Table CA-8 or a salt thereof. In some embodiments, a provided compound is a diastereomer of a compound selected from Table CA-8 or a salt thereof.

In some embodiments, a useful chiral reagent is a compound selected from the compounds below, or its related stereoisomer, particularly enantiomer:

TABLE CA-9

| Example chiral auxiliaries. | |
|---|---|
| WV-CA-268 | 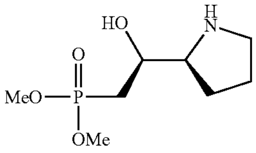 |
| WV-CA-270 | 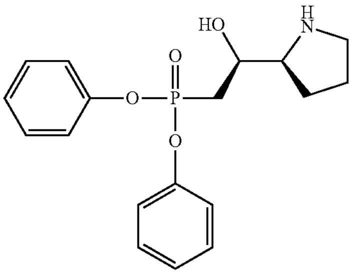 |

In some embodiments, a provided compound is an enantiomer of a compound selected from Table CA-9 or a salt thereof. In some embodiments, a provided compound is a diastereomer of a compound selected from Table CA-9 or a salt thereof.

In some embodiments, a useful chiral reagent is a compound selected from the compounds below, or its related stereoisomer, particularly enantiomer:

TABLE CA-10

| Example chiral auxiliaries. | |
|---|---|
| WV-CA-244 | 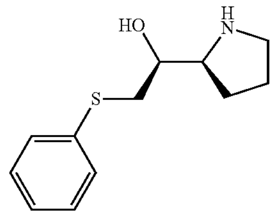 [SMILES: O[C@H](CSc1ccccc1)[C@@H]1CCCN1] |
| WV-CA-246 | 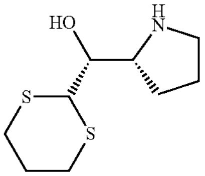 [SMILES: O[C@@H](C1SCCCS1)[C@H]1CCCN1] |

In some embodiments, a provided compound is an enantiomer of a compound selected from Table CA-10 or a salt thereof. In some embodiments, a provided compound is a diastereomer of a compound selected from Table CA-10 or a salt thereof.

In some embodiments, a useful chiral reagent is a compound selected from the compounds below, or its related stereoisomer, particularly enantiomer:

TABLE CA-11

| Example chiral auxiliaries. | |
|---|---|
| WV-CA-247 | 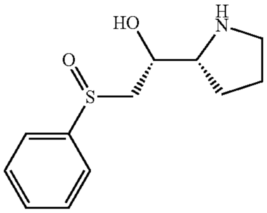 [SMILES: O=S(C[C@H](O)[C@H]1CCCN1)c1ccccc1] |
| WV-CA-248 | 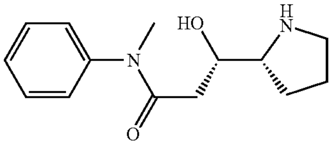 [SMILES: CN(C(=O)C[C@H](O)[C@H]1CCCN1)c1ccccc1] |

In some embodiments, a provided compound is an enantiomer of a compound selected from Table CA-11 or a salt thereof. In some embodiments, a provided compound is a diastereomer of a compound selected from Table CA-11 or a salt thereof.

In some embodiments, a useful chiral reagent is a compound selected from the compounds below, or its related stereoisomer, particularly enantiomer:

TABLE CA-12

| Example chiral auxiliaries. | |
|---|---|
| WV-CA-250 | 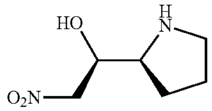 |

TABLE CA-12-continued

| Example chiral auxiliaries. | |
|---|---|
| WV-CA-286 | 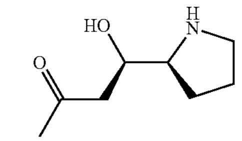 |
| WV-CA-287 | 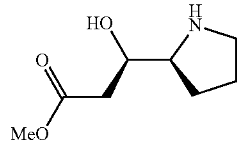 [SMILES: COC(=O)C[C@@H](O)[C@@H]1CCCN1] |
| WV-CA-288 | 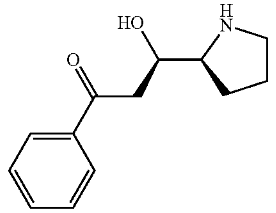 [SMILES: O=C(C[C@@H](O)[C@@H]1CCCN1)c1ccccc1] |
| WV-CA-289 | 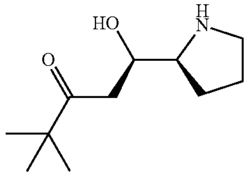 |

In some embodiments, a provided compound is an enantiomer of a compound selected from Table CA-12 or a salt thereof. In some embodiments, a provided compound is a diastereomer of a compound selected from Table CA-12 or a salt thereof.

In some embodiments, a useful chiral reagent is a compound selected from the compounds below, or its related stereoisomer, particularly enantiomer:

TABLE CA-13

| Example chiral auxiliaries. | |
|---|---|
| WV-CA-110 | 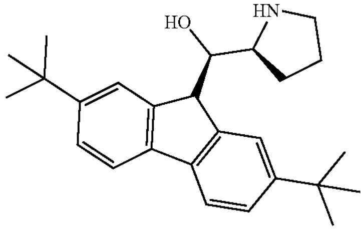 [SMILES: CC(C)(C)c1ccc2c(c1)C([C@@H](O)[C@@H]1CCCN1)c1cc(C(C)(C)C)ccc1-2] |
| WV-CA-315 | 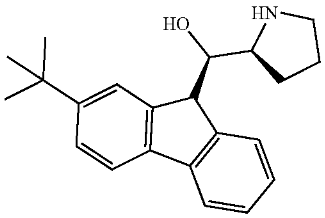 [SMILES: CC(C)(C)c1ccc2c(c1)C([C@@H](O)[C@@H]1CCCN1)c1ccccc1-2] |

TABLE CA-13-continued

| Example chiral auxiliaries. | |
|---|---|
| WV-CA-110b | 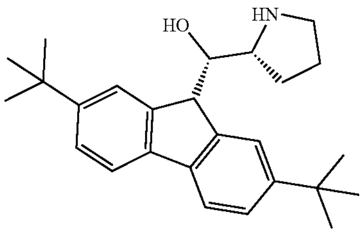 [SMILES: CC(C)(C)c1ccc2c(c1)C([C@H](O)[C@H]1CCCN1)c1cc(C(C)(C)C)ccc1-2] |
| WV-CA-324 | 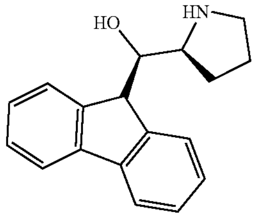 [SMILES: O[C@H](C1c2ccccc2-c2ccccc21)[C@@H]1CCCN1] |

In some embodiments, a provided compound is an enantiomer of a compound selected from Table CA-13 or a salt thereof. In some embodiments, a provided compound is a diastereomer of a compound selected from Table CA-13 or a salt thereof.

As appreciated by those skilled in the art, chiral reagents are typically stereopure or substantially stereopure, and are typically utilized as a single stereoisomer substantially free of other stereoisomers. In some embodiments, compounds of the present disclosure are stereopure or substantially stereopure.

As demonstrated herein, when used for preparing a chiral internucleotidic linkage, to obtain stereoselectivity generally stereochemically pure chiral reagents are utilized. Among other things, the present disclosure provides stereochemically pure chiral reagents, including those having structures described.

The choice of chiral reagent, for example, the isomer represented by Formula Q or its stereoisomer, Formula R, permits specific control of chirality at a linkage phosphorus. Thus, either an Rp or Sp configuration can be selected in each synthetic cycle, permitting control of the overall three dimensional structure of a chirally controlled oligonucleotide. In some embodiments, a chirally controlled oligonucleotide has all Rp stereocenters. In some embodiments of the disclosure, a chirally controlled oligonucleotide has all Sp stereocenters. In some embodiments of the disclosure, each linkage phosphorus in the chirally controlled oligonucleotide is independently Rp or Sp. In some embodiments of the disclosure, each linkage phosphorus in the chirally controlled oligonucleotide is independently Rp or Sp, and at least one is Rp and at least one is Sp. In some embodiments, the selection of Rp and Sp centers is made to confer a specific three dimensional superstructure to a chirally controlled oligonucleotide. Examples of such selections are described in further detail herein.

In some embodiments, a provided oligonucleotide comprise a chiral auxiliary moiety, e.g., in an internucleotidic linkage. In some embodiments, a chiral auxiliary is connected to a linkage phosphorus. In some embodiments, a chiral auxiliary is connected to a linkage phosphorus through $W^2$. In some embodiments, a chiral auxiliary is connected to a linkage phosphorus through $W^2$, wherein $W^2$ is 0. Optionally, $W^1$, e.g., when $W^1$ is —$NG^5$-, is capped during oligonucleotide synthesis. In some embodiments, $W^1$ in a chiral auxiliary in an oligonucleotide is capped, e.g., by a capping reagent during oligonucleotide synthesis. In some embodiments, $W^1$ may be purposeful capped to modulate oligonucleotide property. In some embodiments, $W^1$ is capped with —$R^1$. In some embodiments, $R^1$ is —C(O)R'. In some embodiments, R' is optionally substituted $C_{1-6}$ aliphatic. In some embodiments, R' is methyl.

In some embodiments, a chiral reagent for use in accordance with the present disclosure is selected for its ability to be removed at a particular step in the above-depicted cycle. For example, in some embodiments it is desirable to remove a chiral reagent during the step of modifying the linkage phosphorus. In some embodiments, it is desirable to remove a chiral reagent before the step of modifying the linkage phosphorus. In some embodiments, it is desirable to remove a chiral reagent after the step of modifying the linkage phosphorus. In some embodiments, it is desirable to remove a chiral reagent after a first coupling step has occurred but before a second coupling step has occurred, such that a chiral reagent is not present on the growing oligonucleotide during the second coupling (and likewise for additional subsequent coupling steps). In some embodiments, a chiral reagent is removed during the "deblock" reaction that occurs after modification of the linkage phosphorus but before a subsequent cycle begins. Example methods and reagents for removal are described herein.

In some embodiments, removal of chiral auxiliary is achieved when performing the modification and/or deblocking step, as illustrated in Scheme I. It can be beneficial to combine chiral auxiliary removal together with other transformations, such as modification and deblocking. A person of ordinary skill in the art would appreciate that the saved steps/transformation could improve the overall efficiency of synthesis, for instance, with respect to yield and product purity, especially for longer oligonucleotides. One example wherein the chiral auxiliary is removed during modification and/or deblocking is illustrated in Scheme I.

In some embodiments, a chiral reagent for use in accordance with methods of the present disclosure is characterized in that it is removable under certain conditions. For instance, in some embodiments, a chiral reagent is selected for its ability to be removed under acidic conditions. In certain embodiments, a chiral reagent is selected for its ability to be removed under mildly acidic conditions. In certain embodiments, a chiral reagent is selected for its ability to be removed by way of an E1 elimination reaction (e.g., removal occurs due to the formation of a cation intermediate on the chiral reagent under acidic conditions, causing the chiral reagent to cleave from the oligonucleotide). In some embodiments, a chiral reagent is characterized in that it has a structure recognized as being able to accommodate or facilitate an E1 elimination reaction. One of skill in the relevant arts will appreciate which structures would be envisaged as being prone toward undergoing such elimination reactions.

In some embodiments, a chiral reagent is selected for its ability to be removed with a nucleophile. In some embodiments, a chiral reagent is selected for its ability to be removed with an amine nucleophile. In some embodiments, a chiral reagent is selected for its ability to be removed with a nucleophile other than an amine.

In some embodiments, a chiral reagent is selected for its ability to be removed with a base. In some embodiments, a chiral reagent is selected for its ability to be removed with an amine. In some embodiments, a chiral reagent is selected for its ability to be removed with a base other than an amine.

In some embodiments, chirally pure phosphoramidites comprising chiral auxiliaries may be isolated before use. In some embodiments, chirally pure phosphoramidites comprising chiral auxiliaries may be used without isolation—in some embodiments, they may be used directly after formation.

Activation

As appreciated by those skilled in the art, oligonucleotide preparation may use various conditions, reagents, etc. to active a reaction component, e.g., during phosphoramidite preparation, during one or more steps during in the cycles, during post-cycle cleavage/deprotection, etc. Various technologies for activation can be utilized in accordance with the present disclosure, including but not limited to those described in U.S. Pat. Nos. 9,695,211, 9,605,019, 9,598,458, US 2013/0178612, US 20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the activation technologies of each of which are incorporated by reference. Certain activation technologies, e.g., reagents, conditions, methods, etc. are illustrated in the Examples.

Coupling

In some embodiments, cycles of the present disclosure comprise stereoselective condensation/coupling steps to form chirally controlled internucleotidic linkages. For condensation, often an activating reagent is used, such as 4,5-dicyanoimidazole (DCI), 4,5-dichloroimidazole, 1-phenylimidazolium triflate (PhIMT), benzimidazolium triflate (BIT), benztriazole, 3-nitro-1,2,4-triazole (NT), tetrazole, 5-ethylthiotetrazole (ETT), 5-benzylthiotetrazole (BTT), 5-(4-nitrophenyl) tetrazole, N-cyanomethylpyrrolidinium triflate (CMPT), N-cyanomethylpiperidinium triflate, N-cyanomethyldimethylammonium triflate, etc. Suitable conditions and reagents, including chiral phosphoramidites, include those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the condensation reagents, conditions and methods of each of which are incorporated by reference. Certain coupling technologies, e.g., reagents, conditions, methods, etc. are illustrated in the Examples.

In some embodiments, a phosphoramidite for coupling has the structure of

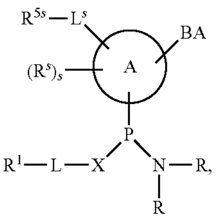

,

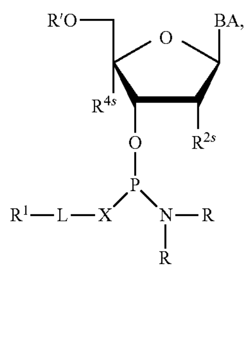

or

-continued

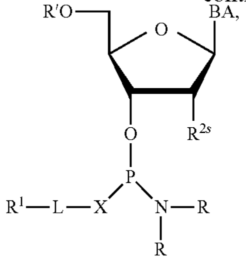

wherein each variable is independently as described in the present disclosure. In some embodiments, each R is independently optionally substituted $C_{1-6}$ aliphatic. A person skill in the art will appreciate that two R groups in any structure or formula can either be the same or different. In some embodiments, each R is independently optionally substituted $C_{1-6}$ alkyl. In some embodiments, each R is independently optionally substituted $C_{1-6}$ alkenyl. In some embodiments, each R is independently optionally substituted $C_{1-6}$ alkynyl. In some embodiments, each R is indenpendtly isopropyl. In some embodiments, —X-L-$R^1$ comprises an optionally substituted triazole group. In some embodiments, X is a covalent bond. In some embodiments, L is a covalent bond. In some embodiments, —X-L-$R^1$ is $R^1$. In some embodiments, $R^1$ comprise an optionally substituted ring. In some embodiments, $R^1$ is R as described herein. In some embodiments, $R^1$ is optionally substituted

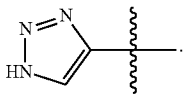

In some embodiments, $R^1$ is

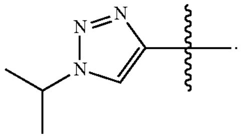 [SMILES: *c1cn(C(C)C)nn1]

In some embodiments, $R^1$ is

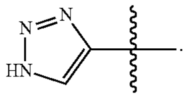

In some embodiments, $R^1$ is

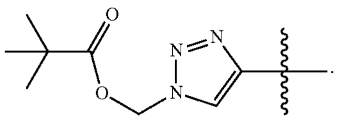 [SMILES: *c1cn(COC(=O)C(C)(C)C)nn1]

In some embodiments, -L-comprises $C_{1-6}$ alkylene. In some embodiments, -L-comprises $C_{1-6}$ alkenylene. In some embodiments, -L- comprises

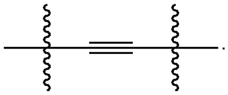

In some embodiments, $R^1$ is R as described herein. In some embodiments, -L- is

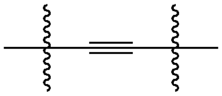 [SMILES: *C#C*]

and $R^1$ is H. In some embodiments, -L-$R^1$ is

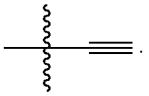 [SMILES: *C#C]

In some embodiments, —X-L-R' is

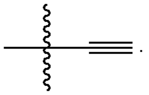

In some embodiments, —X-L-$R^1$ is —$OCH_2CH_2CN$.

In some embodiments, a chiral phosphoramidite for coupling has the structure of

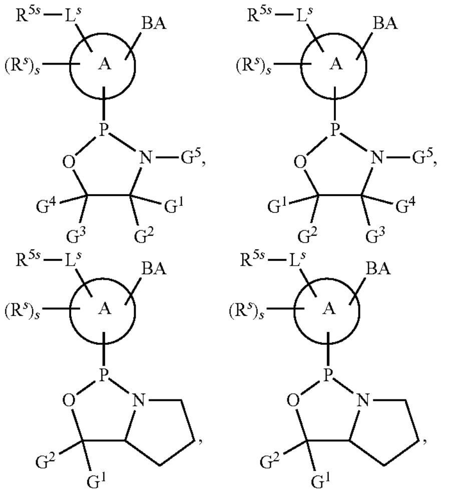

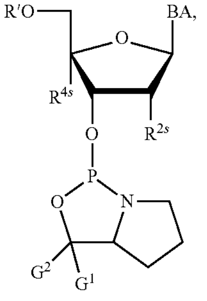

or

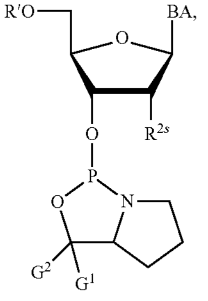

wherein each variable is independently as described in the present disclosure. In some embodiments, a chiral phosphoramidite for coupling has the structure of
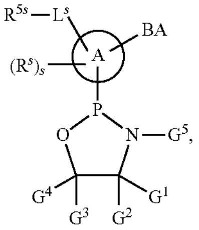
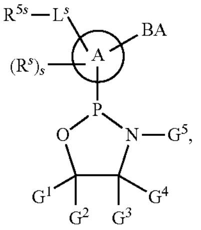
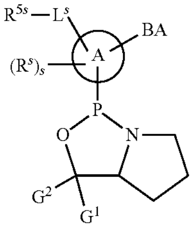
,
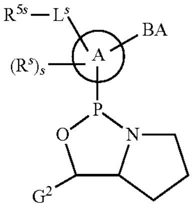
,
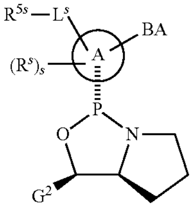
,
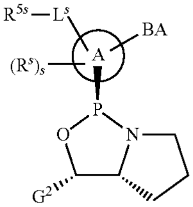
,
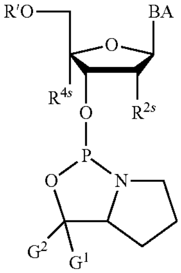
,
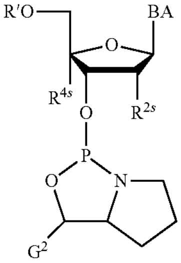
,
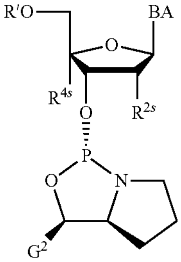
,
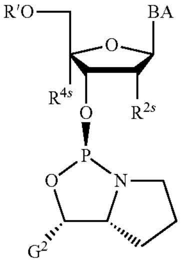
,
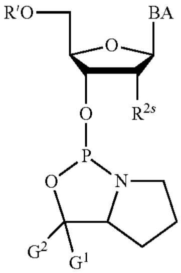
,
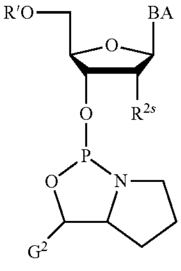
,
-continued
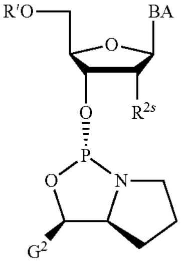
, or
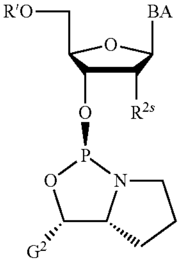
.
In some embodiments, a chiral phosphoramidite for coupling has the structure of
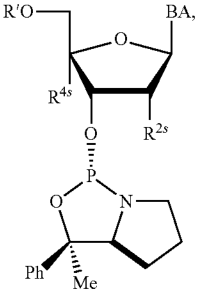
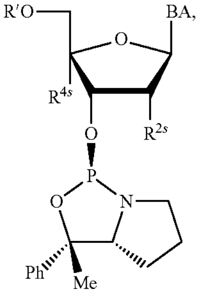
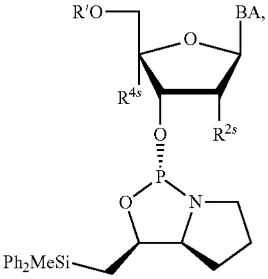
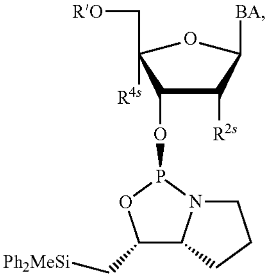
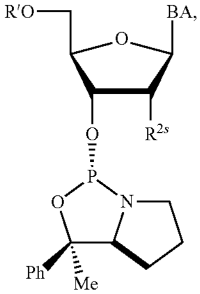
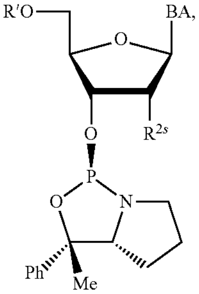
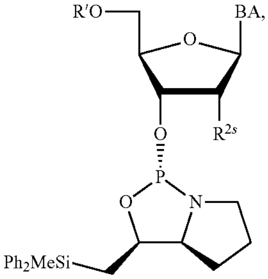

-continued
or
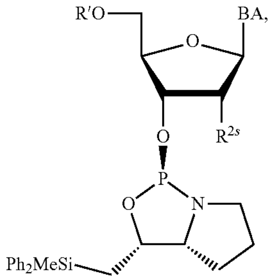
wherein each variable is independently as described in the present disclosure. In some embodiments, $G^1$ or $G^2$ comprises an electron-withdrawing group as described in the present disclosure. In some embodiments, a chiral phosphoramidite for coupling has the structure of
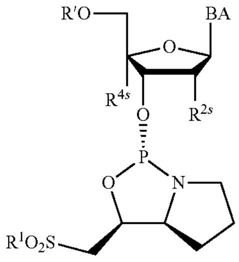
,
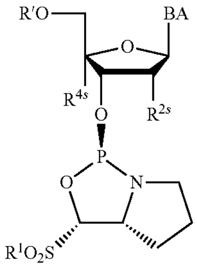
,
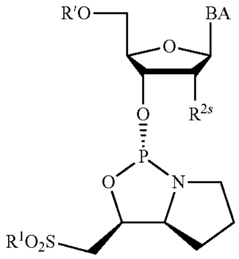
,
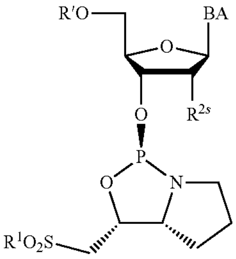
,
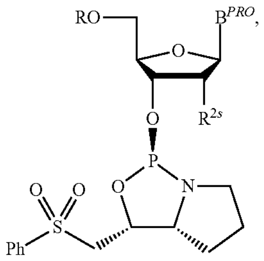
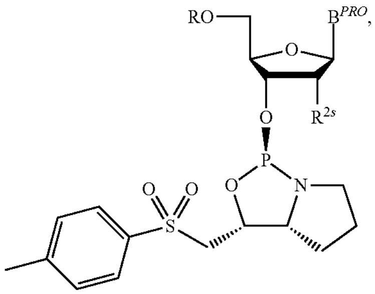
-continued
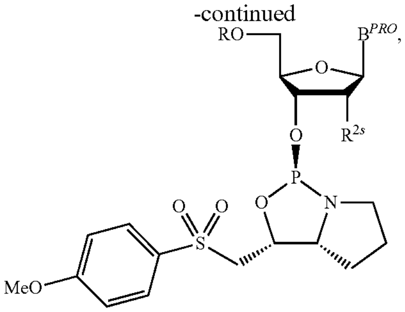
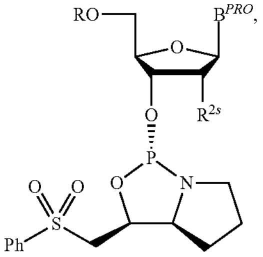
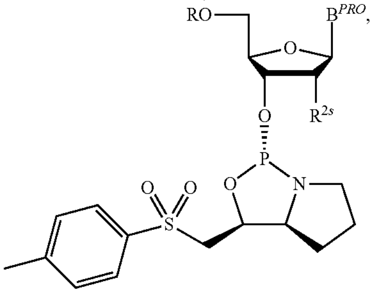
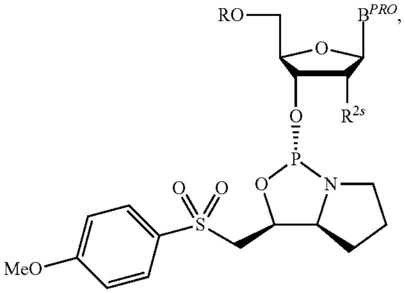
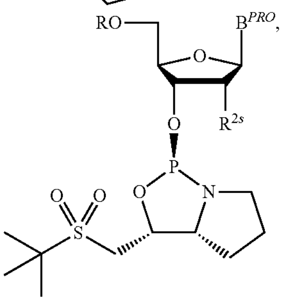
or
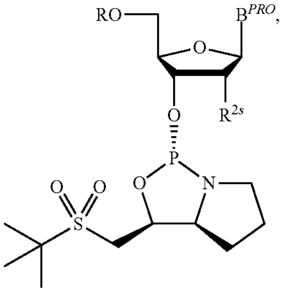

wherein each variable is independently as described in the present disclosure. In some embodiments, $R^1$ is R' as described in the present disclosure. In some embodiments, $R^1$ is R as described in the present disclosure. In some embodiments, R is optionally substituted phenyl as described in the present disclosure. In some embodiments, R is phenyl. In some embodiments, R is 4-methyl phenyl. In some embodiments, R is 4-methoxy phenyl. In some embodiments, R is optionally substituted $C_{1-6}$ aliphatic as described in the present disclosure. In some embodiments, R is optionally substituted $C_{1-6}$ alkyl as described in the present disclosure. For example, in some embodiments, R is methyl; in some embodiments, R is isopropyl; in some embodiments, R is t-butyl; etc.

In some embodiments, $R^{5s}$-$L^s$- is R'O—. In some embodiments, R'O— is DMTrO—. In some embodiments, $R^{4s}$ is —H. In some embodiments, $R^{4s}$ and $R^{2s}$ are taken together to form a bridge -L-O— as described in the present disclosure. In some embodiments, the —O— is connected to the carbon at the 2' position. In some embodiments, L is —$CH_2$—. In some embodiments, L is —CH(Me)-. In some embodiments, L is —(R)—CH(Me)-. In some embodiments, L is —(S)—CH(Me)-. In some embodiments, $R^{2s}$ is —H. In some embodiments, $R^{2s}$ is —F. In some embodiments, $R^{2s}$ is —OR'. In some embodiments, $R^{2s}$ is —OMe. In some embodiments, $R^{2s}$ is -MOE. As appreciated by those skilled in the art, BA may be suitably protected during synthesis.

In some embodiments, an internucleotidic linkage formed in a coupling step has the structure of formula I or a salt form thereof. In some embodiments, $P^L$ is P. In some embodiments, —X-L-$R^1$ is

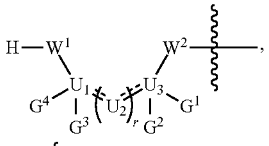,
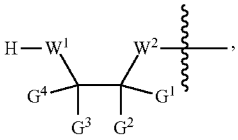,
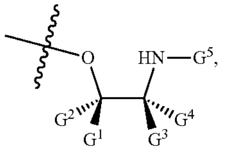
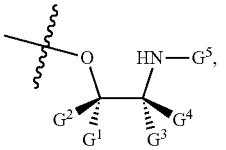
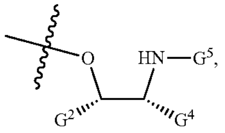
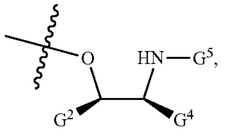
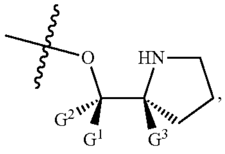,
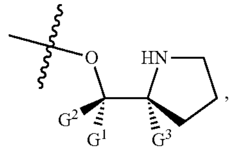,
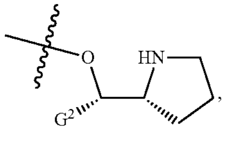, or
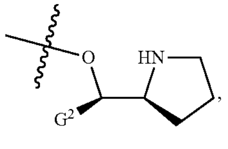, wherein each variable is independently in accordance with the present disclosure. In some embodiments, —X-L-$R^1$ is —$CH_2CH_2CN$.

In some embodiments, a coupling forms an internucleotidic linkage with a stereoselectivity of 80%, 85%, 90%, 91%, 92%, 93%, 94%, 95%, 96%, 97%, 98%, 99% or more. In some embodiments, the stereoselectivity is 85% or more. In some embodiments, the stereoselectivity is 85% or more. In some embodiments, the stereoselectivity is 90% or more. In some embodiments, the stereoselectivity is 91% or more. In some embodiments, the stereoselectivity is 92% or more. In some embodiments, the stereoselectivity is 93% or more. In some embodiments, the stereoselectivity is 94% or more. In some embodiments, the stereoselectivity is 95% or more. In some embodiments, the stereoselectivity is 96% or more. In some embodiments, the stereoselectivity is 97% or more. In some embodiments, the stereoselectivity is 98% or more. In some embodiments, the stereoselectivity is 99% or more.

Capping

If the final nucleic acid is larger than a dimer, the unreacted-OH moiety is generally capped with a blocking/capping group. Chiral auxiliaries in oligonucleotides may also be capped with a blocking group to form a capped condensed intermediate. Suitable capping technologies (e.g., reagents, conditions, etc.) include those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the capping technologies of each of which are incorporated by reference. In some embodiments, a capping reagent is a carboxylic acid or a derivate thereof. In some embodiments, a capping reagent is R'COOH. In some embodiments, a capping step introduces R'COO— to unreacted 5'-OH group and/or amino groups in chiral auxiliaries. In some embodiments, a cycle may comprise two or more capping steps. In some embodiments, a cycle comprises a first capping before modification of a coupling product (e.g., converting P(III) to P(V)), and another capping after modification of a coupling product. In some embodiments, a first capping is performed under an amidation condition, e.g., which comprises an acylating reagent (e.g., an anhydride having the structure of $(RC(O))_2O$, (e.g., $Ac_2O$)) and a base (e.g., 2,6-lutidine). In some embodiments, a first capping caps an amino group, e.g., that of a chiral auxiliary in an internucleotidic linkage. In some embodiments, an internucleotidic linkage formed in a coupling step has the structure of formula I or a salt form thereof. In some embodiments, $P^L$ is P. In some embodiments, —X-L-$R^1$ is

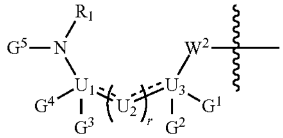,
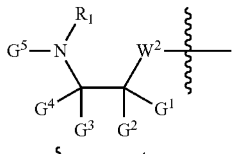,
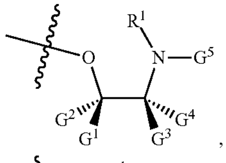,
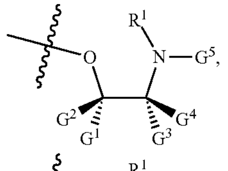
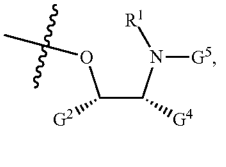
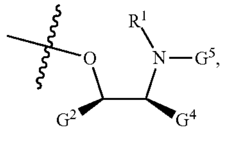

-continued

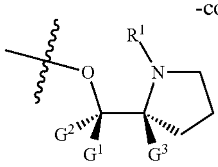 , 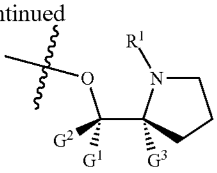 ,

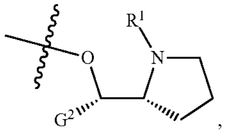 , or 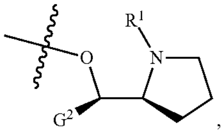 , wherein each variable is independently in accordance with the present disclosure. In some embodiments, $R^1$ is R—C(O)—. In some embodiments, R is $CH_3$—. In some embodiments, each chirally controlled coupling (e.g., using a chiral auxiliary) is followed with a first capping. Typically, cycles for non-chirally controlled coupling using traditional phosphoramidite to construct natural phosphate linkages do not contain a first capping. In some embodiments, a second capping is performed, e.g., under an esterification condition (e.g., capping conditions of traditional phosphoramidite oligonucleotide synthesis) wherein free 5'-OH are capped.

Certain capping technologies, e.g., reagents, conditions, methods, etc. are illustrated in the Examples.

Modifying

In some embodiments, an internucleotidic linkage wherein its linkage phosphorus exists as P(III) is modified to form another modified internucleotidic linkage (e.g., one of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof) or a natural phosphate linkage. In many embodiments, P(III) is modified by reaction with an electrophile. Various types of reactions suitable for P(III) may be utilized in accordance with the present disclosure. Suitable modifying technologies (e.g., reagents (e.g., sulfurization reagent, oxidation reagent, etc.), conditions, etc.) include those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the modifying technologies of each of which are incorporated by reference.

In some embodiments, as illustrated in the Examples, the present disclosure provides modifying reagents for introducing non-negatively charged internucleotidic linkages including neutral internucleotidic linkages.

In some embodiments, modifying is within a cycle. In some embodiments, modifying can be outside of a cycle. For example, in some embodiments, one or more modifying steps can be performed after the oligonucleotide chain has been reached to introduce modifications simultaneously at one or more internucleotidic linkages and/or other locations.

In some embodiments, modifying comprises use of click chemistry, e.g., wherein an alkyne group of an oligonucleotide, e.g., of an internucleotidic linkage, is reacted with an azide. Various reagents and conditions for click chemistry can be utilized in accordance with the present disclosure. In some embodiments, an azide has the structure of $R^1$—$N_3$, wherein $R^1$ is as described in the present disclosure. In some embodiments, $R^1$ is optionally substituted $C_{1-6}$ alkyl. In some embodiments, $R^1$ is isopropyl.

In some embodiments, as demonstrated in the examples, a P(III) linkage can be converted into a non-negatively charged internucleotidic linkage by reacting the P(III) linkage with an azide or an azido imidazolinium salt (e.g., a compound comprising

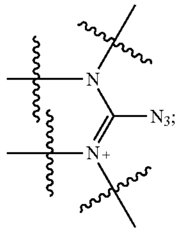

in some embodiments, referred to as an azide reaction) under suitable conditions. In some embodiments, an azido imidazolinium salt is a salt of $PF_6^-$. In some embodiments, an azido imidazolinium salt is a salt of

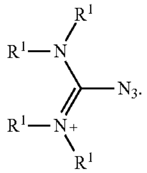

In some embodiments, a useful reagent, e.g., an azido imidazolinium salt, is a salt of

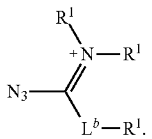

In some embodiments, a useful reagent is a salt of

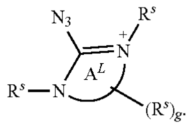

In some embodiments, a useful reagent is a salt of

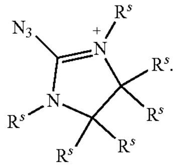

In some embodiments, a useful reagent is a salt of

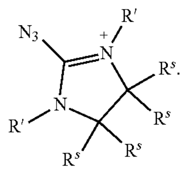

Such reagents comprising nitrogen cations also contain counter anions (e.g., $Q^-$ as described in the present disclosure), which are widely known in the art and are contained in various chemical reagents. In some embodiments, a useful reagent is $Q^+Q^-$, wherein $Q^+$ is

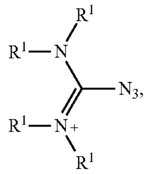

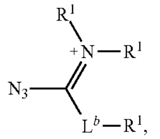

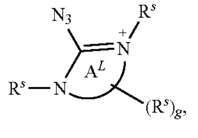

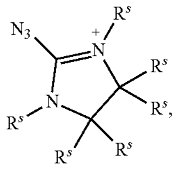

or

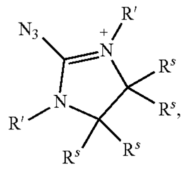

and $Q^-$ is a counter anion. In some embodiments, $Q^+$ is

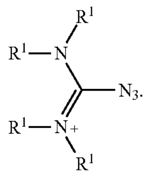

In some embodiments, $Q^+$ is

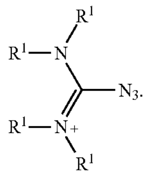

In some embodiments, $Q^+$ is

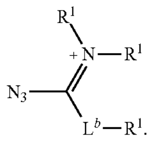

In some embodiments, $Q^+$ is

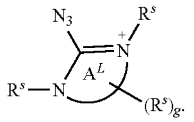

In some embodiments, $Q^+$ is

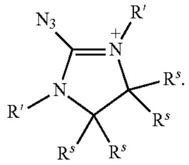

As appreciated by those skilled in the art, in a compound having the structure of $Q^+Q^-$, typically the number of positive charges in $Q^+$ equals the number of negative charges in $Q^-$. In some embodiments, $Q^+$ is a monovalent cation and $Q^-$ is a monovalent anion. In some embodiments, $Q^-$ is $F^-$, $Cl^-$, $Br^-$, $BF_4^-$, $PF_6^-$, $TfO^-$, $Tf_2N^-$, $AsF_6^-$, $ClO_4^-$, or $SbF_6^-$. In some embodiments, $Q^-$ is $PF_6^-$. Those skilled in the art readily appreciate that many other types of counter anions are available and can be utilized in accordance with the present disclosure. In some embodiments, an azido imidazolinium salt is 2-azido-1,3-dimethylimidazolinium hexafluorophosphate. In some embodiments, an azide is

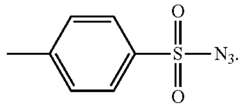

In some embodiments, an azido imidazolinium salt is

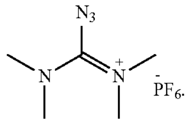

In some embodiments, an azido imidazolinium salt is

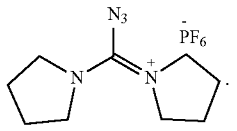

In some embodiments, an azide is

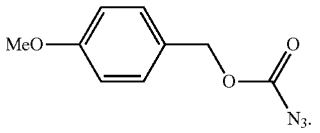

In some embodiments, an azide is

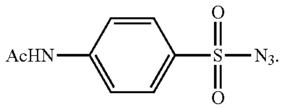 [SMILES: CC(=O)Nc1ccc(S(=O)(=O)N=[N+]=[N-])cc1]

In some embodiments, an azide is

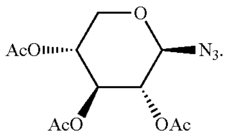 [SMILES: CC(=O)O[C@@H]1[C@@H](OC(C)=O)[C@H](OC(C)=O)CO[C@H]1N=[N+]=[N-]]

In some embodiments, an azido imidazolinium salt is

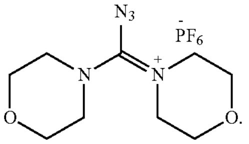

In some embodiments, an azido imidazolinium salt is

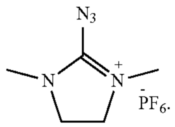

In some embodiments, an azido imidazolinium salt is

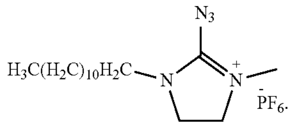

In some embodiments, an azido imidazolinium salt is

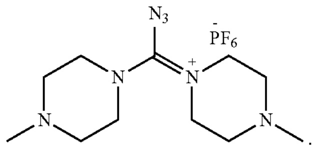

In some embodiments, a P(III) linkage is reacted with an electrophile having the structure of R-$G^Z$, wherein R is as described in the present disclosure, and $G^Z$ is a leaving group, e.g., —Cl, —Br, —I, —OTf, —Oms, —OTosyl, etc. In some embodiments, R is —$CH_3$. In some embodiments, R is —$CH_2CH_3$. In some embodiments, R is —$CH_2CH_2CH_3$. In some embodiments, R is —$CH_2OCH_3$. In some embodiments, R is $CH_3CH_2OCH_2$—. In some embodiments, R is $PhCH_2OCH_2$—. In some embodiments, R is HC≡C—$CH_2$—. In some embodiments, R is $H_3C$—C≡C—$CH_2$—. In some embodiments, R is $CH_2$—$CHCH_2$—. In some embodiments, R is $CH_3SCH_2$—. In some embodiments, R is —$CH_2COOCH_3$. In some embodiments, R is —$CH_2COOCH_2CH_3$. In some embodiments, R is —$CH_2CONHCH_3$.

In some embodiments, after a modifying step, a P(III) linkage phosphorus is converted into a P(V) internucleotidic linkage. In some embodiments, a P(III) linkage phosphorus is converted into a P(V) internucleotidic linkage, and all groups bounded to the linkage phosphorus remain unchanged. In some embodiments, a linkage phosphorus is converted from P into P(═O). In some embodiments, a linkage phosphorus is converted from P into P(═S). In some embodiments, a linkage phosphorus is converted from P into P(═N-L-$R^5$). In some embodiments, a linkage phosphorus is converted from P into

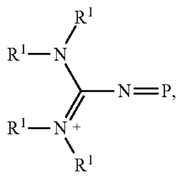

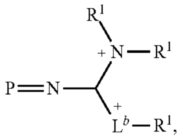

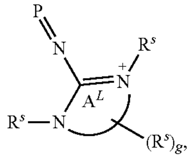

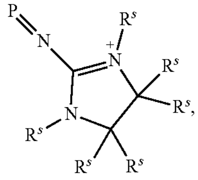

or

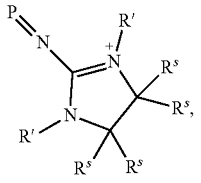

wherein each variable is independently as described in the present disclosure. In some embodiments, P is converted into

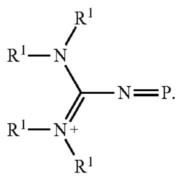

In some embodiments, P is converted into

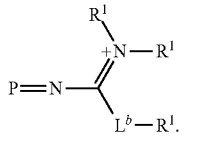

In some embodiments, P is converted into

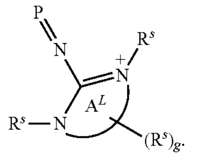

In some embodiments, P is converted into

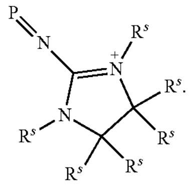

In some embodiments, P is converted into

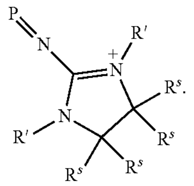

As appreciated by those skilled in the art, for each cation there typically exists a counter anion so that the total number of positive charges equals the total number of negative charges in a system (e.g., compound, composition, etc.). In some embodiments, a counter anion is $Q^-$ as described in the present disclosure (e.g., $F^-$, $Cl^-$, $Br^-$, $BF_4^-$, $PF_6^-$, $TfO^-$, $Tf_2N^-$, $AsF_6^-$, $ClO_4^-$, $SbF_6^-$, etc.). In some embodiments, an internucleotidic linkage having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof, wherein $P^L$ is P, is converted into an internucleotidic linkage having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, III, or a salt form thereof, wherein $P^L$ is P(=W) or $P\rightarrow B(R')_3$ or $P^N$. In some embodiments, an internucleotidic linkage having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof, wherein $P^L$ is P, is converted into an internucleotidic linkage having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof, wherein $P^L$ is P(=W) or $P\rightarrow B(R')_3$. In some embodiments, a linkage phosphorus P, which is $P^L$ in an internucleotidic linkage having the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof is converted into $P^L$ which is P(=W) or $P\rightarrow B(R')_3$. In some embodiments, a linkage phosphorus P, which is $P^L$ in an internucleotidic linkage having the structure of formula I or a salt form thereof is converted into $P^L$ which is P(=W) or $P\rightarrow B(R')_3$. In some embodiments, W is O(e.g., for an oxidation reaction). In some embodiments, W is S (e.g., for a sulfurization reaction). In some embodiments, W is =N-L-$R^5$ (e.g., for an azide reaction). In some embodiments, an internucleotidic linkage having the structure of formula I or a salt form thereof (e.g., wherein $P^L$ is P) is converted into an internucleotidic linkage having the structure of formula III or a salt form thereof:

III

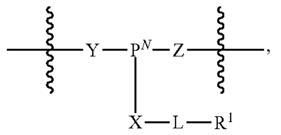

wherein:

$P^N$ is P(=N-L-$R^5$),

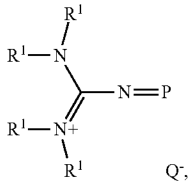 $Q^-$, 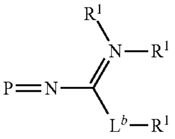 $Q^-$, 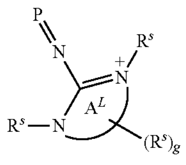 $Q^-$, 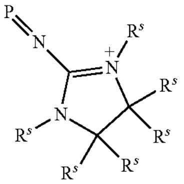 $Q^-$, or 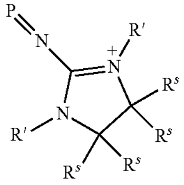 $Q^-$, $Q^-$ is an anion, and each other variables is independently as described in the present disclosure.

In some embodiments, $P^N$ is P(=N-L-$R^5$). In some embodiments, $P^N$ is

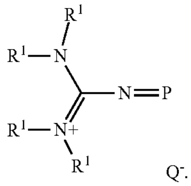 $Q^-$.

In some embodiments, $P^N$ is

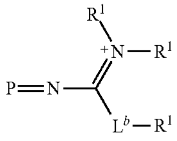

Q⁻.

In some embodiments, $P^N$ is

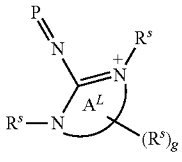

Q⁻.

In some embodiments, $P^N$ is

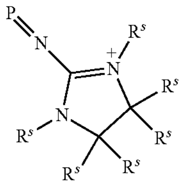

Q⁻.

In some embodiments, $P^N$ is

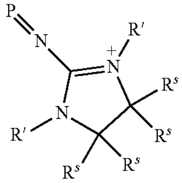

Q⁻.

In some embodiments, internucleotidic linkages of the present disclosure may exist in a salt form. In some embodiments, internucleotidic linkages of formula III may exist in a salt form. In some embodiments, in a salt form of an internucleotidic linkage of formula III $P^N$ is

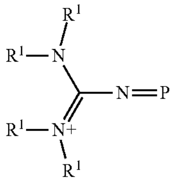

,

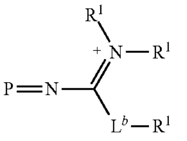

,

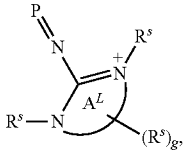

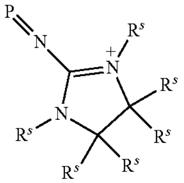

,

-continued or

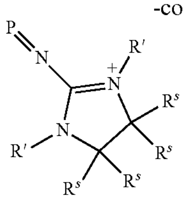

.

In some embodiments, $P^N$ is $P{=}W^N$, wherein $W^N$ is as described herein.

In some embodiments, Y, Z, and —X-L-$R^1$ remains the same during the conversion. In some embodiments, each of X, Y and Z is independently —O—. In some embodiments, as described herein, —X-L-$R^1$ is of such a structure that H—X-L-$R^1$ is a chiral reagent described herein, or a capped chiral reagent described herein wherein an amino group of the chiral reagent (typically of —$W^1$—H or —$W^2$—H, which comprises an amino group —$NHG^5$-) is capped, e.g., with —C(O)R' (replacing a —H, e.g., —N [—C(O)R']$G^5$-). In some embodiments, —X-L-$R^1$ is

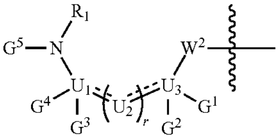

,

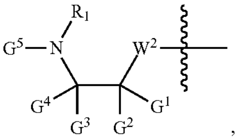

,

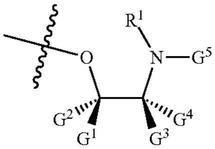

,

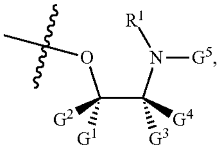

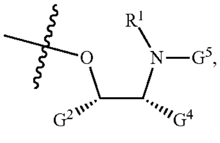

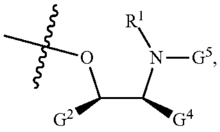

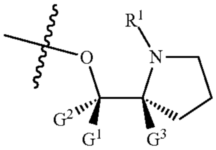

,

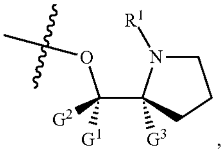

,

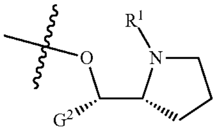

, or

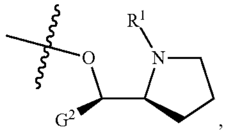

, wherein each variable is independently in accordance with the present disclosure. In some embodiments, wherein $R^1$ is —C(O)R. In some embodiments, $R^1$ is $CH_3C(O)$—. In some embodiments, as described herein, $G^2$ comprises an electron-withdrawing group. In some embodiments, $G^2$ is —$CH_2SO_2Ph$.

In some embodiments, an internucleotidic linkage (e.g., a modified internucleotidic linkage, a chiral internucleotidic linkage, a chirally controlled internucleotidic linkage, a non-negatively charged internucleotidic linkage, a neutral internucleotidic linkage, etc.) has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof, wherein $P^L$ is P(=N-L-$R^5$), or of formula III or a salt form thereof. In some embodiments, such an internucleotidic linkage is chirally controlled. In some embodiments, all such internucleotidic linkages are chirally controlled. In some embodiments, linkage phosphorus of at least one of such internucleotidic linkages is Rp. In some embodiments, linkage phosphorus of at least one of such internucleotidic linkages is Sp. In some embodiments, linkage phosphorus of at least one of such internucleotidic linkages is Rp, and linkage phosphorus of at least one of such internucleotidic linkages is Sp. In some embodiments, oligonucleotides of the present disclosure comprises one or more (e.g., 1-5, 1-10, 1-15, 1-20, 1-25, 1-30, 1-40, 1-50, 1, 2, 3, 4, 5, 6, 7, 8, 9, 10, 11, 12, 13, 14, 15, 16, 17, 18, 19, 20, 21, 22, 23, 24, 25, etc.) such internucleotidic linkages. In some embodiments, such oligonucleotide further comprise one or more other types of internucleotidic linkages, e.g., one or more natural phosphate linkages, and/or one or more phosphorothioate internucleotidic linkages (e.g., in some embodiments, one or more of which are independently chirally controlled; in some embodiments, each of which is independently chirally controlled; in some embodiments, at least one is Rp; in some embodiments, at least one is Sp; in some embodiments, at least one is Rp and at least one is Sp; etc.) In some embodiments, such oligonucleotides are stereopure (substantially free of other stereoisomers). In some embodiments, the present disclosure provides chirally controlled oligonucleotide compositions of such oligonucleotides. In some embodiments, the present disclosure provides chirally pure oligonucleotide compositions of such oligonucleotides.

In some embodiments, modifying proceeds with a stereoselectivity of 80%, 85%, 90%, 91%, 92%, 93%, 94%, 95%, 96%, 97%, 98%, 99% or more. In some embodiments, the stereoselectivity is 85% or more. In some embodiments, the stereoselectivity is 85% or more. In some embodiments, the stereoselectivity is 90% or more. In some embodiments, the stereoselectivity is 91% or more. In some embodiments, the stereoselectivity is 92% or more. In some embodiments, the stereoselectivity is 93% or more. In some embodiments, the stereoselectivity is 94% or more. In some embodiments, the stereoselectivity is 95% or more. In some embodiments, the stereoselectivity is 96% or more. In some embodiments, the stereoselectivity is 97% or more. In some embodiments, the stereoselectivity is 98% or more. In some embodiments, the stereoselectivity is 99% or more. In some embodiments, modifying is stereospecific.

Deblocking

In some embodiments, a cycle comprises a cycle step. In some embodiments, the 5' hydroxyl group of the growing oligonucleotide is blocked (i.e., protected) and must be deblocked in order to subsequently react with a nucleoside coupling partner.

In some embodiments, acidification is used to remove a blocking group. Suitable deblocking technologies (e.g., reagents, conditions, etc.) include those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the deblocking technologies of each of which are incorporated by reference. Certain deblocking technologies, e.g., reagents, conditions, methods, etc. are illustrated in the Examples.

Cleavage and Deprotection

At certain stage, e.g., after the desired oligonucleotide lengths have been achieved, cleavage and/or deprotection are performed to deprotect blocked nucleobases etc. and cleave the oligonucleotide products from support. In some embodiments, cleavage and deprotection are performed separately. In some embodiments, cleavage and deprotection are performed in one step, or in two or more steps but without separation of products in between. In some embodiments, cleavage and/or deprotection utilizes basic conditions and elevated temperature. In some embodiments, for certain chiral auxiliaries, a fluoride condition is required (e.g., TBAF, HF-$ET_3N$, etc., optionally with additional base). Suitable cleavage and deprotection technologies (e.g., reagents, conditions, etc.) include those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the cleavage and deprotection technologies of each of which are incorporated by reference. Certain cleavage and deprotection technologies, e.g., reagents, conditions, methods, etc. are illustrated in the Examples.

In some embodiments, certain chiral auxiliaries are removed under basic conditions. In some embodiments, oligonucleotides are contacted with a base, e.g., an amine having the structure of $N(R)_3$, to remove certain chiral auxiliaries (e.g., those comprising an electronic-withdrawing group in $G^2$ as described in the present disclosure). In some embodiments, a base is $NHR_2$. In some embodiments, each R is independently optionally substituted $C_{1-6}$ aliphatic. In some embodiments, each R is independently optionally substituted $C_{1-6}$ alkyl. In some embodiments, an amine is DEA. In some embodiments, an amine is TEA. In some embodiments, an amine is provided as a solution, e.g., an acetonitrile solution. In some embodiments, such contact is performed under anhydrous conditions. In some embodiments, such a contact is performed immediately after desired oligonucleotide lengths are achieved (e.g., first step post synthesis cycles). In some embodiments, such a contact is performed before removal of chiral auxiliaries and/or protection groups and/or cleavage of oligonucleotides from a solid support. In some embodiments, contact with a base may remove cyanoethyl groups utilized in standard oligonucleotide synthesis, providing an natural phosphate linkage which may exist in a salt form (with the cation being, e.g., an ammonium salt). In some embodiments, contact with a base provides an internucleotidic linkage of formula I-n-1, I-n-2, I-n-3, I-n-4, II, II-a-1, II-a-2, II-b-1, II-b-2, II-c-1, II-c-2, II-d-1, or II-d-2, or a salt form thereof. In some embodiments, contact with a base removes a chiral auxiliary from an internucleotidic linkage of formula I, I-a, I-b, I-c, I-n-1, I-n-2, I-n-3, I-n-4, II, II-a-1, II-a-2, II-b-1, II-b-2, II-c-1, II-c-2, II-d-1, or II-d-2, or a salt form thereof. In some embodiments, contact with a base removes a chiral auxiliary (e.g., —X-L-$R^1$) from an internucleotidic linkage of formula I or a salt form thereof (e.g., wherein $P^L$ is P(=N-L-$R^5$)). In some embodiments, contact with a base removes a chiral auxiliary (e.g., —X-L-$R^1$) from an internucleotidic linkage of formula III or a salt form thereof. In some embodiments, In some embodiments, contact with a base converts an internucleotidic linkage of formula I or a salt form thereof (e.g., wherein $P^L$ is P(=N-L-$R^5$)), or of formula III or a salt form thereof, into an internucleotidic linkage of formula II-n-1, I-n-2, I-n-3, I-n-4, II, II-a-1, II-a-2, II-b-1, II-b-2, II-c-1, II-c-2, II-d-1, or II-d-2, or a salt form thereof.

Cycles

Suitable cycles for preparing oligonucleotides of the present disclosure include those described in U.S. Pat. Nos. 9,695,211, 9,605,019, 9,598,458, US 2013/0178612, US20150211006, US 20170037399, WO 2017/015555, WO 2017/062862, WO 2017/160741, WO 2017/192664, WO 2017/192679, WO 2017/210647 (e.g., Schemes I, I-b, I-c, I-d, I-e, I-f, etc.), WO 2018/223056, WO 2018/237194, and/or WO 2019/055951, the cycles of each of which are incorporated by reference. For example, in some embodiments, an example cycle is Scheme I-f. Certain cycles are illustrated in the Examples (e.g., for preparation of natural phosphate linkages, utilizing other chiral auxiliaries, etc.).

In some embodiments, $R^{2s}$ is —F. In some embodiments, $R^{4s}$ is —H. In some embodiments, $R^{4s}$ and $R^{2s}$ are taken together to form a bridge -L-O— as described in the present disclosure. In some embodiments, the —O— is connected to the carbon at the 2' position. In some embodiments, L is —$CH_2$—. In some embodiments, L is —CH(Me)-. In some embodiments, L is —(R)—CH(Me)-. In some embodiments, L is —(S)—CH(Me)-.

Purification and Characterization

Various purification and/or characterization technologies (methods, instruments, protocols, etc.) can be utilized to purify and/or characterize oligonucleotides and oligonucleotide compositions in accordance with the present disclosure. In some embodiments, purification is performed using various types of HPLC/UPLC technologies. In some embodiments, characterization comprises MS, NMR, UV, Scheme I-e. Example cycle using DPSE chiral auxiliary.

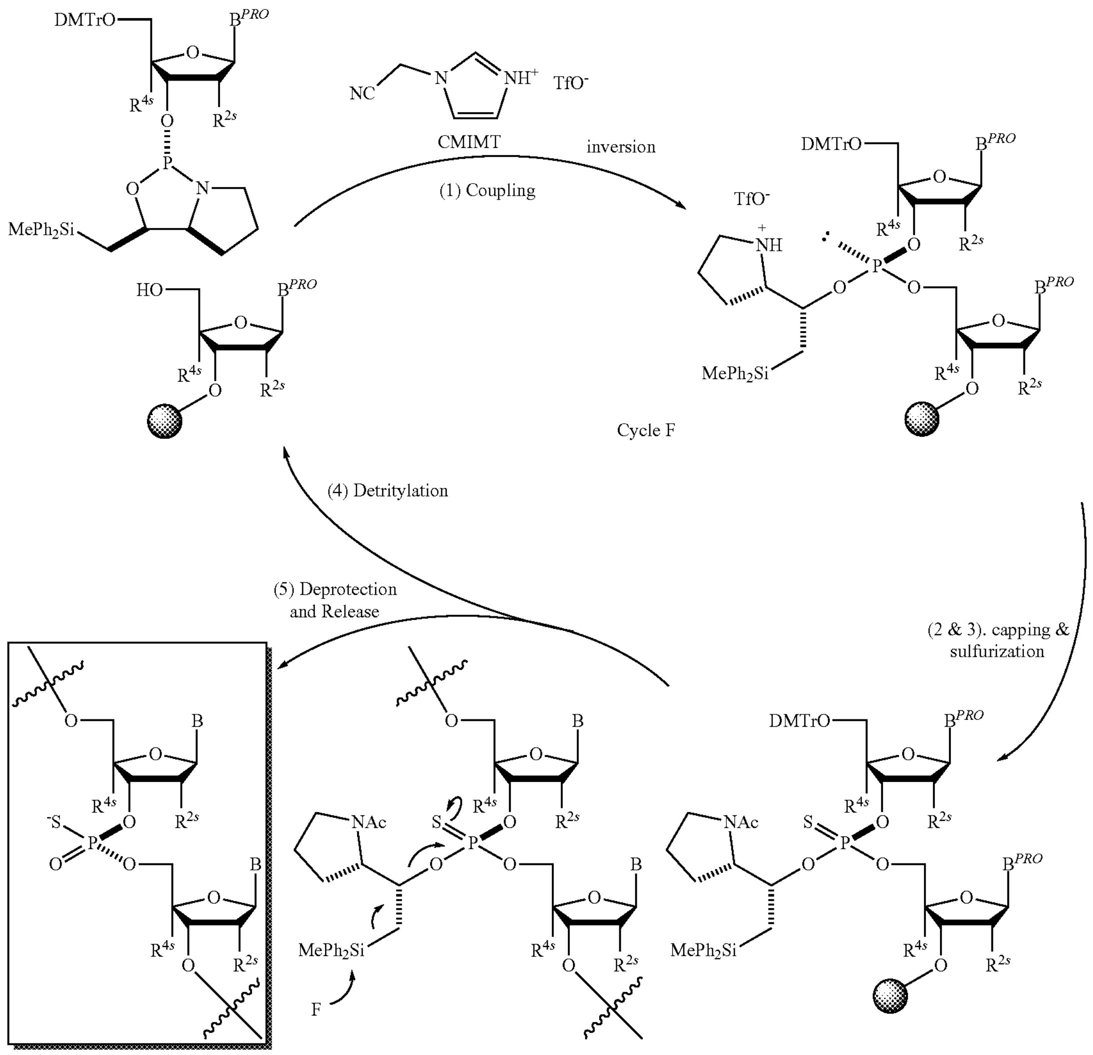

Stereodefined Phosphorothioate Oligonucleotide

In some embodiments, $R^2$ is H or —$OR^1$, wherein $R^1$ is not hydrogen. In some embodiments, $R^{2s}$ is H or —$OR^1$, wherein $R^1$ is optionally substituted $C_{1-6}$ alkyl. In some embodiments, $R^{2s}$ is H. In some embodiments, $R^{2s}$ is —OMe. In some embodiments, $R^{2s}$ is —$OCH_2CH_2OCH_3$.

etc. In some embodiments, purification and characterization may be performed together, e.g., HPLC-MS, UPLC-MS, etc. Example purification and characterization technologies include those described in U.S. Pat. Nos. 9,695,211, 9,605,019, 9,598,458, US 2013/0178612, US20150211006, US 20170037399, WO 2017/015555, WO 2017/062862, WO 2017/160741, WO 2017/192664, WO 2017/192679, WO 2017/210647, WO 2018/223056, WO 2018/237194, and/or WO 2019/055951, the purification and characterization technologies of each of which are incorporated by reference.

In some embodiments, the present disclosure provides methods for preparing provided oligonucleotide and oligonucleotide compositions. In some embodiments, a provided method comprises providing a provided chiral reagent having the structure of formula 3-I or 3-AA. In some embodiments, a provided method comprises providing a provided chiral reagent having the structure of

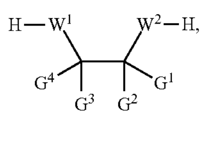

wherein $W^1$ is —$NG^5$, $W^2$ is O, each of $G^1$ and $G^3$ is independently hydrogen or an optionally substituted group selected from $C_{1-10}$ aliphatic, heterocyclyl, heteroaryl and aryl, $G^2$ is —$C(R)_2Si(R)_3$, and $G^4$ and $G^5$ are taken together to form an optionally substituted saturated, partially unsaturated or unsaturated heteroatom-containing ring of up to about 20 ring atoms which is monocyclic or polycyclic, fused or unfused, wherein each R is independently hydrogen, or an optionally substituted group selected from $C_1$-$C_6$ aliphatic, carbocyclyl, aryl, heteroaryl, and heterocyclyl. In some embodiments, a provided chiral reagent has the structure of

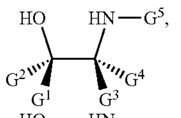 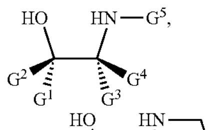

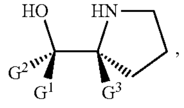 or 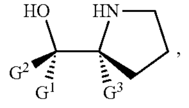

wherein each variable is independently as described in the present disclosure. In some embodiments, a provided methods comprises providing a phosphoramidite comprising a moiety from a chiral reagent having the structure of

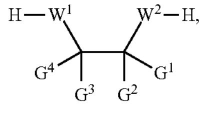 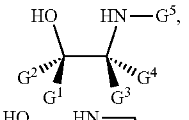

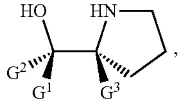 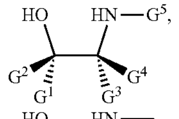 or

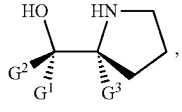

wherein —$W^1H$ and —$W^2H$, or the hydroxyl and amino groups, form bonds with the phosphorus atom of the phosphoramidite. In some embodiments, —$W^1H$ and —$W^2H$, or the hydroxyl and amino groups, form bonds with the phosphorus atom of the phosphoramidite, e.g., in

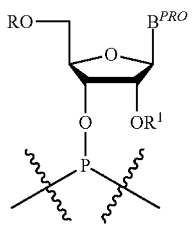 or 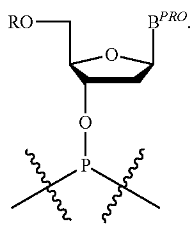

In some embodiments, a phosphoramidite has the structure of

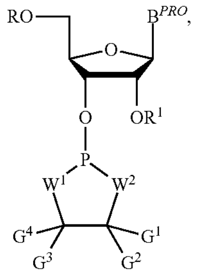 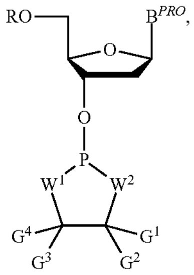

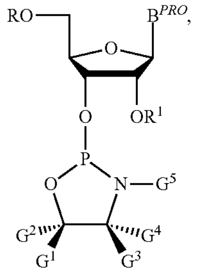 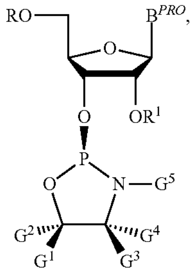

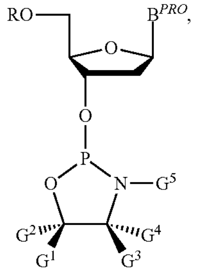 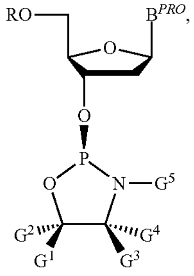

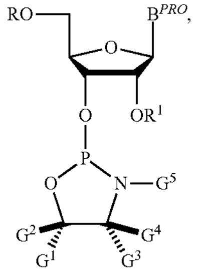 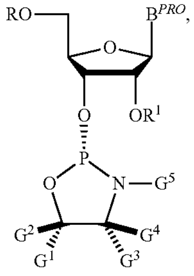

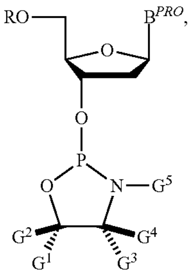
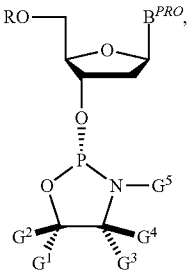
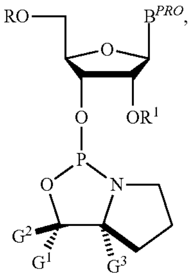
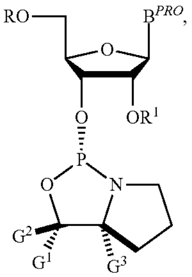
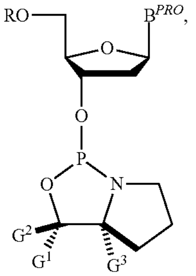
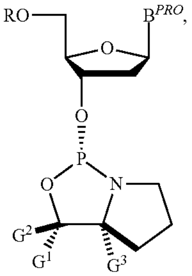
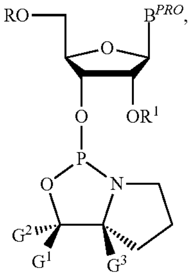
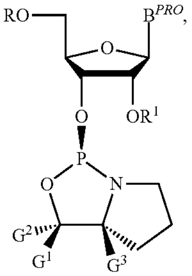
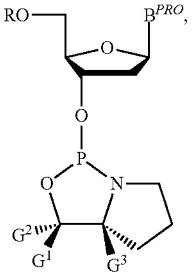
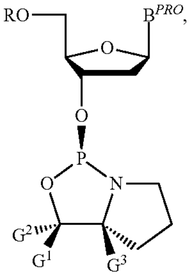
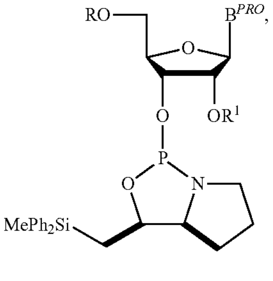
-continued
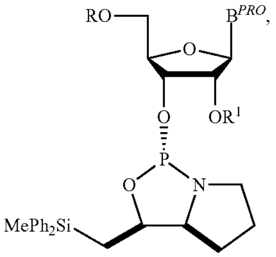
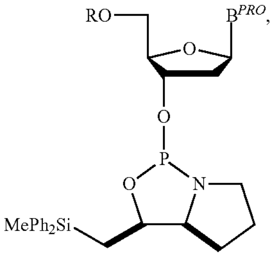
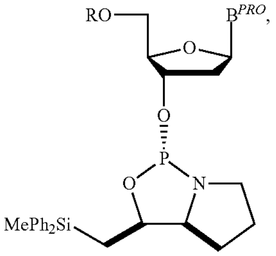
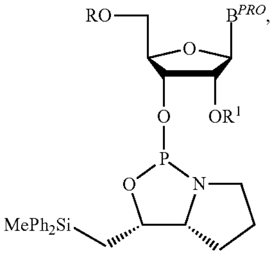
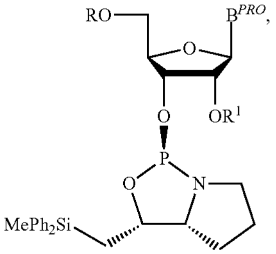
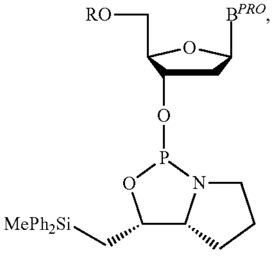

-continued

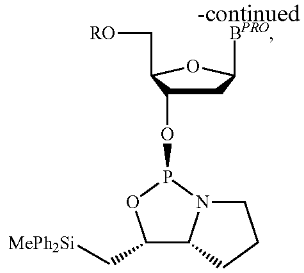,

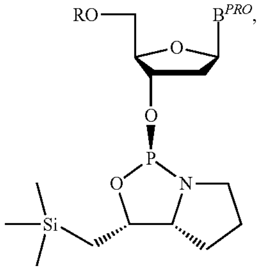,

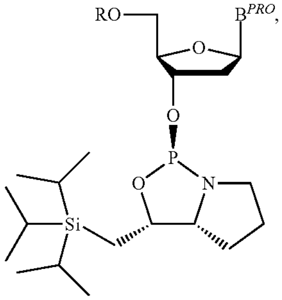,

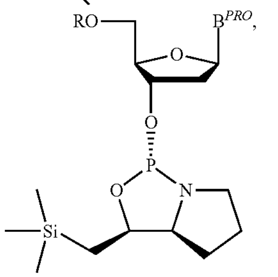, or

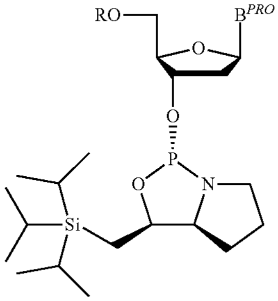

or wherein $B^{PRO}$ is BA as described in the present disclosure, and each other variable is as described in the present disclosure. In some embodiments, $B^{PRO}$ is a protected nucleobase. In some embodiments, $B^{PRO}$ is protected A, T, G, C, U or a tautomers thereof. In some embodiments, R is a protection group. In some embodiments, R is DMTr.

In some embodiments, $G^2$ is —$C(R)_2Si(R)_3$, wherein —$C(R)_2$— is optionally substituted —$CH_2$—, and each R of —$Si(R)_3$ is independently an optionally substituted group selected from $C_{1-10}$ aliphatic, heterocyclyl, heteroaryl and aryl. In some embodiments, at least one R of —$Si(R)_3$ is independently optionally substituted $C_{1-10}$ alkyl. In some embodiments, at least one R of —$Si(R)_3$ is independently optionally substituted phenyl. In some embodiments, one R of —$Si(R)_3$ is independently optionally substituted phenyl, and each of the other two R is independently optionally substituted $C_{1-10}$ alkyl. In some embodiments, one R of —$Si(R)_3$ is independently optionally substituted $C_{1-10}$ alkyl, and each of the other two R is independently optionally substituted phenyl. In some embodiments, $G^2$ is optionally substituted —$CH_2Si(Ph)(Me)_2$. In some embodiments, $G^2$ is optionally substituted —$CH_2Si(Me)(Ph)_2$. In some embodiments, $G^2$ is —$CH_2Si(Me)(Ph)_2$. In some embodiments, $G^2$ is —$CH_2SiMe_3$. In some embodiments, $G^2$ is —$CH_2Si(iPr)_3$. In some embodiments, $G^4$ and $G^5$ are taken together to form an optionally substituted saturated 5-6 membered ring containing one nitrogen atom (to which $G^5$ is attached). In some embodiments, $G^4$ and $G^5$ are taken together to form an optionally substituted saturated 5-membered ring containing one nitrogen atom. In some embodiments, $G^1$ is hydrogen. In some embodiments, $G^3$ is hydrogen. In some embodiments, both $G^1$ and $G^3$ are hydrogen. In some embodiments, both $G^1$ and $G^3$ are hydrogen, $G^2$ is —$C(R)_2Si(R)_3$, wherein —$C(R)_2$— is optionally substituted —$CH_2$—, and each R of —$Si(R)_3$ is independently an optionally substituted group selected from $C_{1-10}$ aliphatic, heterocyclyl, heteroaryl and aryl, and $G^4$ and $G^5$ are taken together to form an optionally substituted saturated 5-membered ring containing one nitrogen atom. In some embodiments, a provided method further comprises providing a fluoro-containing reagent. In some embodiments, a provided fluoro-containing reagent removes a chiral reagent, or a product formed from a chiral reagent, from oligonucleotides after synthesis. Various known fluoro-containing reagents, including those F-sources for removing —$SiR_3$ groups, can be utilized in accordance with the present disclosure, for example, TBAF, $HF_3$—$Et_3N$ etc. In some embodiments, a fluoro-containing reagent provides better results, for example, shorter treatment time, lower temperature, less de-sulfurization, etc, compared to traditional methods, such as concentrated ammonia. In some embodiments, for certain fluoro-containing reagent, the present disclosure provides linkers for improved results, for example, less cleavage of oligonucleotides from support during removal of chiral reagent (or product formed therefrom during oligonucleotide synthesis). In some embodiments, a provided linker is an SP linker. In some embodiments, the present disclosure demonstrated that a HF-base complex can be utilized, such as HF—$NR_3$, to control cleavage during removal of chiral reagent (or product formed therefrom during oligonucleotide synthesis). In some embodiments, HF—$NR_3$ is HF—$NEt_3$. In some embodiments, HF—$NR_3$ enables use of traditional linkers, e.g., succinyl linker.

In some embodiments, as described herein, $G^2$ comprises an electron-withdrawing group, e.g., at its $\alpha$ position. In some embodiments, $G^2$ is methyl substituted with one or more electron-withdrawing groups. In some embodiments, an electronic-withdrawing group comprises and/or is connected to the carbon atom through, e.g., —S(O)—, —$S(O)_2$—, —$P(O)(R^1)$—, —$P(S)R^1$—, or —C(O)—. In some embodiments, an electron-withdrawing group is —CN, —$NO_2$, halogen, —$C(O)R^1$, —C(O)OR', —$C(O)N(R')_2$, —$S(O)R^1$, —$S(O)_2R^1$, —$P(W)(R^1)_2$, —$P(O)(R^1)_2$, —$P(O)(OR')_2$, or —$P(S)(R^1)_2$. In some embodiments, an electron-withdrawing group is aryl or heteroaryl, e.g., phenyl, substituted with one or more of —CN, —$NO_2$, halogen, —$C(O)R^1$, —C(O)OR', —$C(O)N(R')_2$, —$S(O)R^1$, —$S(O)_2R^1$, —$P(W)(R^1)_2$, —$P(O)(R^1)_2$, —$P(O)(OR')_2$, or —$P(S)(R^1)_2$. In some embodiments, $G^2$ is —$CH_2S(O)R'$. In some embodiments, $G^2$ is —$CH_2S(O)_2R'$. In some embodiments, $G^2$ is —$CH_2P(O)(R')_2$. Additional example embodiments are described, e.g., as for chiral reagents/auxiliaries.

Confirmation that a stereocontrolled oligonucleotide (e.g., one prepared by a method described herein or in the art) comprises the intended stereocontrolled (chirally controlled) internucleotidic linkage can be performed using a variety of suitable technologies. A stereocontrolled (chirally controlled) oligonucleotide comprises at least one stereocontrolled internucleotidic linkage, which can be, e.g., a stereocontrolled internucleotidic linkage comprising a phosphorus, a stereocontrolled phosphorothioate internucleotidic linkage (PS) in the Rp configuration, a PS in the Sp configuration, etc. Useful technologies include, as non-limiting examples: NMR (e.g., 1D (one-dimensional) and/or 2D (two-dimensional) $^1H$—$^{31}P$ HETCOR (heteronuclear correlation spectroscopy)), HPLC, RP-HPLC, mass spectrometry, LC-MS, and/or stereospecific nucleases. In some embodiments, stereospecific nucleases include: benzonase, micrococcal nuclease, and svPDE (snake venome phosphodiesterase), which are specific for internucleotidic linkages in the Rp configuration (e.g., a PS in the Rp configuration); and nuclease P1, mung bean nuclease, and nuclease S1, which are specific for internucleotidic linkages in the Sp configuration (e.g., a PS in the Sp configuration).

In some embodiments, the present disclosure pertains to a method of confirming or identifying the stereochemistry pattern of the backbone of an oligonucleotide and/or stereochemistry of particular internucleotidic linkages. In some embodiments, an oligonucleotide comprises a stereocontrolled internucleotidic linkage comprising a phosphorus, a stereocontrolled phosphorothioate (PS) in the Rp configuration, or a PS in the Sp configuration. In some embodiments, an oligonucleotide comprises at least one stereocontrolled internucleotidic linkage and at least one internucleotidic linkage which is not stereocontrolled. In some embodiments, a method comprises digestion of an oligonucleotide with a stereospecific nuclease. In some embodiments, a stereospecific nuclease is selected from: benzonase, micrococcal nuclease, and svPDE (snake venom phosphodiesterase), which are specific for internucleotidic linkages in the Rp configuration (e.g., a PS in the Rp configuration); and nuclease P1, mung bean nuclease, and nuclease S1, which are specific for internucleotidic linkages in the Sp configuration (e.g., a PS in the Sp configuration). In some embodiments, an oligonucleotide or fragments thereof produced by digestion with a stereospecific nuclease are analyzed. In some embodiments, an oligonucleotide or fragments thereof (e.g., produced by digestion with a stereospecific nuclease) are analyzed by NMR, 1D (one-dimensional) and/or 2D (two-dimensional) $^1H$—$^{31}P$ HETCOR (heteronuclear correlation spectroscopy), HPLC, RP-HPLC, mass spectrometry, LC-MS, UPLC, etc. In some embodiments, an oligonucleotide or fragments thereof are compared with chemically synthesized fragments of the oligonucleotide having a known pattern of stereochemistry.

Without wishing to be bound by any particular theory, the present disclosure notes that, in at least some cases, stereospecificity of a particular nuclease may be altered by a modification (e.g., 2'-modification) of a sugar, by a base sequence, or by a stereochemical context. For example, in some embodiments, benzonase and micrococcal nuclease, which are specific for Rp internucleotidic linkages, were both unable to cleave an isolated PS Rp internucleotidic linkage flanked by PS Sp internucleotidic linkages.

Various techniques and materials can be utilized. In some embodiments, the present disclosure provides useful combinations of technologies. For example, in some embodiments, stereochemistry of one or more particular internucleotidic linkages of an oligonucleotide can be confirmed by digestion of the oligonucleotide with a stereospecific nuclease and analysis of the resultant fragments (e.g., nuclease digestion products) by any of a variety of techniques (e.g., separation based on mass-to-charge ratio, NMR, HPLC, mass spectrometry, etc.). In some embodiments, stereochemistry of products of digesting an oligonucleotide with a stereospecific nuclease can be confirmed by comparison (e.g., NMR, HPLC, mass spectrometry, etc.) with chemically synthesized fragments (e.g., dimers, trimers, tetramers, etc.) produced, e.g., via technologies that control stereochemistry.

In one example, an oligonucleotide was confirmed to have the designed and intended pattern of stereochemistry in the backbone. The tested oligonucleotide comprises a core comprising 2'-deoxy nucleosides, wherein all of the internucleotidic linkages were PS in the Sp configuration except for one PS in the Rp configuration; and two wings, each of which comprising 2'-OMe nucleosides, wherein all the internucleotidic linkages in each wing were phosphodiester (PO) except for one PS in the Sp configuration in each wing. The oligonucleotide was digested with a stereospecific nuclease (e.g., nuclease P1). The various fragments were analyzed (e.g., by LC-MS and by comparison with chemically synthesized fragments of known stereochemistry). It was confirmed that the oligonucleotide had the intended pattern of stereochemistry in its backbone.

In another example, an oligonucleotide having a different sequence was confirmed to have the intended pattern of stereochemistry in its backbone, using digestion with a stereospecific nuclease and analysis of the resultant fragments. This oligonucleotide comprises a core comprising 2'-deoxy nucleotides, wherein all of the internucleotidic linkages were PS in the Sp configuration except for one PS in the Rp configuration; and two wings, each of which comprising 2'-OMe nucleotides, wherein all the internucleotidic linkages in each wing were phosphodiester (PO) except for one PS in the Sp configuration in each wing.

In yet another example, a different oligonucleotide was tested to confirm that the internucleotidic linkages were in the intended configurations. The oligonucleotide is capable of skipping exon 51 of DMD; the majority of the nucleotides in the oligonucleotide were 2'-F and the remainder were 2'-OMe; the majority of the internucleotidic linkages in the oligonucleotide were PS in the Sp configuration and the remainder were PO. This oligonucleotide was tested by digestion with stereospecific nucleases, and the resultant digestion fragments were analyzed (e.g., by LC-MS and by comparison with chemically synthesized fragments of known stereochemistry). The results confirmed that the oligonucleotide had the intended pattern of stereocontrolled internucleotidic linkages.

In some embodiments, NMR is useful for characterization and/or confirming stereochemistry. In a set of example experiments, a set of oligonucleotides comprising a stereocontrolled CpG motif were tested to confirm the intended stereochemistry of the CpG motif. Oligonucleotides of the set comprise a motif having the structure of pCpGp, wherein C is Cytosine, G is Guanine, and p is a phosphorothioate which is stereorandom or stereocontrolled (e.g., in the Rp or Sp configuration). For example, one oligonucleotide comprises a pCpGp structure, wherein the pattern of stereochemistry of the phosphorothioates (e.g., the ppp) was RRR; in another oligonucleotide, the pattern of stereochemistry of the ppp was RSS; in another oligonucleotide, the pattern of stereochemistry of the ppp was RSR; etc. In the set, all possible patterns of stereochemistry of the ppp were represented. In the portion of the oligonucleotide outside the pCpGp structure, all the internucleotidic linkages were PO; all nucleosides in the oligonucleotides were 2'-deoxy. These various oligonucleotides were tested in NMR, without digestion with a stereospecific nuclease, and distinctive patterns of peaks were observed, indicating that each PS which was Rp or Sp produced a unique peak, and confirming that the oligonucleotides comprised stereocontrolled PS internucleotidic linkages of the intended stereochemistry.

Stereochemistry patterns of the internucleotidic linkages of various other stereocontrolled oligonucleotides were confirmed, wherein the oligonucleotides comprise a variety of chemical modifications and patterns of stereochemistry.

As those skilled in the art will appreciate, in some embodiments, a product oligonucleotide of a step, cycle or preparation is an oligonucleotide comprising $O^{5P}$, $O^{P}$, $*^{PD}$, $*^{PD}S$, $*^{PD}R$, $*^{N}$, $*^{N}S$ and/or $*^{N}R$ as described herein, which oligonucleotide is optionally linked to a support (e.g., CPG) optionally via a linker (e.g., a CAN linker). For example, in some embodiments, after coupling and/or pre-modification capping and before modification, $O^{5P}$ is

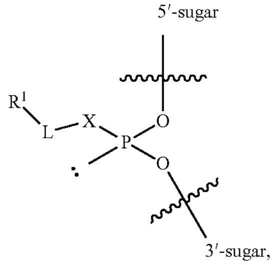

,

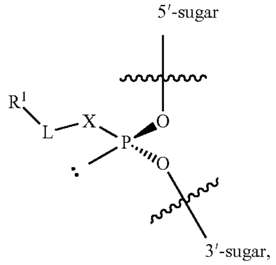

,

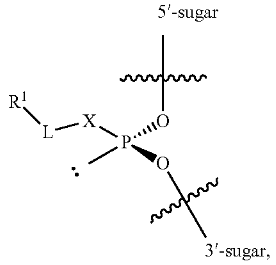

, or a salt form thereof. In some embodiments, after modification $O^{5P}$ is $L^{PO}$, $L^{PA}$, $L^{PB}$, or a salt form thereof.

Metabolites

In some embodiments, a DMD oligonucleotide corresponds to a fragment of a different, longer DMD oligonucleotide. In some embodiments, a DMD oligonucleotide corresponds to a metabolite produced by cleavage (e.g., enzymatic cleavage by a nuclease) of a longer DMD oligonucleotide, which produces a fragment or portion of the longer DMD oligonucleotide. In some embodiments, the present disclosure pertains to an DMD oligonucleotide which corresponds to a metabolite produced by the cleavage of a DMD oligonucleotide described herein. In some embodiments, the present disclosure pertains to a DMD oligonucleotide which corresponds to a portion, or fragment of a DMD oligonucleotide disclosed herein.

Several experiments were performed wherein a DMD oligonucleotide was incubated in vitro in the presence of any of various substances comprising nucleases. In various experiments, such substances include brain homogenatem, cerebrospinal fluid or plasma from Sprague-Dawley rat or Cynomolgus monkey. Plasma was heparinized. Oligonucleotides were incubated for various time points (e.g., 0, 1, 2, 3, 4 or 5 days for brain tissue homogenate, with a pre-incubation period of 0, 1 or 2 days; 0, 1, 2, 4, 8, 16, 24 or 48 hrs for cerebrospinal fluid; or 0, 1, 2, 4, 8, 16 or 24 hrs for plasma). Pre-incubation indicates that the homogenate is incubated at 37 degrees ° C. for 0, 24 or 48 hrs to activate the enzymes before adding the oligonucleotide. Final concentration and volume of oligonucleotides was 20 μM in 200 μl. Products produced by cleavage of the oligonucleotides were analyzed by LC/MS.

For one DMD oligonucleotide, which is 20 bases long, tested in rat brain homogenate, the major metabolites represented the 3' end of the oligonucleotide, which were truncated by 4, 10, 11, 12, or 13 bases.

One test DMD oligonucleotide has a length of 20 bases and was tested in rat brain homogenate, yielding major metabolites which were truncated at the 5' end by 4, 10, 11, 12, or 13 bases, leaving metabolites representing the 3' end of the oligonucleotide and which were 16, 10, 9, 8 or 7 bases long, respectively. This oligonucleotide also produced a metabolite which was a 5' fragment which was 12 bases long (truncated at the 3' end by 8 bases).

A second test oligonucleotide has a length of 20 bases and was tested in rat brain homogenate, yielding major metabolites which were truncated at the 3' end by 4, 8, 9 or 10 bases, leaving metabolites representing the 5' end of the oligonucleotide and which were 16, 12, 11 or 10 bases long, respectively.

The two tested oligonucleotides comprise internucleotidic linkages which are phosphodiesters, phosphorothioate in the Rp configuration, and phosphorothioates in the Sp configuration. In some embodiments, phosphodiesters were more labile than the phosphorothioate in the Rp configuration or the phosphorothioate in the Sp configuration. In some cases, a metabolite of an oligonucleotide represents a product of a cleavage at a phosphodiester.

In some embodiments, the present disclosure pertains to a DMD oligonucleotide which corresponds to a metabolite of a DMD oligonucleotide disclosed herein. In some embodiments, the present disclosure pertains to a DMD oligonucleotide which is 1, 2, 3, 4, 5, 6, 7, 8, 9, 10,11, 12, 13, or more bases shorter than a DMD oligonucleotide disclosed herein. In some embodiments, the present disclosure pertains to a DMD oligonucleotide which has a base sequence which is 1, 2, 3, 4, 5, 6, 7, 8, 9, 10,11, 12, 13, or more bases shorter than that of a DMD oligonucleotide disclosed herein.

In some embodiments, a metabolite is designated as 3'-N-#, or 5'-N- #, wherein the # indicates the number of bases removed, and the 3' or 5' indicates which end of the molecule from which the bases were deleted. For example, 3'-N-1 indicates a fragment or metabolite wherein 1 base was removed from the 3' end.

In some embodiments, the present disclosure perhaps to an oligonucleotide which corresponds to a fragment or metabolite of a DMD oligonucleotide disclosed herein, wherein the fragment or metabolite can be described as corresponding to 3'-N-1, 3'-N-2, 3'-N-3, 3'-N-4, 3'-N-5, 3'-N-6, 3'-N-7, 3'-N-8, 3'-N-9, 3'-N-10, 3'-N-11, 3'-N-12, 5'-N-1, 5'-N-2, 5'-N-3, 5'-N-4, 5'-N-5, 5'-N-6, 5'-N-7, 5'-N-8, 5'-N-9, 5'-N-10, 5'-N-11, or 5'-N-12 of a DMD oligonucleotide described herein.

In some embodiments, the present disclosure pertains to a DMD oligonucleotide which is 1, 2, 3, 4, 5, 6, 7, 8, 9, 10,11, 12, 13, or more bases shorter on the 5' end than a DMD oligonucleotide disclosed herein. In some embodiments, the present disclosure pertains to a DMD oligonucleotide which has a base sequence which is 1, 2, 3, 4, 5, 6, 7, 8, 9, 10,11, 12, 13, or more bases shorter on the 5' end than that of a DMD oligonucleotide disclosed herein. In some embodiments, the present disclosure pertains to a DMD oligonucleotide which is 1, 2, 3, 4, 5, 6, 7, 8, 9, 10,11, 12, 13, or more bases shorter on the 3' end than a DMD oligonucleotide disclosed herein. In some embodiments, the present disclosure pertains to a DMD oligonucleotide which has a base sequence which is 1, 2, 3, 4, 5, 6, 7, 8, 9, 10,11, 12, 13, or more bases shorter on the 3' end than that of a DMD oligonucleotide disclosed herein.

In some embodiments, the present disclosure pertains to a DMD which corresponds to a metabolite of a DMD oligonucleotide, wherein the metabolite is truncated on the 5' and/or 3' end relative to the DMD oligonucleotide disclosed herein. In some embodiments, the present disclosure pertains to a DMD which corresponds to a metabolite of a DMD oligonucleotide, wherein the metabolite is truncated on both the 5' and 3' end relative to the DMD oligonucleotide disclosed herein. In some embodiments, the present disclosure pertains to a DMD oligonucleotide which is 1, 2, 3, 4, 5, 6, 7, 8, 9, 10,11, 12, 13, or more total bases shorter on the 5' and/or 3' end than a DMD oligonucleotide disclosed herein. In some embodiments, the present disclosure pertains to a DMD oligonucleotide which has a base sequence which is 1, 2, 3, 4, 5, 6, 7, 8, 9, 10,11, 12, 13, or more bases total shorter on the 5' and/or 3' end than that of a DMD oligonucleotide disclosed herein.

In some embodiments, the present disclosure pertains to a DMD oligonucleotide which would be represented by a product of cleavage of a DMD oligonucleotide disclosed herein, which is cleaved at a phosphodiester linkage. In some embodiments, the present disclosure pertains to a DMD oligonucleotide which would be represented by a product of cleavage of a DMD oligonucleotide disclosed herein, if such an oligonucleotide were cleaved at a phosphorothioate linkage in the Rp configuration. In some embodiments, the present disclosure pertains to a DMD oligonucleotide which would be represented by a product of cleavage of a DMD oligonucleotide disclosed herein, if such an oligonucleotide were cleaved at one or more phosphodiester linkages and/or phosphorothioate linkages in the Rp configuration.

Biological Applications, Example Use, and Dosing Regimens

As described herein, provided compositions and methods are useful for various purposes, e.g., those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, and/or WO 2017/210647. Among other things, provided technologies can function and/or provide various benefits through a number of chemical and/or biological mechanisms, pathways, etc. (e.g., RNase H, RNAi, splicing modulation (exon skipping (e.g., for DMD in DMD subjects/samples), exon inclusion (e.g., for SMN2 in SMA subjects/samples)), etc.). In some embodiments, provided technologies reduce levels, activities, expressions, etc. of a nucleic acid and/or a product thereof. For example, in some embodiments, provided technologies reduce levels and/or activities of target transcripts and/or products encoded thereby (without the intention to be limited by any particular theory, in some embodiments, via RNase H pathway). In some embodiments, provided technologies increase levels and/or activities of target transcripts and/or products encoded thereby (without the intention to be limited by any particular theory, in some embodiments, via exon skipping). A number of oligonucleotides comprising various types of modified internucleotidic linkages, including many comprising non-negatively charged internucleotidic linkages (e.g., n001), which have various base sequences and/or target various nucleic acids (e.g., transcripts of various genes) were prepared, and various useful properties, activities, and/or advantages were demonstrated. Certain such oligonucleotides, including many comprising non-negatively charged internucleotidic linkages, target transcripts of PNPLA3, C9orf72, SMN2, etc. and have demonstrated various activities and/or benefits. Example oligonucleotides comprising non-negatively charged internucleotidic linkages and targeting various genes, and compositions and uses thereof, include those described in WO 2018/223056, WO 2019/032607, PCT/US18/55653, and WO 2019/032612, each of which is independently incorporated herein by reference.

In some embodiments, the present disclosure provides methods for modulating level of a transcript or a product encoded thereby in a system, comprising administering an effective amount of a provided oligonucleotide or a composition thereof. In some embodiments, the present disclosure provides methods for modulating level of a transcript or a product encoded thereby in a system, comprising contacting the transcript a provided oligonucleotide or a composition thereof. In some embodiments, a system is an in vitro system. In some embodiments, a system is a cell. In some embodiments, a system is a tissue. In some embodiments, a system is an organ. In some embodiments, a system is an organism. In some embodiments, a system is a subject. In some embodiments, a system is a human. In some embodiments, modulating level of a transcript decreases level of the transcript. In some embodiments, modulating level of a transcript increases level of the transcript.

In some embodiments, the present disclosure provides methods for preventing or treating a condition, disease, or disorder associated with a nucleic acid sequence or a product encoded thereby, comprising administering to a subject suffering therefrom or susceptible thereto an effective amount of a provided oligonucleotide or composition thereof, wherein the oligonucleotide or composition thereof modulate level of a transcript of the nucleic acid sequence. In some embodiments, a nucleic acid sequence is a gene. In some embodiments, modulating level of a transcript decreases level of the transcript. In some embodiments, modulating level of a transcript increases level of the transcript.

In some embodiments, change of the level of a modulated transcript, e.g., through knock-down, exon skipping, etc., is at least 1.1, 1.2, 1.3, 1.4, 1.5, 2, 3, 4, 5, 6, 7, 8, 9, 10, 15, 20, 25, 30, 40, 50, 100, 200, 500, or 1000 fold.

In some embodiments, provided oligonucleotides and oligonucleotide compositions modulate splicing. In some embodiments, provided oligonucleotides and oligonucleotide compositions promote exon skipping, thereby produce a level of a transcript which has increased beneficial functions that the transcript prior to exon skipping. In some embodiments, a beneficial function is encoding a protein that has increased biological functions. In some embodiments, the present disclosure provides methods for modulating splicing, comprising administering to a splicing system a provided oligonucleotide or oligonucleotide composition, wherein splicing of at least one transcript is altered. In some embodiments, level of at least one splicing product is increased at least 1.1, 1.2, 1.3, 1.4, 1.5, 2, 3, 4, 5, 6, 7, 8, 9, 10, 15, 20, 25, 30, 40, 50, 100, 200, 500, or 1000 fold. In some embodiments, the present disclosure provides methods for modulating DMD splicing, comprising administering to a splicing system a provided DMD oligonucleotide or composition thereof.

In some embodiments, the present disclosure provides methods for preventing or treating DMD, comprising administering to a subject susceptible thereto or suffering therefrom a pharmaceutical composition comprising an effective amount of a provided oligonucleotide or oligonucleotide composition.

In some embodiments, provided compositions and methods provide improved splicing patterns of transcripts compared to a reference pattern, which is a pattern from a reference condition selected from the group consisting of absence of the composition, presence of a reference composition, and combinations thereof. An improvement can be an improvement of any desired biological functions. In some embodiments, for example, in DMD, an improvement is production of an mRNA from which a dystrophin protein with improved biological activities is produced.

In some embodiments, particularly useful and effective are chirally controlled oligonucleotides and chirally controlled oligonucleotide compositions, wherein the oligonucleotides (or oligonucleotides of a plurality in chirally controlled oligonucleotide compositions) optionally comprises one or more non-negatively charged internucleotidic linkages. Among other things, such oligonucleotides and oligonucleotide compositions can provide greatly improved effects, better delivery, lower toxicity, etc.

For Duchenne muscular dystrophy, example mutations and/or suitable DMD exons for skipping are widely known in the art, including but not limited to those described in U.S. Pat. No. 8,759,507, US Patent No. U.S. Pat. No. 8,486,907, and reference cited therein.

In some embodiments, one or more skipped exons are selected from exon 2, 29, 40, 41, 42, 43, 44, 45, 46, 47, 48, 49, 50, 51, 52, 53, 54, 55, 56, 57, 58, 59 and 60. In some embodiments, exon 2 of DMD is skipped. In some embodiments, exon 29 of DMD is skipped. In some embodiments, exon 40 of DMD is skipped. In some embodiments, exon 41 of DMD is skipped. In some embodiments, exon 42 of DMD is skipped. In some embodiments, exon 43 of DMD is skipped. In some embodiments, exon 44 of DMD is skipped. In some embodiments, exon 45 of DMD is skipped. In some embodiments, exon 46 of DMD is skipped. In some embodiments, exon 47 of DMD is skipped. In some embodiments, exon 48 of DMD is skipped. In some embodiments, exon 49 of DMD is skipped. In some embodiments, exon 50 of DMD is skipped. In some embodiments, exon 51 of DMD is skipped. In some embodiments, exon 52 of DMD is skipped. In some embodiments, exon 53 of DMD is skipped. In some embodiments, exon 54 of DMD is skipped. In some embodiments, exon 50 of DMD is skipped. In some embodiments, exon 55 of DMD is skipped. In some embodiments, a skipped exon is any exon whose inclusion decreases a desired function of DMD. In some embodiments, a skipped exon is any exon whose skipping increased a desired function of DMD.

In some embodiments, more than one exon of DMD is skipped. In some embodiments, two or more exons of DMD are skipped. In some embodiments, two or more adjacent exons of DMD are skipped.

In some embodiments, for exon skipping of DMD transcript, or for treatment of DMD, a sequence of a provided plurality of oligonucleotides comprises a DMD sequence list herein. In some embodiments, a sequence comprises one of SEQ ID Nos 1-30 of U.S. Pat. No. 8,759,507. In some embodiments, a sequence comprises one of SEQ ID Nos 1-211 of US Patent No. U.S. Pat. No. 8,486,907. In some embodiments, for exon skipping of DMD transcript, or for treatment of DMD, a sequence of a provided plurality of oligonucleotides is a DMD sequence disclosed herein. In some embodiments, a sequence is one of SEQ ID Nos 1-30 of U.S. Pat. No. 8,759,507. In some embodiments, a sequence is one of SEQ ID Nos 1-211 of US Patent No. U.S. Pat. No. 8,486,907. In some embodiments, a sequence is, comprises or comprises at least 15 consecutive bases of the sequence of any oligonucleotide list herein, e.g., in Table A1. In some embodiments, a sequence is one described in Kemaladewi, et al., Dual exon skipping in myostatin and dystrophin for Duchenne muscular dystrophy, BMC Med Genomics. 2011 Apr. 20; 4:36. doi: 10.1186/1755-8794-4-36; or Malerba et al., Dual Myostatin and Dystrophin Exon Skipping by Morpholino Nucleic Acid Oligomers Conjugated to a Cell-penetrating Peptide Is a Promising Therapeutic Strategy for the Treatment of Duchenne Muscular Dystrophy, Mol Ther Nucleic Acids. 2012 Dec. 18;1: e62. doi: 10.1038/mtna.2012.54.

In some embodiments, a provided oligonucleotide composition is administered at a dose and/or frequency lower than that of an otherwise comparable reference oligonucleotide composition with comparable effect in altering the splicing of a target transcript. In some embodiments, a stereocontrolled (chirally controlled) oligonucleotide composition is administered at a dose and/or frequency lower than that of an otherwise comparable stereorandom reference oligonucleotide composition with comparable effect in altering the splicing of the target transcript. If desired, a provided composition can also be administered at higher dose/frequency due to its lower toxicities.

In some embodiments, provided oligonucleotides, compositions and methods have low toxicities, e.g., when compared to a reference composition. As widely known in the art, oligonucleotides can induce toxicities when administered to, e.g., cells, tissues, organism, etc. In some embodiments, oligonucleotides can induce undesired immune response. In some embodiments, oligonucleotide can induce complement activation. In some embodiments, oligonucleotides can induce activation of the alternative pathway of complement. In some embodiments, oligonucleotides can induce inflammation. Among other things, the complement system has strong cytolytic activity that can damages cells and should therefore be modulated to reduce potential injuries. In some embodiments, oligonucleotide-induced vascular injury is a recurrent challenge in the development of oligonucleotides for e.g., pharmaceutical use. In some embodiments, a primary source of inflammation when high doses of oligonucleotides are administered involves activation of the alternative complement cascade. In some embodiments, complement activation is a common challenge associated with phosphorothioate-containing oligonucleotides, and there is also a potential of some sequences of phosphorothioates to induce innate immune cell activation. In some embodiments, cytokine release is associated with administration of oligonucleotides. For example, in some embodiments, increases in interleukin-6 (IL-6) monocyte chemoattractant protein (MCP-1) and/or interleukin-12 (IL-12) is observed. See, e.g., Frazier, Antisense Oligonucleotide Therapies: The Promise and the Challenges from a Toxicologic Pathologist's Perspective. *Toxicol Pathol.,* 43:78-89, 2015; and Engelhardt, et al., Scientific and Regulatory Policy Committee Points-to-consider Paper: Drug-induced Vascular Injury Associated with Nonsmall Molecule Therapeutics in Preclinical Development: Part 2. Antisense Oligonucleotides. *Toxicol Pathol.* 43:935-944, 2015.

Oligonucleotide compositions as provided herein can be used as agents for modulating a number of cellular processes and machineries, including but not limited to, transcription, translation, immune responses, epigenetics, etc. In addition, oligonucleotide compositions as provided herein can be used as reagents for research and/or diagnostic purposes. One of ordinary skill in the art will readily recognize that the present disclosure disclosure herein is not limited to particular use but is applicable to any situations where the use of synthetic oligonucleitides is desirable. Among other things, provided compositions are useful in a variety of therapeutic, diagnostic, agricultural, and/or research applications.

Various dosing regimens can be utilized to administer provided chirally controlled oligonucleotide compositions, e.g., those described in in U.S. Pat. Nos. 9,695,211, 9,605, 019, 9,598,458, US 2013/0178612, US20150211006, US20170037399, WO 2017/015555, WO 2017/062862, WO 2017/160741, WO 2017/192664, WO 2017/192679, and/or WO 2017/210647, the dosing regimens of each of which is incorporated herein by reference.

In some embodiments, with their low toxicity, provided oligonucleotides and compositions can be administered in higher dosage and/or with higher frequency. In some embodiments, with their improved delivery (and other properties), provided compositions can be administered in lower dosages and/or with lower frequency to achieve biological effects, for example, clinical efficacy.

A single dose can contain various amounts of oligonucleotides. In some embodiments, a single dose can contain various amounts of a type of chirally controlled oligonucleotide, as desired suitable by the application. In some embodiments, a single dose contains about 1, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300 or more (e.g., about 350, 400, 450, 500, 550, 600, 650, 700, 750, 800, 850, 900, 950, 1000 or more) mg of a type of chirally controlled oligonucleotide. In some embodiments, a chirally controlled oligonucleotide is administered at a lower amount in a single dose, and/or in total dose, than a chirally uncontrolled oligonucleotide. In some embodiments, a chirally controlled oligonucleotide is administered at a lower amount in a single dose, and/or in total dose, than a chirally uncontrolled oligonucleotide due to improved efficacy. In some embodiments, a chirally controlled oligonucleotide is administered at a higher amount in a single dose, and/or in total dose, than a chirally uncontrolled oligonucleotide. In some embodiments, a chirally controlled oligonucleotide is administered at a higher amount in a single dose, and/or in total dose, than a chirally uncontrolled oligonucleotide due to improved safety.

Pharmaceutical Compositions

When used as therapeutics, a provided oligonucleotide or oligonucleotide composition described herein is administered as a pharmaceutical composition. In some embodiments, the pharmaceutical composition comprises a therapeutically effective amount of a provided oligonucleotides, or a pharmaceutically acceptable salt thereof, and at least one pharmaceutically acceptable inactive ingredient selected from pharmaceutically acceptable diluents, pharmaceutically acceptable excipients, and pharmaceutically acceptable carriers. In some embodiments, in provided compositions provided oligonucleotides may exist as salts, preferably pharmaceutically acceptable salts, e.g., sodium salts, ammonium salts, etc. In some embodiments, a salt of a provided oligonucleotide comprises two or more cations, for example, in some embodiments, up to the number of negatively charged acidic groups (e.g., phosphate, phosphorothioate, etc.) in an oligonucleotide. As appreciated by those skilled in the art, oligonucleotides described herein may be provided and/or utilized in a salt form, particularly a pharmaceutically acceptable salt form.

In some embodiments, the present disclosure provides salts of provided oligonucleotides, e.g., chirally controlled oligonucleotides, and pharmaceutical compositions thereof. In some embodiments, a salt is a pharmaceutically acceptable salt. In some embodiments, each hydrogen ion that may be donated to a base (e.g., under conditions of an aqueous solution, a pharmaceutical composition, etc.) is replaced by a non-$H^+$ cation. For example, in some embodiments, a pharmaceutically acceptable salt of an oligonucleotide is an all-metal ion salt, wherein each hydrogen ion (for example, of —OH, —SH, etc., acidic enough in water) of each internucleotidic linkage (e.g., a natural phosphate linkage, a phosphorothioate diester linkage, etc.) is replaced by a metal ion. In some embodiments, a provided salt is an all-sodium salt. In some embodiments, a provided pharmaceutically acceptable salt is an all-sodium salt. In some embodiments, a provided salt is an all-sodium salt, wherein each internucleotidic linkage which is a natural phosphate linkage (acid form —O—P(O)(OH)—O—), if any, exists as its sodium salt form (—O—P(O)(ONa)—O—), and each internucleotidic linkage which is a phosphorothioate diester linkage (phosphorothioate internucleotidic linkage; acid form —O—P(O)(SH)—O—), if any, exists as its sodium salt form (—O—P(O)(SNa)—O—).

In some embodiments, the pharmaceutical composition is formulated for intravenous injection, oral administration, buccal administration, inhalation, nasal administration, topical administration, ophthalmic administration or otic administration. In some embodiments, the pharmaceutical composition is a tablet, a pill, a capsule, a liquid, an inhalant, a nasal spray solution, a suppository, a suspension, a gel, a colloid, a dispersion, a suspension, a solution, an emulsion, an ointment, a lotion, an eye drop or an ear drop.

In some embodiments, the present disclosure provides a pharmaceutical composition comprising chirally controlled oligonucleotide, or composition thereof, in admixture with a pharmaceutically acceptable excipient. One of skill in the art will recognize that the pharmaceutical compositions include the pharmaceutically acceptable salts of the chirally controlled oligonucleotide, or composition thereof, described above.

A variety of supramolecular nanocarriers can be used to deliver nucleic acids. Example nanocarriers include, but are not limited to liposomes, cationic polymer complexes and various polymeric. Complexation of nucleic acids with various polycations is another approach for intracellular delivery; this includes use of PEGlyated polycations, polyethyleneamine (PEI) complexes, cationic block co-polymers, and dendrimers. Several cationic nanocarriers, including PEI and polyamidoamine dendrimers help to release contents from endosomes. Other approaches include use of polymeric nanoparticles, polymer micelles, quantum dots and lipoplexes. In some embodiments, an oligonucleotide is conjugated to another molecular.

Additional nucleic acid delivery strategies are known in addition to the example delivery strategies described herein.

In therapeutic and/or diagnostic applications, the compounds of the disclosure can be formulated for a variety of modes of administration, including systemic and topical or localized administration. Techniques and formulations generally may be found in Remington, The Science and Practice of Pharmacy, (20th ed. 2000).

Provided oligonucleotides, and compositions thereof, are effective over a wide dosage range. For example, in the treatment of adult humans, dosages from about 0.01 to about 1000 mg, from about 0.5 to about 100 mg, from about 1 to about 50 mg per day, and from about 5 to about 100 mg per day are examples of dosages that may be used. The exact dosage will depend upon the route of administration, the form in which the compound is administered, the subject to be treated, the body weight of the subject to be treated, and the preference and experience of the attending physician.

Pharmaceutically acceptable salts are generally well known to those of ordinary skill in the art, and may include, by way of example but not limitation, acetate, benzenesulfonate, besylate, benzoate, bicarbonate, bitartrate, bromide, calcium edetate, carnsylate, carbonate, citrate, edetate, edisylate, estolate, esylate, fumarate, gluceptate, gluconate, glutamate, glycollylarsanilate, hexylresorcinate, hydrabamine, hydrobromide, hydrochloride, hydroxynaphthoate, iodide, isethionate, lactate, lactobionate, malate, maleate, mandelate, mesylate, mucate, napsylate, nitrate, pamoate (embonate), pantothenate, phosphate/diphosphate, polygalacturonate, salicylate, stearate, subacetate, succinate, sulfate, tannate, tartrate, or teoclate. Other pharmaceutically acceptable salts may be found in, for example, Remington, The Science and Practice of Pharmacy (20th ed. 2000). Preferred pharmaceutically acceptable salts include, for example, acetate, benzoate, bromide, carbonate, citrate, gluconate, hydrobromide, hydrochloride, maleate, mesylate, napsylate, pamoate (embonate), phosphate, salicylate, succinate, sulfate, or tartrate.

As appreciated by a person having oridinary skill in the art, oligonucleotides may be formulated as a number of salts for, e.g., pharmaceutical uses. In some embodiments, a salt is a metal cation salt and/or ammonium salt. In some embodiments, a salt is a metal cation salt of an oligonucleotide. In some embodiments, a salt is an ammonium salt of an oligonucleotide. Representative alkali or alkaline earth metal salts include sodium, lithium, potassium, calcium, magnesium, and the like. In some embodiments, a salt is a sodium salt of an oligonucleotide. In some embodiments, pharmaceutically acceptable salts include, when appropriate, nontoxic ammonium, quaternary ammonium, and amine cations formed with oligonucleotides. As appreciated by a person having oridinary skill in the art, a salt of an oligonucleotide may contain more than one cations, e.g., sodium ions, as there may be more than one anions within an oligonucleotide.

Depending on the specific conditions being treated, such agents may be formulated into liquid or solid dosage forms and administered systemically or locally. The agents may be delivered, for example, in a timed- or sustained-low release form as is known to those skilled in the art. Techniques for formulation and administration may be found in Remington, The Science and Practice of Pharmacy (20th ed. 2000). Suitable routes may include oral, buccal, by inhalation spray, sublingual, rectal, transdermal, vaginal, transmucosal, nasal or intestinal administration; parenteral delivery, including intramuscular, subcutaneous, intramedullary injections, as well as intrathecal, direct intraventricular, intravenous, intraarticullar, intra-sternal, intra-synovial, intra-hepatic, intralesional, intracranial, intraperitoneal, intranasal, or intraocular injections or other modes of delivery.

For injection, the agents of the disclosure may be formulated and diluted in aqueous solutions, such as in physiologically compatible buffers such as Hank's solution, Ringer's solution, or physiological saline buffer. For such transmucosal administration, penetrants appropriate to the barrier to be permeated are used in the formulation. Such penetrants are generally known in the art.

Use of pharmaceutically acceptable inert carriers to formulate the compounds herein disclosed for the practice of the disclosure into dosages suitable for systemic administration is within the scope of the disclosure. With proper choice of carrier and suitable manufacturing practice, the compositions of the present disclosure, in particular, those formulated as solutions, may be administered parenterally, such as by intravenous injection.

Compounds, e.g., oligonucleotides, can be formulated readily using pharmaceutically acceptable carriers well known in the art into dosages suitable for oral administration. Such carriers enable the compounds of the disclosure to be formulated as tablets, pills, capsules, liquids, gels, syrups, slurries, suspensions and the like, for oral ingestion by a subject (e.g., patient) to be treated.

For nasal or inhalation delivery, the agents of the disclosure may also be formulated by methods known to those of skill in the art, and may include, for example, but not limited to, examples of solubilizing, diluting, or dispersing substances such as, saline, preservatives, such as benzyl alcohol, absorption promoters, and fluorocarbons.

In certain embodiments, oligonucleotides and compositions are delivered to the CNS. In certain embodiments, oligonucleotides and compositions are delivered to the cerebrospinal fluid. In certain embodiments, oligonucleotides and compositions are administered to the brain parenchyma. In certain embodiments, oligonucleotides and compositions are delivered to an animal/subject by intrathecal administration, or intracerebroventricular administration. Broad distribution of oligonucleotides and compositions, described herein, within the central nervous system may be achieved with intraparenchymal administration, intrathecal administration, or intracerebroventricular administration.

In certain embodiments, parenteral administration is by injection, by, e.g., a syringe, a pump, etc. In certain embodiments, the injection is a bolus injection. In certain embodiments, the injection is administered directly to a tissue, such as striatum, caudate, cortex, hippocampus and cerebellum.

In certain embodiments, methods of specifically localizing a pharmaceutical agent, such as by bolus injection, decreases median effective concentration (EC50) by a factor of 20, 25, 30, 35, 40, 45 or 50. In certain embodiments, the targeted tissue is brain tissue. In certain embodiments the targeted tissue is striatal tissue. In certain embodiments, decreasing EC50 is desirable because it reduces the dose required to achieve a pharmacological result in a patient in need thereof.

In certain embodiments, an oligonucleotide is delivered by injection or infusion once every month, every two months, every 90 days, every 3 months, every 6 months, twice a year or once a year.

Pharmaceutical compositions suitable for use in the present disclosure include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of an active compound into preparations which can be used pharmaceutically. The preparations formulated for oral administration may be in the form of tablets, dragees, capsules, or solutions.

Pharmaceutical preparations for oral use can be obtained by combining an active compound with solid excipients, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations, for example, maize starch, wheat starch, rice starch, potato starch, gelatin, gum tragacanth, methyl cellulose, hydroxypropylmethyl-cellulose, sodium carboxymethyl-cellulose (CMC), and/or polyvinylpyrrolidone (PVP: povidone). If desired, disintegrating agents may be added, such as the cross-linked polyvinylpyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinylpyrrolidone, carbopol gel, polyethylene glycol (PEG), and/or titanium dioxide, lacquer solutions, and suitable organic solvents or solvent mixtures. Dye-stuffs or pigments may be added to the tablets or dragee coatings for identification or to characterize different combinations of active compound doses.

Pharmaceutical preparations that can be used orally include push-fit capsules made of gelatin, as well as soft, sealed capsules made of gelatin, and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, an active compound may be dissolved or suspended in suitable liquids, such as fatty oils, liquid paraffin, or liquid polyethylene glycols (PEGs). In addition, stabilizers may be added.

In some embodiments, any DMD oligonucleotide, or combination thereof, described herein, or any composition comprising a DMD oligonucleotide described herein, can be combined with any pharmaceutical preparation described herein or known in the art.

Certain Embodiments of Conjugates and Additional Chemical Moieties

In some embodiments, provided oligonucleotides comprise one or more additional chemical moieties (e.g., other than typical moieties of nucleobases, sugars and/or internucleotidic linkages, etc.), optionally through a linker. In some embodiments, a chemical moiety is a lipid moiety. In some embodiments, a chemical moiety is a carbohydrate moiety. In some embodiments, a chemical moiety is a targeting moiety. In some embodiments, a chemical moiety is a moiety of a ligand. In some embodiments, a chemical moiety can increase delivery of oligonucleotides to certain organelles, cells, tissues, organs, and/or organisms. In some embodiments, a chemical moiety enhances one or more of desired properties and/or activities. Certain example chemical moieties utilized in certain oligonucleotides are presented in the Tables (e.g., various Mod in Table A1). In some embodiments, a chemical moiety comprises one or more sugar moieties or derivatives thereof, e.g., glucose, mannose, etc. In some embodiments, a chemical moiety is or comprises a lipid moiety. In some embodiments, a chemical moiety is or comprises a vitamin E moiety. In some embodiments, a chemical moiety comprises one or more peptide moieties. In some embodiments, a peptide is a cell-penetrating peptide. In some embodiments, a peptide is a ligand of a protein, e.g., a cell surface receptor. In some embodiments, a peptide is a Tfr1 peptide. Certain example peptide moieties are utilized to prepare oligonucleotides described in the Tables, e.g., Table 1A. In some embodiments, a chemical moiety comprises one or more basic moieties. In some embodiments, a basic moiety is positively charged at, e.g. about pH 7.4. In some embodiments, a basic moiety is or comprises a guanidine moiety. In some embodiments, a basic moiety is or comprises $—N(R^1)_2$, wherein each $R^1$ is independently as described in the present disclosure. In some embodiments, a basic moiety is or comprises $—N(R^1)_3$, wherein each $R^1$ is independently as described in the present disclosure. In some embodiments, a basic moiety is or comprises $—N{=}C(N(R^1)_2)_2$, wherein each $R^1$ is independently as described in the present disclosure. In some embodiments, each $R^1$ is independently R as described in the present disclosure. In some embodiments, each $R^1$ is independently optionally substituted $C_{1-6}$ alkyl. In some embodiments, $R^1$ is methyl. In some embodiments, one or two $R^1$ are the same. In some embodiments, each $R^1$ is the same. In some embodiments, at least one $R^1$ is different from another $R^1$. In some embodiments, a basic moiety is $—N{=}C(N(CH_3)_2)_2$. In some embodiments, a chemical moiety comprises 1, 2, 3, 4, 5, 6, 7, 8, 9, 10, or more sugar, peptide, lipid, and/or basic moieties. In some embodiments, the number is 1. In some embodiments, the number is 2. In some embodiments, the number is 3. In some embodiments, the number is 4. In some embodiments, the number is 5. In some embodiments, the number is 6. In some embodiments, a chemical moiety comprises a ligand moiety of a protein, e.g., a receptor protein of a target cell. In some embodiments, a ligand is a ligand for a vitamin E receptor. In some embodiments, a ligand is for Tfr1 receptor. Chemical moieties as described and demonstrated in the present disclosure include and can be utilized as carbohydrate moieties, lipid moieties, targeting moieties, etc., and can provide a variety of functions, e.g., improving delivery, one or more properties, activities, etc.

In some embodiments, the present disclosure provides oligonucleotides comprising additional chemistry moieties, optionally connected to the oligonucleotide moiety through a linker. In some embodiments, the present disclosure provides oligonucleotides comprising $(R^D)b\text{-}L^{M1}\text{-}L^{M2}\text{-}L^{M3}\text{-}$, wherein:

each $R^D$ is independently a chemical moiety;

each of $L^{M1}$, $L^{M2}$, and $L^{M3}$ is independently L; and b is 1-1000.

In some embodiments, each of $L^{M1}$, $L^{M2}$, and $L^{M3}$ is independently a covalent bond, or a bivalent or multivalent, optionally substituted, linear or branched group selected from a $C_{1-10}$ aliphatic group and a $C_{1-10}$ heteroaliphatic group having 1-5 heteroatoms, wherein one or more methylene units are optionally and independently replaced with $C_{1-6}$ alkylene, $C_{1-6}$ alkenylene, $—C{\equiv}C—$, $C(R')_2—$, $—O—$, $—S—$, $—S—S—$, $—N(R')—$, $—C(O)—$, $—C(S)—$, $—C(NR')—$, $—C(O)N(R')—$, $—N(R')C(O)N(R')—$, $—N(R')C(O)O—$, $—S(O)—$, $—S(O)_2—$, $—S(O)_2N(R')—$, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]—; and one or more CH or carbon atoms are optionally and independently replaced with $Cy^L$.

In some embodiments, $L^{M1}$ comprises one or more —N(R')— and one or more —C(O)—. In some embodiments, a linker (e.g., L, $L^M$, etc.) or $L^{M1}$ is or comprises

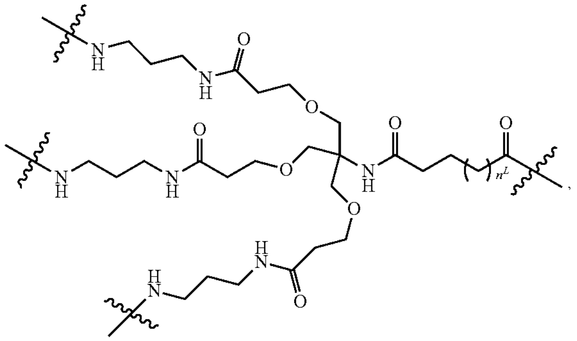

wherein $n^L$ is 1-8. In some embodiments, a linker or -$L^{M1}$-$L^{M2}$-$L^{M3}$- is

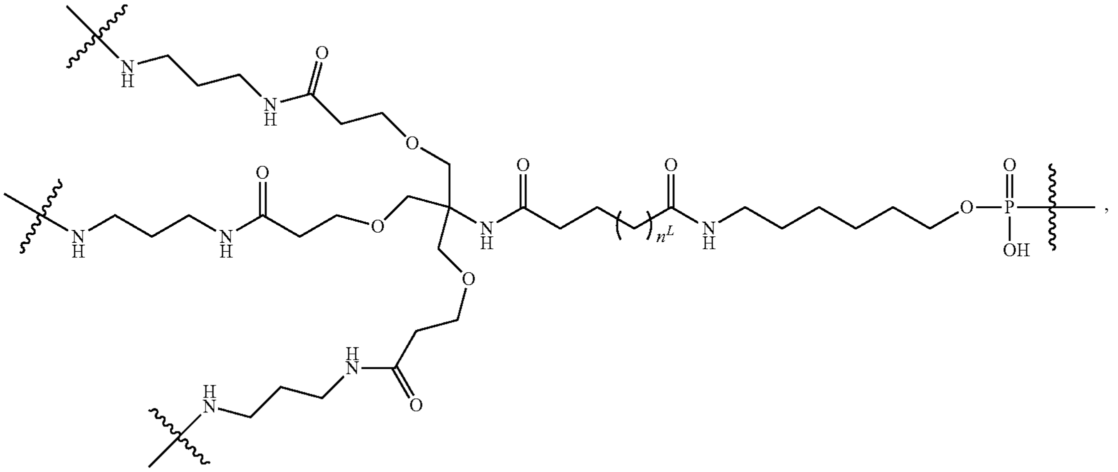

or a salt form thereof, wherein $n^L$ is 1-8. In some embodiments, a linker or -$L^{M1}$-$L^{M2}$-$L^{M3}$- is

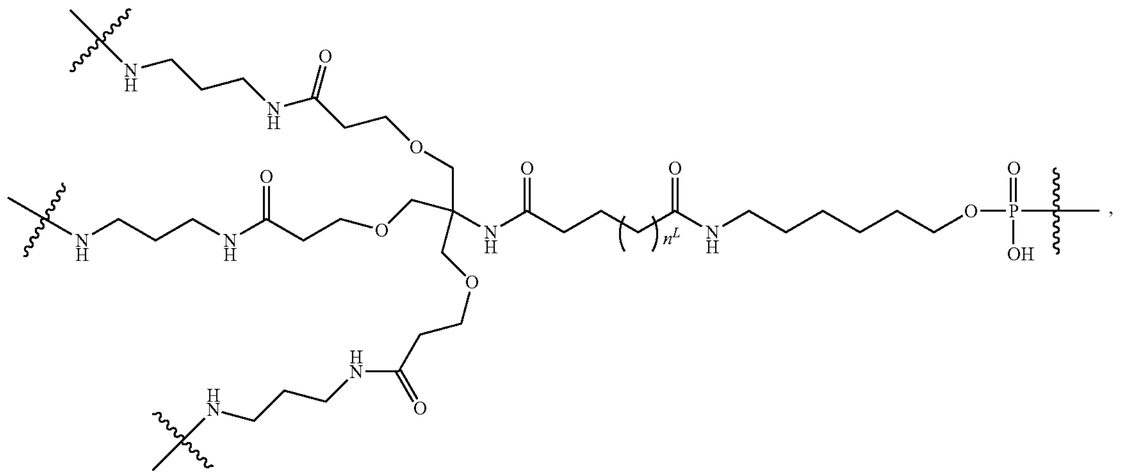
or a salt form thereof, wherein:
$n^L$ is 1-8.
each amino group independently connects to a moiety; and
the P atom connects to the 5'-OH of the oligonucleotide.
In some embodiments, the moiety and the linker, or $(R^D)$b-$L^{M1}$-$L^{M2}$-$L^{M3}$-, is or comprises
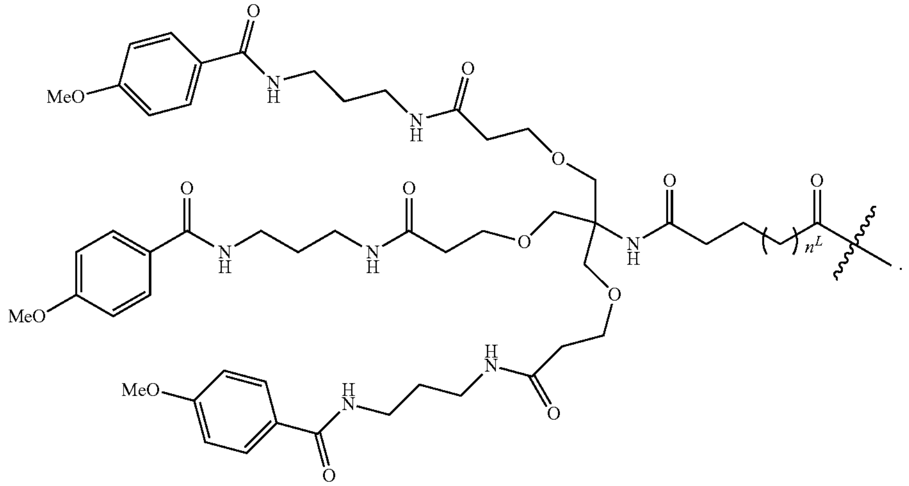
In some embodiments, the moiety and the linker, or $(R^D)$b-$L^{M1}$-$L^{M2}$-$L^{M3}$-, is or comprises

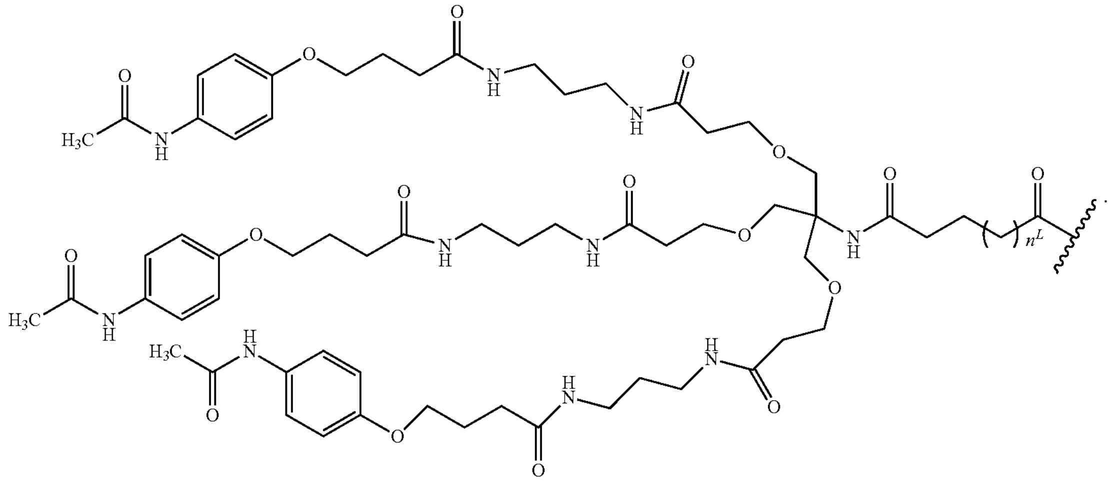
In some embodiments, the moiety and the linker, or $(R^D)$b-$L^{M1}$-$L^{M2}$-$L^{M3}$-, is or comprises
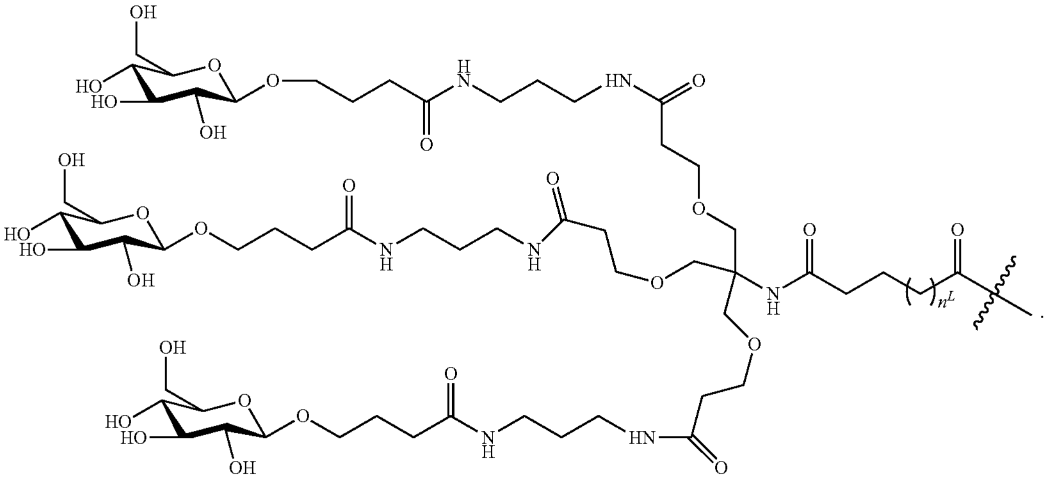
In some embodiments, the moiety and the linker, or $(R^D)$b-$L^{M1}$-$L^{M2}$-$L^{M3}$-, is or comprises

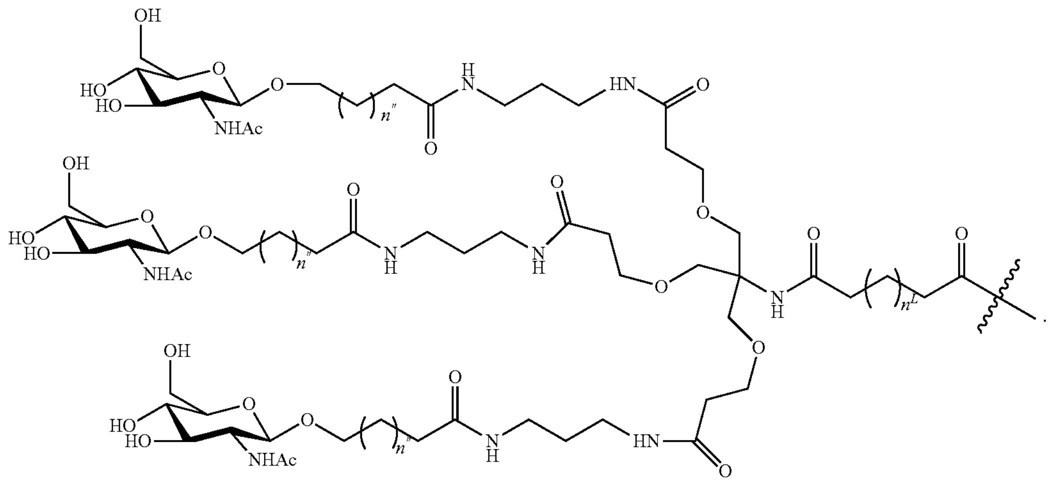
In some embodiments, the moiety and the linker, or $(R^D)$b-$L^{M1}$-$L^{M2}$-$L^{M3}$-, is or comprises
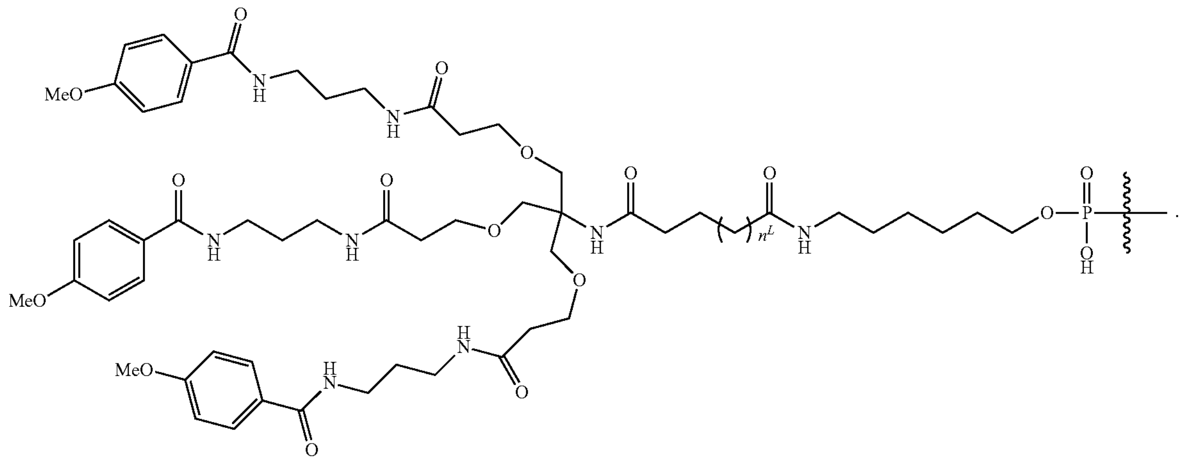
In some embodiments, the moiety and the linker, or $(R^D)$b-$L^{M1}$-$L^{M2}$-$L^{M3}$-, is or comprises
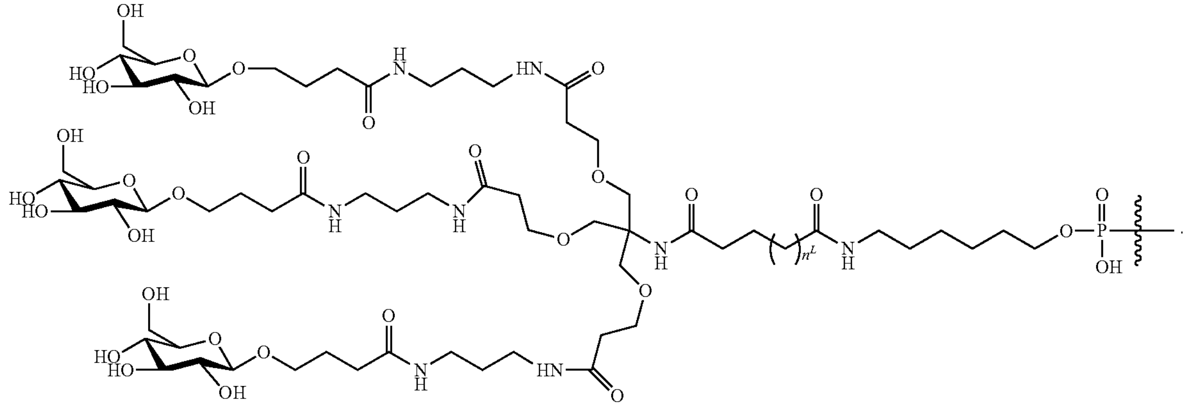

In some embodiments, the moiety and the linker, or $(R^D)b$-$L^{M1}$-$L^{M2}$-$L^{M3}$-, is or comprises
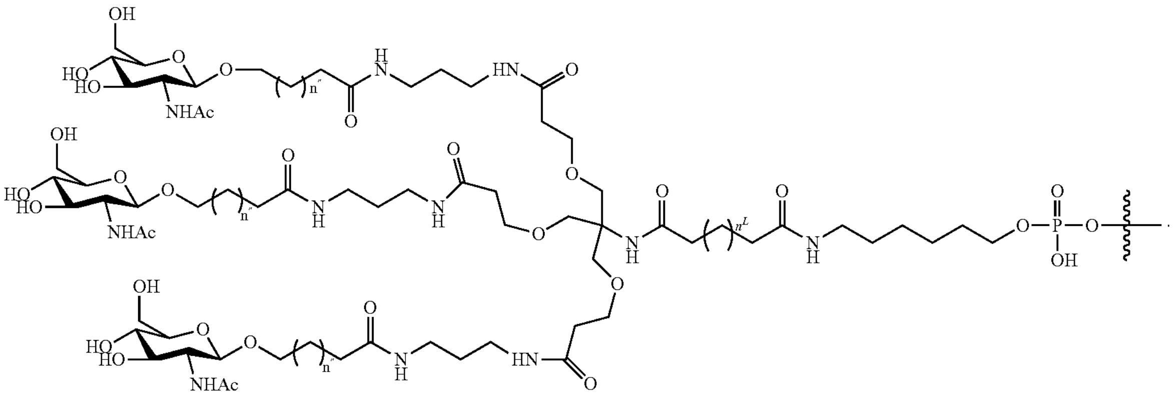
In some embodiments, a linker, or $L^{M1}$, is or comprises
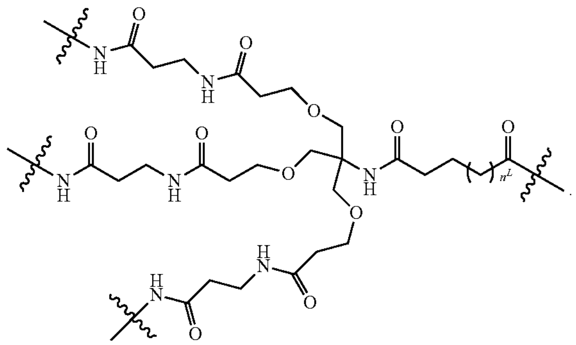
In some embodiments, the moiety and linker, or $(R^D)b$-$L^{M1}$-$L^{M2}$-$L^{M3}$-, is or comprises:
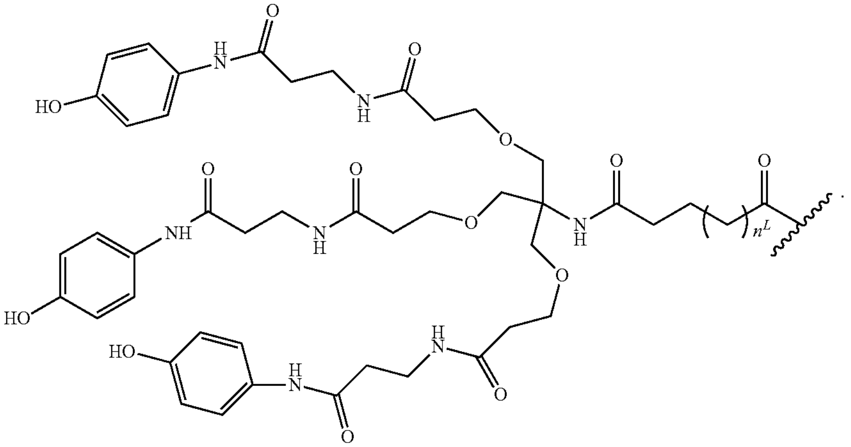
In some embodiments, the moiety and linker, or $(R^D)b$-$L^{M1}$-$L^{M2}$-$L^{M3}$-, is or comprises:

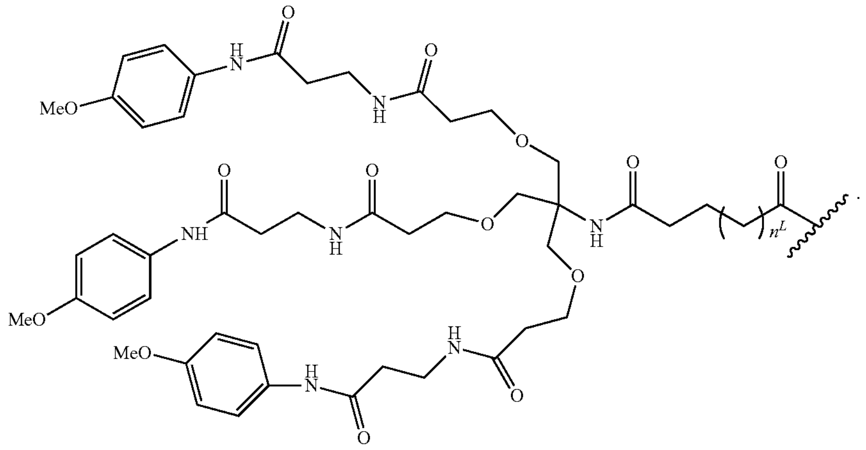
In some embodiments, a linker is
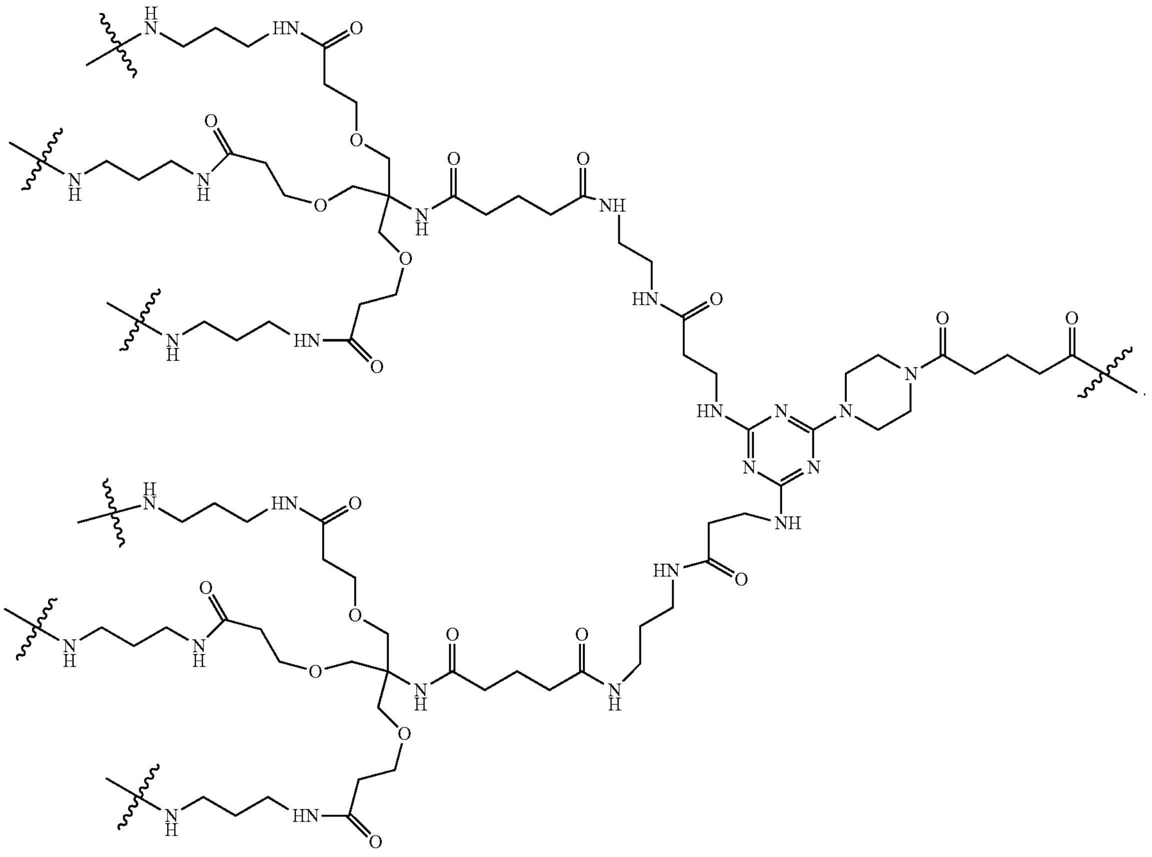 [SMILES: *NCCCNC(=O)CCOCC(COCCC(=O)NCCCN*)(COCCC(=O)NCCCN*)NC(=O)CCCC(=O)NCCCNC(=O)CCNc1nc(NCCC(=O)NCCNC(=O)CCCC(=O)NC(COCCC(=O)NCCCN*)(COCCC(=O)NCCCN*)COCCC(=O)NCCCN*)nc(N2CCN(C(=O)CCCC(*)=O)CC2)n1]
In some embodiments, the moiety and linker, or $(R^D)$b-$L^{M1}$-$L^{M2}$-$L^{M3}$-, is or comprises:

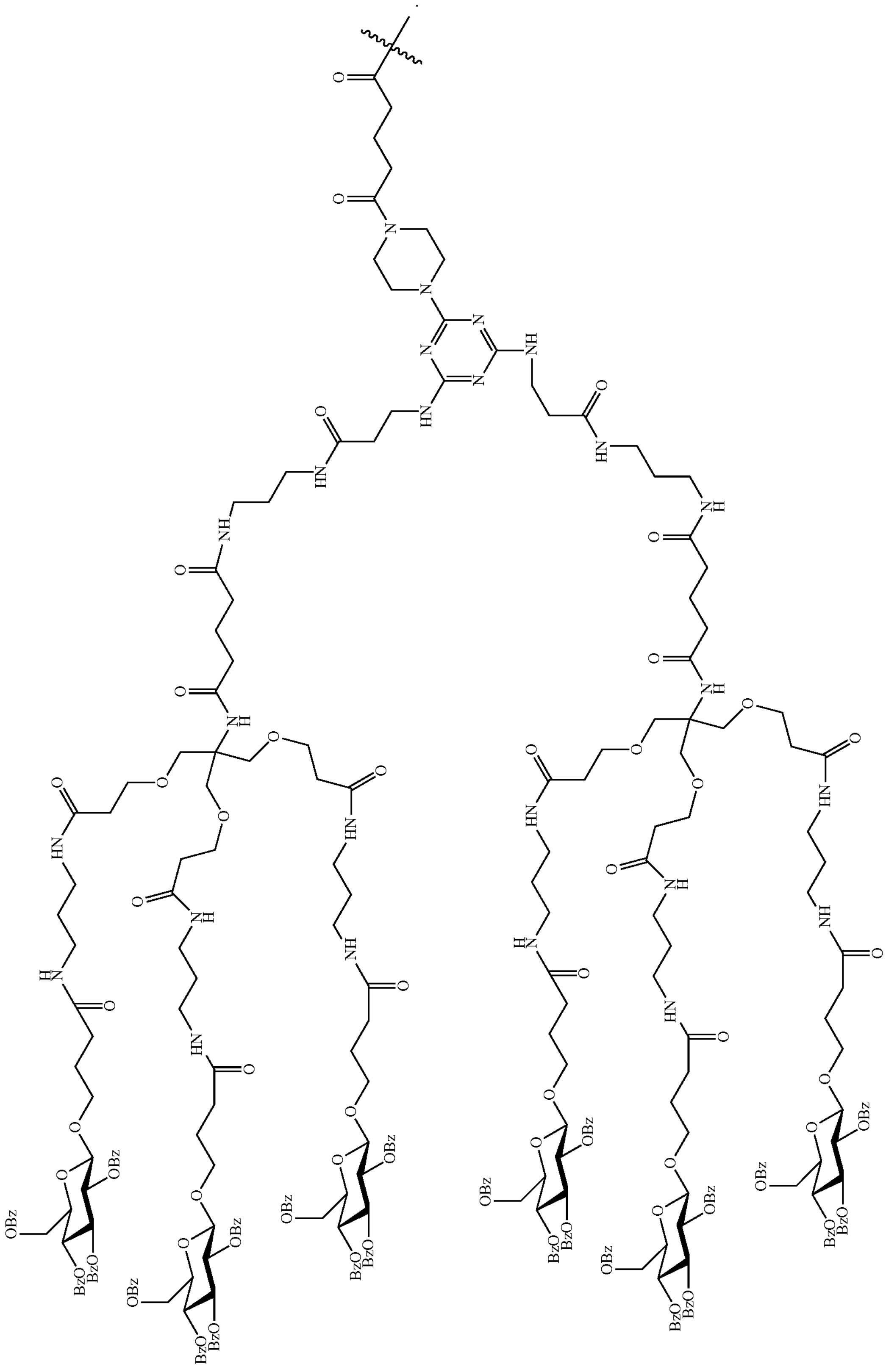

In some embodiments, the moiety and linker, or $(R^D)b-L^{M1}-L^{M2}-L^{M3}-$, is or comprises:

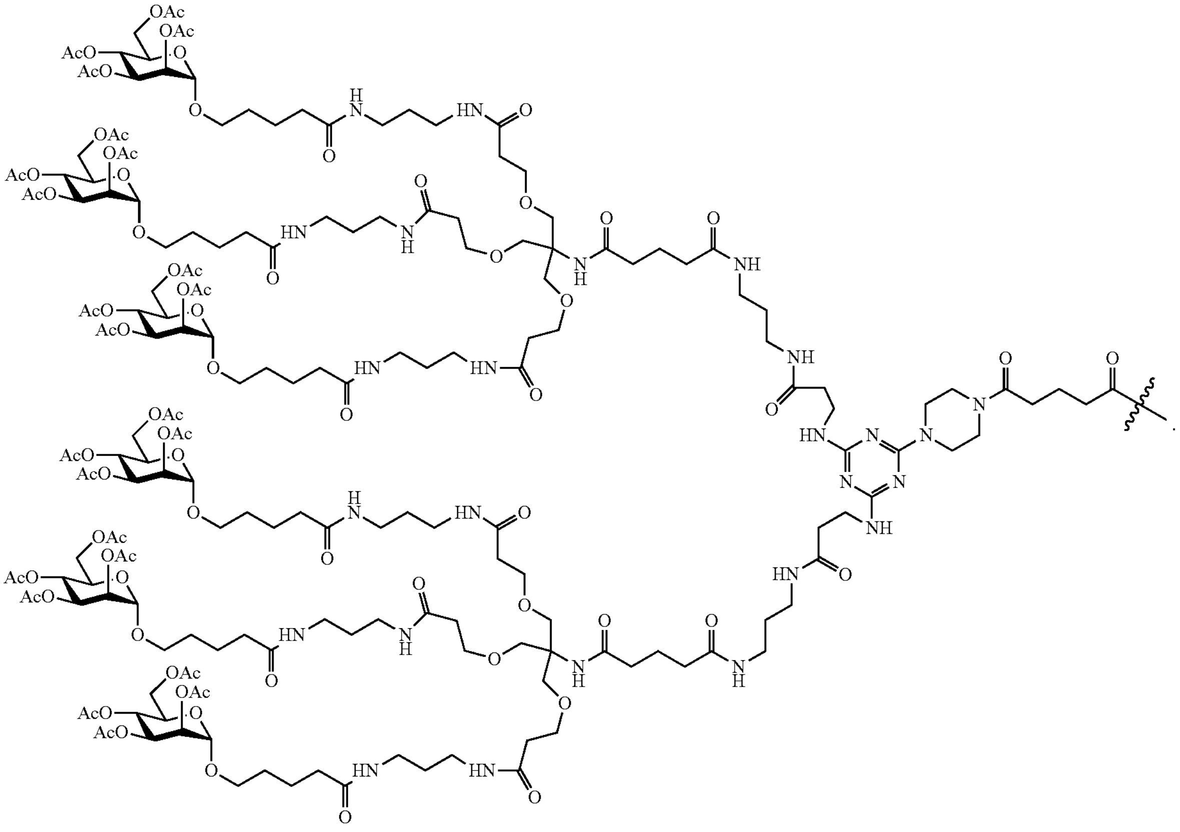

In some embodiments, $n^L$ is 1-8. In some embodiments, $n^L$ is 1, 2, 3, 4, 5, 6, 7, or 8. In some embodiments, $n^L$ is 1. In some embodiments, $n^L$ is 2. In some embodiments, $n^L$ is 3. In some embodiments, $n^L$ is 4. In some embodiments, $n^L$ is 5. In some embodiments, $n^L$ is 6. In some embodiments, $n^L$ is 7. In some embodiments, $n^L$ is 8.

In some embodiments, $L^{M2}$ is a covalent bond, or a bivalent, optionally substituted, linear or branched group selected from a $C_{1-10}$ aliphatic group and a $C_{1-10}$ heteroaliphatic group having 1-5 heteroatoms, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more CH or carbon atoms are optionally and independently replaced with $Cy^L$. In some embodiments, $L^{M2}$ is a covalent bond, or a bivalent, optionally substituted, linear or branched group selected from a $C_{1-10}$ aliphatic group and a $C_{1-10}$ heteroaliphatic group having 1-5 heteroatoms, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, or —P(O)(R')—. In some embodiments, $L^{M2}$ is is a covalent bond, or a bivalent, optionally substituted, linear or branched $C_{1-10}$ aliphatic wherein one or more methylene units are optionally and independently replaced with $C_{1-6}$ alkylene, $C_{1-6}$ alkenylene, —C≡C—, —C(R')$_2$—, —O—, —S—, —N(R')—, or —C(O)—. In some embodiments, $L^{M2}$ is —NH—(CH$_2$)$_6$—, wherein —NH— is bonded to $L^{M1}$.

In some embodiments, $L^{M3}$ is is —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')—, —OP(O)(SR')—, —OP(O)(R')—, —OP(O)(NR')—, —OP(S)(OR')—, —OP(S)(SR')—, —OP(S)(R')—, —OP(S)(NR')—, —OP(R')—, —OP(OR')—, —OP(SR')—, —OP(NR')—, or —OP(OR')[B(R')$_3$]—. In some embodiments, $L^{M3}$ is —OP(O)(OR')—, or —OP(O)(SR')—, wherein —O— is bonded to $L^{M2}$. In some embodiments, the P atom is connected to a sugar unit, a nucleobase unit, or an internucleotidic linkage. In some embodiments, the P atom is connected to a —OH group through formation of a P—O bond. In some embodiments, the P atom is connected to the 5'-OH group through formation of a P—O bond.

In some embodiments, $L^{M1}$ is a covalent bond. In some embodiments, $L^{M2}$ is a covalent bond. In some embodiments, $L^{M3}$ is a covalent bond. In some embodiments, $L^{M1}$ is $L^{M2}$ as described in the present disclosure. In some embodiments, $L^{M1}$ is $L^{M3}$ as described in the present disclosure. In some embodiments, $L^{M2}$ is $L^{M1}$ as described in the present disclosure. In some embodiments, $L^{M2}$ is $L^{M3}$ as described in the present disclosure. In some embodiments, $L^{M3}$ is $L^{M1}$ as described in the present disclosure. In some embodiments, $L^{M3}$ is $L^{M2}$ as described in the present disclosure. In some embodiments, $L^{M}$ is $L^{M1}$ as described in the present disclosure. In some embodiments, $L^{M}$ is $L^{M2}$ as described in the present disclosure. In some embodiments, $L^{M}$ is $L^{M3}$ as described in the present disclosure. In some embodiments, $L^{M}$ is $L^{M1}$-$L^{M2}$, wherein each of $L^{M1}$ and $L^{M2}$ is independently as described in the present disclosure. In some embodiments, $L^{M}$ is $L^{M1}$-$L^{M3}$, wherein each of $L^{M1}$ and $L^{M3}$ is independently as described in the present disclosure. In some embodiments, $L^{M}$ is $L^{M2}$-$L^{M3}$, wherein each of $L^{M2}$ and $L^{M3}$ is independently as described in the present disclosure. In some embodiments, $L^{M}$ is $L^{M1}$-$L^{M2}$-$L^{M3}$, wherein each of $L^{M1}$, $L^{M2}$ and $L^{M3}$ is independently as described in the present disclosure.

In some embodiments, each $R^{D}$ is independently a chemical moiety as described in the present disclosure. In some embodiments, $R^{D}$ is an additional chemical moiety. In some embodiments, $R^{D}$ is targeting moiety. In some embodiments, $R^{D}$ is or comprises a carbohydrate moiety. In some embodiments, $R^{D}$ is or comprises a lipid moiety. In some embodiments, $R^{D}$ is or comprises a ligand moiety for, e.g., cell receptors such as a sigma receptor, an asialoglycoprotein receptor, etc. In some embodiments, a ligand moiety is or comprises an anisamide moiety, which may be a ligand moiety for a sigma receptor. In some embodiments, a ligand moiety is or comprises a lipid. In some embodiments, a ligand moiety is or comprises a GalNAc moiety, which may be a ligand moiety for an asialoglycoprotein receptor. In some embodiments, $R^{D}$ is selected from optionally substituted phenyl,

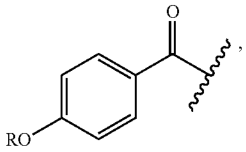
,

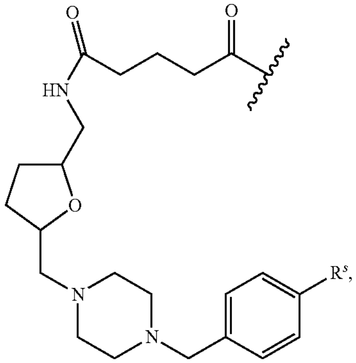
,

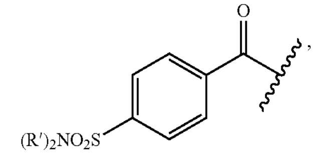
,

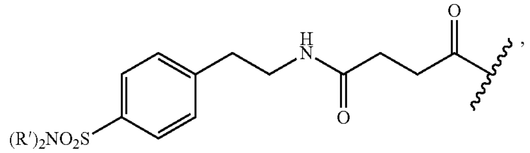
, and

-continued

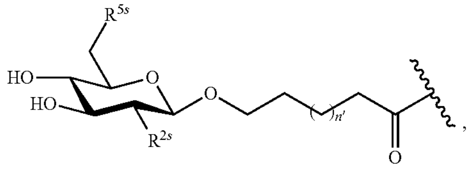
, wherein n' is 0 or 1, and each other variable is independently as described in the present disclosure. In some embodiments, $R^{s}$ is F. In some embodiments, $R^{s}$ is OMe. In some embodiments, $R^{s}$ is OH. In some embodiments, $R^{s}$ is NHAc. In some embodiments, $R^{s}$ is $NHCOCF_3$. In some embodiments, R' is H. In some embodiments, R is H. In some embodiments, $R^{2s}$ is NHAc, and $R^{5s}$ is OH. In some embodiments, $R^{2s}$ is p-anisoyl, and $R^{5s}$ is OH. In some embodiments, $R^{2s}$ is NHAc and $R^{5s}$ is p-anisoyl. In some embodiments, $R^{2s}$ is OH, and $R^{5s}$ is p-anisoyl. In some embodiments, $R^{D}$ is selected from

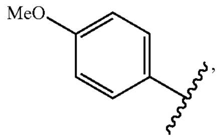
,

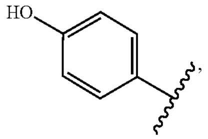
,

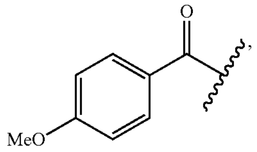
,

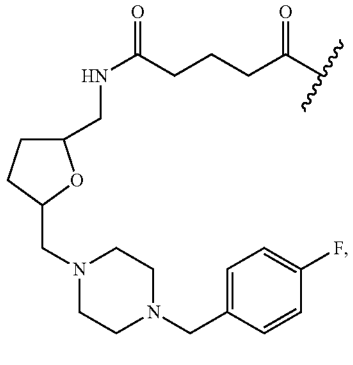
,

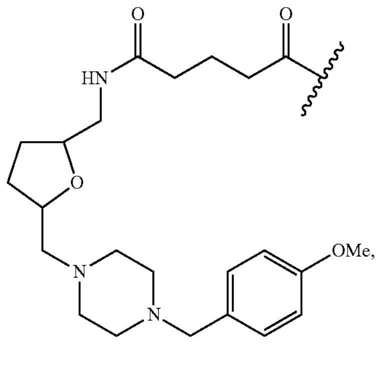
,

-continued

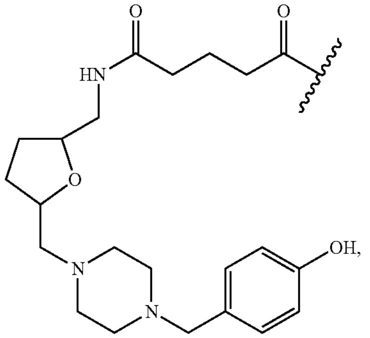

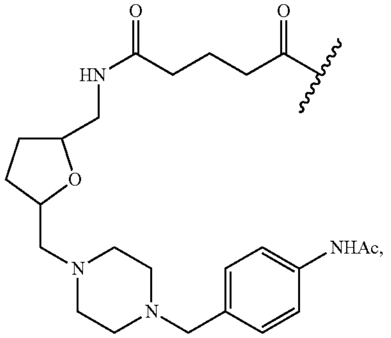

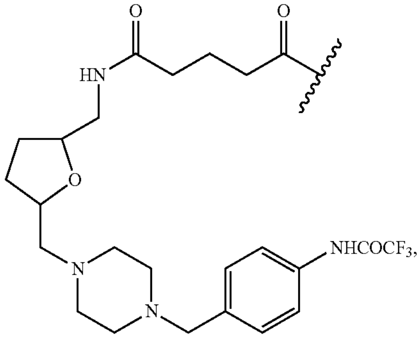

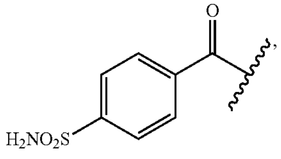

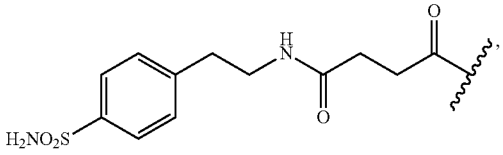

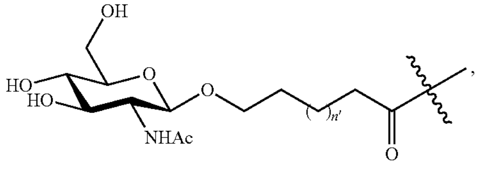

-continued

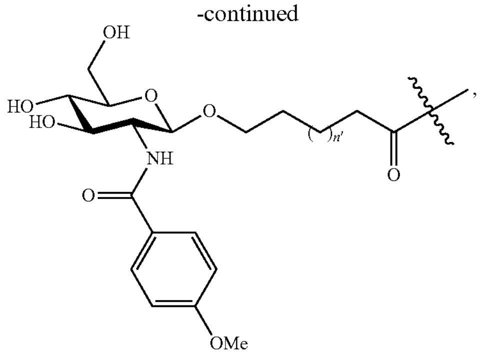

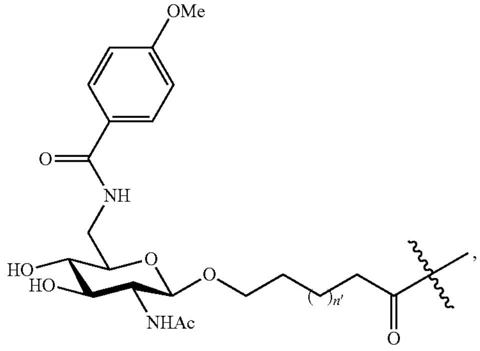

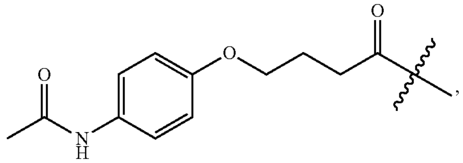

and

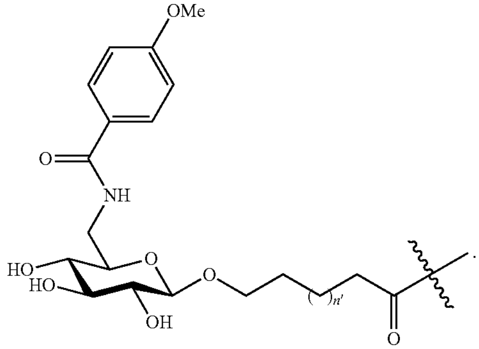

Further embodiments of $R^D$ includes additional chemical moiety embodiments, e.g., those described in the examples.

In some embodiments, n' is 1. In some embodiments, n' is 0.

In some embodiments, n" is 1. In some embodiments, n" is 2.

In some embodiments, a provided oligonucleotide, e.g., DMD oligonucleotide, is conjugated to an additional component (chemical moiety). In some embodiments, a composition comprises any DMD oligonucleotide, or combination thereof, described herein, can be conjugated to any chemical moiety described herein or known in the art.

In some embodiments, a composition comprising a provided oligonucleotide, e.g., a DMD oligonucleotide, comprises an additional component which is any of: Sulfonamide (Carbonic Anhydrases IV inhibitor); Cleavable lipid; Transferrin Receptor 1 (CD71, TfR) ligand; OCTN2 transporter targeting (L-Cartinine); Glut4 and Glut1 Receptor ligand; Mannose Receptor C1 (Mrc1) and Mannose 6P Receptor (M6Pr) ligand; Cleavable Lipid; Cholesterol; or a Peptide (including, but not limited to, a short delivery peptide or cell-penetrating peptide (CPP)).

Variously oligonucleotides have been designed and/or constructed which comprise an additional component which is, comprises or is derived from: cholesterol; L-carnitine (amide and carbamate bond); Folic acid; Gambogic acid; Cleavable lipid (1,2-dilaurin and ester bond); Insulin receptor ligand; CPP; Glucose (tri- and hex-antennary); and Mannose (tri- and hex-antennary, alpha and beta); and various synthesis schemes for these additional components and oligonucleotides comprising them or molecules derived from them have been devised.

In some embodiments, a composition comprising an oligonucleotide, e.g., a DMD oligonucleotide comprises an additional component which is derived from

WV-DL-14

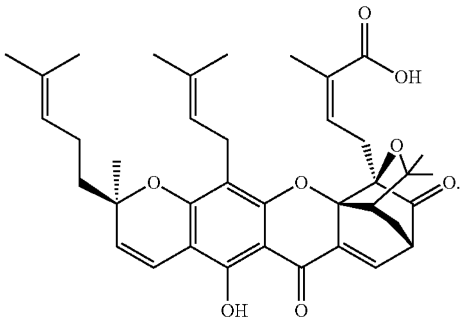

Gambogic acid

WV-DL-14 is also known as WV-DL-014. In some embodiments, gambogic acid or a derivative thereof binds to Transferrin receptor (CD71).

In some embodiments, a composition comprising an oligonucleotide, e.g., a DMD oligonucleotide comprises an additional component which is derived from L-cartinine, which binds to the OCTN2 transporter. In some embodiments, a composition comprising a DMD oligonucleotide comprises an additional component which is derived from

WV-DL-012

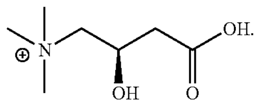

In some embodiments, a composition comprising an oligonucleotide, e.g., a DMD oligonucleotide comprises an additional component which is a sulfonamide or a derivative thereof.

In some embodiments, a composition comprising an oligonucleotide, e.g., a DMD oligonucleotide comprises an additional component which is derived from any of:

WV-DL-05

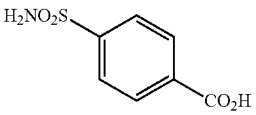

WV-DL-06

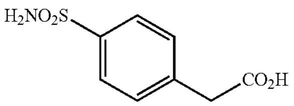

WV-DL-011

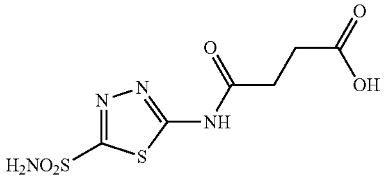

WV-DL-007

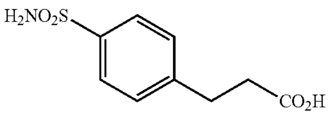

WV-DL-009

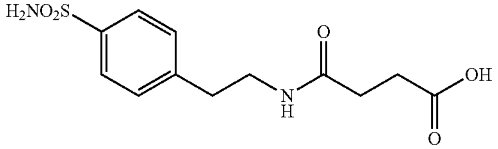

-continued
WV-DL-008
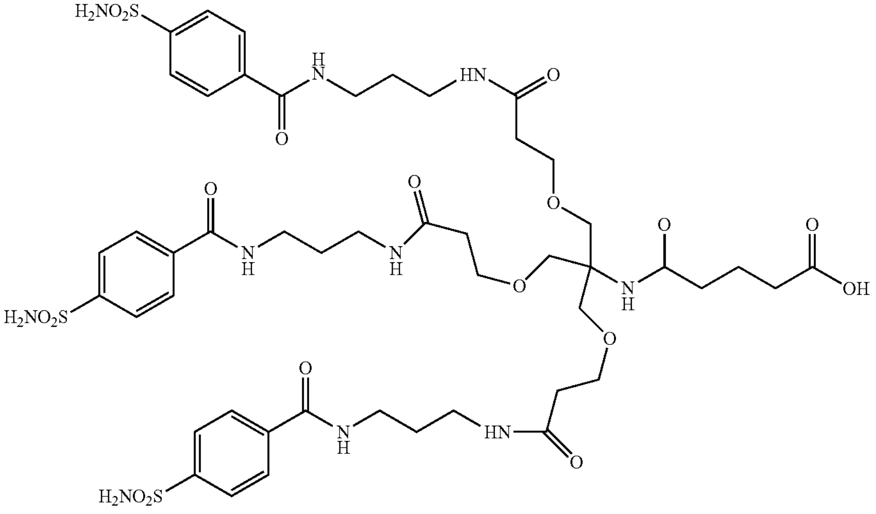
WV-DL-002
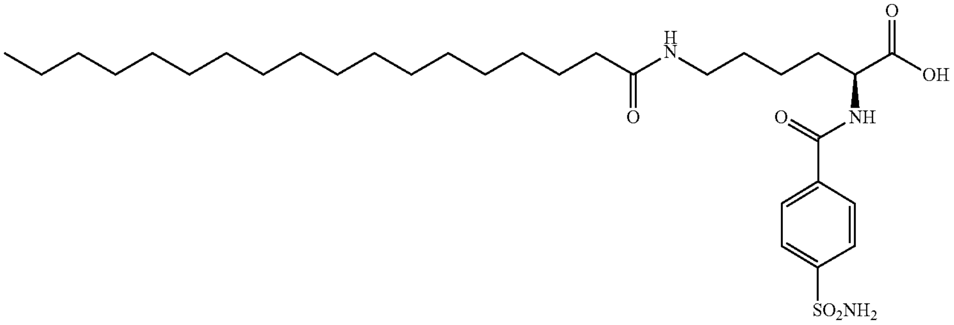
WV-DL-010
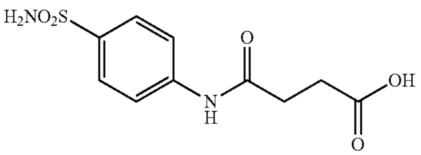
WV-DL-001
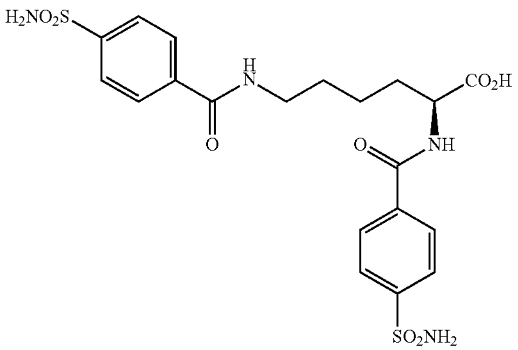
WV-DL-003
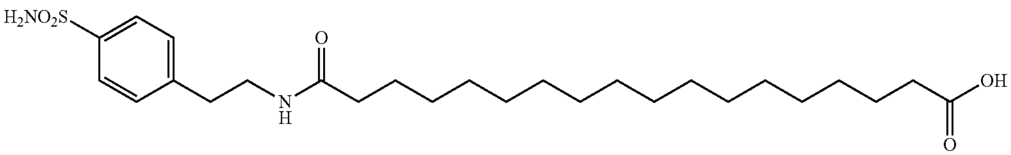

In some embodiments, a composition comprising an oligonucleotide, e.g., a DMD oligonucleotide comprises an additional component which is or comprises or comprises a derivative of:

WV-DL-002

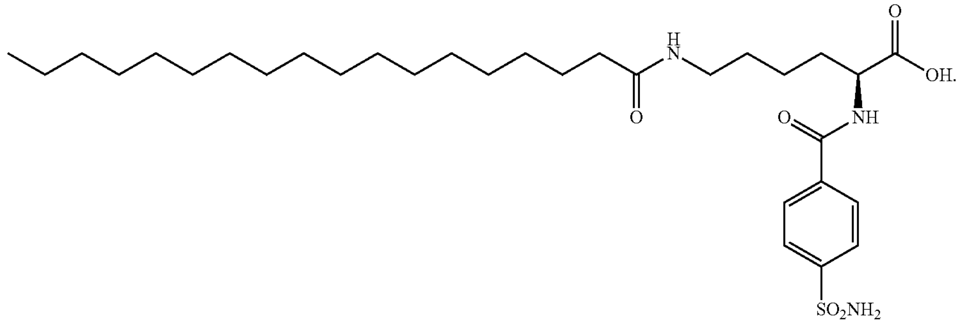

In some embodiments, a composition comprising an oligonucleotide, e.g., a DMD oligonucleotide comprises an additional component which is or comprises or comprises a derivative of:

WV-DL-13

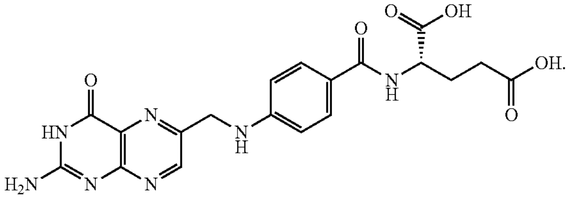

folic acid

In some embodiments, a composition comprising an oligonucleotide, e.g., a DMD oligonucleotide comprises an additional component which is derived from any of: WV-DL-001, WV-DL-002, WV-DL-003, WV-DL-006, WV-DL-007, WV-DL-008, WV-DL-009, WV-DL-010, WV-DL-011, WV-DL-012, or WV-D1-014, and other additional components, wherein the terminal-COOH is used to conjugate the additional component to a linker or to an oligonucleotide. In some embodiments, a composition comprising an oligonucleotide, e.g., a DMD oligonucleotide comprises an additional component which is derived from any of: WV-DL-001, WV-DL-002, WV-DL-003, WV-DL-006, WV-DL-007, WV-DL-008, WV-DL-009, WV-DL-010, WV-DL-011, WV-DL-012, or WV-DI-014, and other additional components, wherein the terminal-COOH is used to conjugate the additional component to a linker, wherein the conjugation process converts the —COOH to a —C(O)— which connects a linker. In some embodiments, a composition comprising an oligonucleotide, e.g., a DMD oligonucleotide comprises an additional component which is derived from any of: WV-DL-001, WV-DL-002, WV-DL-003, WV-DL-006, WV-DL-007, WV-DL-008, WV-DL-009, WV-DL-010, WV-DL-011, WV-DL-012, or WV-DI-014, and other additional components, wherein the terminal —COOH is used to conjugate the additional component to a linker, wherein the conjugation process replaces the —COOH with —C(O)— which connects to —NH— of a linker (e.g., L001). A non-limiting example of a product of this process for conjugation, using an additional component derived from WV-DL-006 is shown here:

WV-DL-005

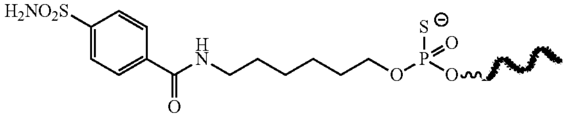

wherein WV-DL-005 indicates the additional component.

In some embodiments, a composition comprising an oligonucleotide, e.g., a DMD oligonucleotide comprises an additional component which is a lipid. In some embodiments, a composition comprising an oligonucleotide, e.g., a DMD oligonucleotide comprises an additional component which is a lipid, including but not limited to a lipid described herein.

In some embodiments, a composition comprising an oligonucleotide, e.g., a DMD oligonucleotide, comprises an additional component, wherein the additional component is conjugated to the oligonucleotide via a cleavable linker. In some embodiments, a composition comprising an oligonucleotide, e.g., a DMD oligonucleotide, comprises an additional component which is a lipid, wherein the lipid is conjugated to the oligonucleotide via a cleavable linker. In some embodiments, a composition comprising an oligonucleotide, e.g., a DMD oligonucleotide, comprises an additional component which is a lipid, including but not limited to a lipid described herein, wherein the lipid is conjugated to the oligonucleotide via a cleavable linker.

In some embodiments a cleavable linker comprises an ester. In some embodiments, a cleavable linker is cleavable within a cell, allowing the oligonucleotide to be physically separated from the additional component.

In some embodiments a cleavable linker is or comprises:

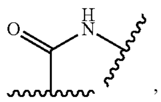
,
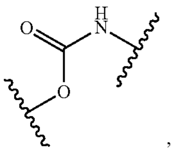
,

-continued

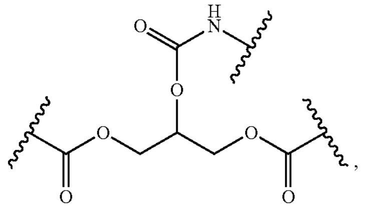

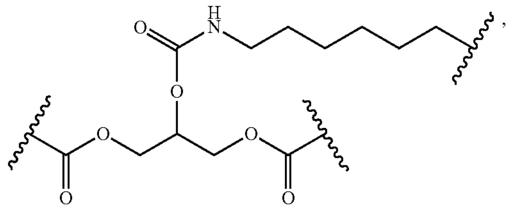

-continued

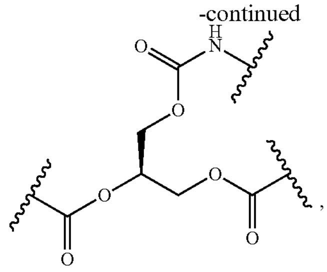

or

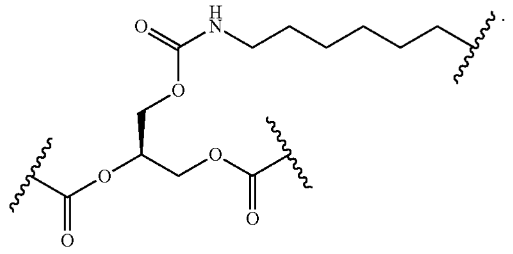

Non-limiting examples of an oligonucleotide conjugated to a lipid(s) via a cleavable linker are shown here:

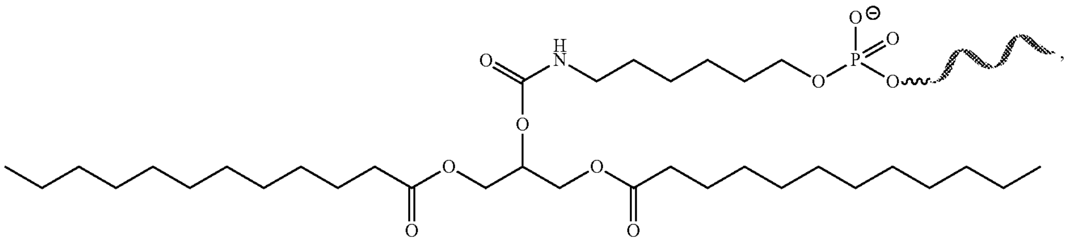

and 1,3-dilaurin (C12:0)
1.3-dicaprylin (C8:0)
1.3-dipalmitin (C16:0)

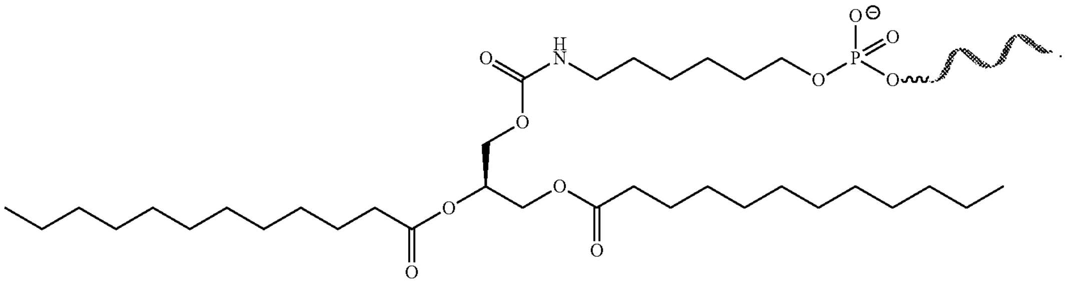

1,3-dilaurin (C12:0)

A non-limiting example of an oligonucleotide comprising an additional component which is stearic acid, linked to the oligonucleotide via a cleavable linker is shown here:

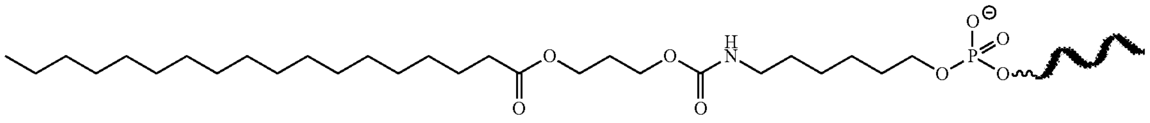

Stearic acid wherein stearic acid indicates the additional component.

A non-limiting reagent useful for conjugating stearic acid through a cleavable linker and its example preparation and use are shown below:

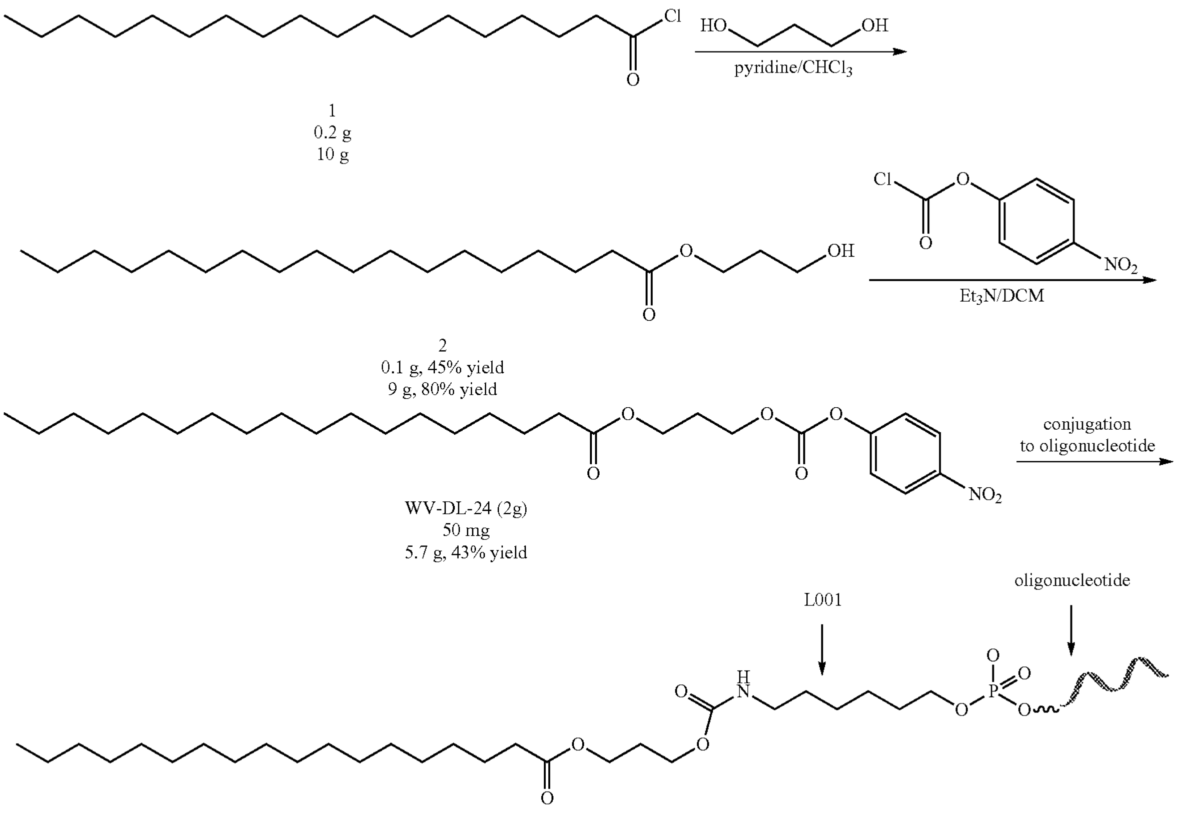

A non-limiting reagent useful for conjugating a cholesterol derivative through a cleavable linker, and its example preparation, are shown here:

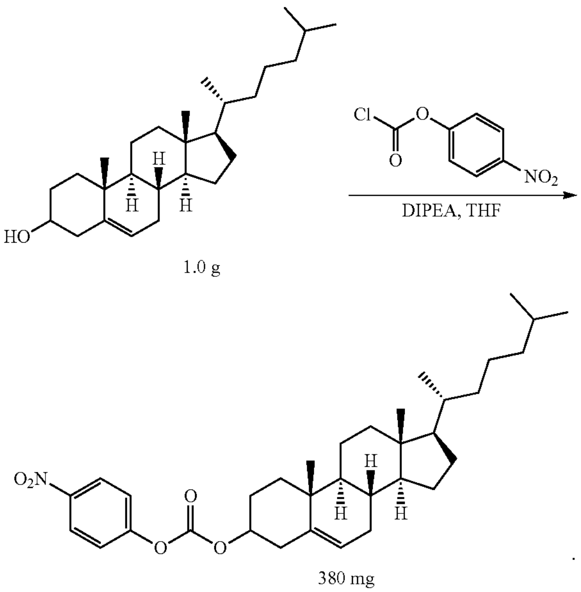

In some embodiments, a composition comprising an oligonucleotide comprises an additional component derived from:

WV-DL-019

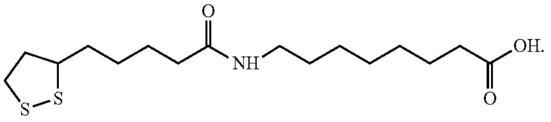

In some embodiments, a composition comprising an oligonucleotide comprises an additional component derived from either of:

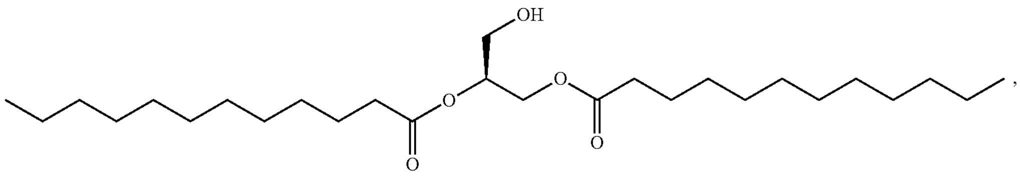

, and 1,2-dilaurin (C12:0)

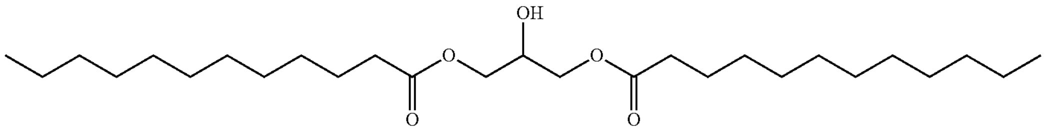

.

1,3-dilaurin (C12:0)

In some embodiments, a composition comprising an oligonucleotide, e.g., a DMD oligonucleotide comprises a mannose receptor ligand. In some embodiments, a composition comprising an oligonucleotide, e.g., a DMD oligonucleotide comprises a mannose receptor ligand which is a mannose receptor inhibitor. In some embodiments, a composition comprising an oligonucleotide, e.g., a DMD oligonucleotide comprises an additional component which is derived from any of:

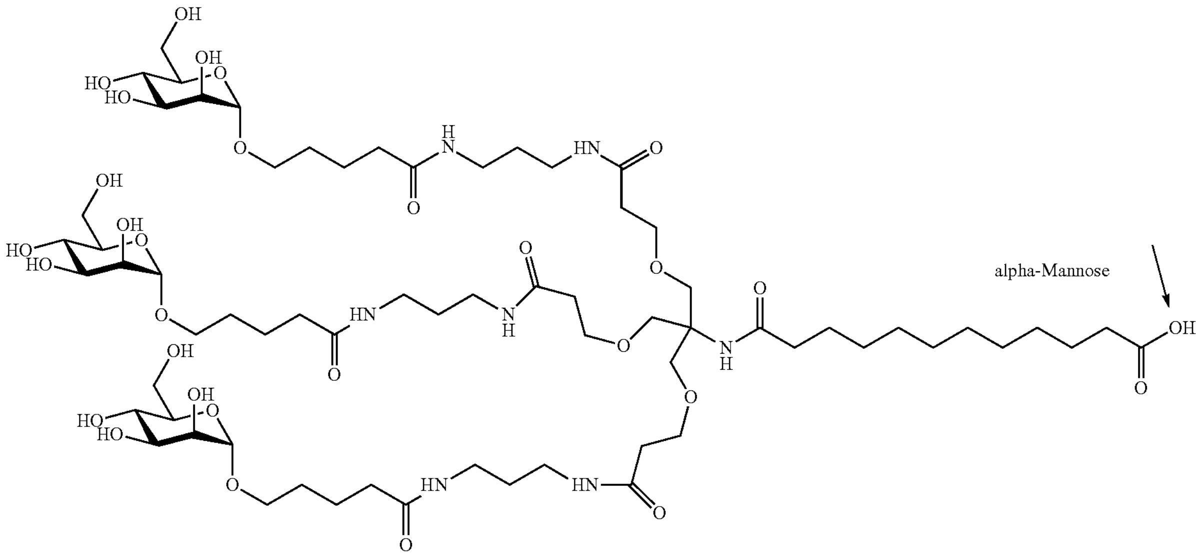

-continued
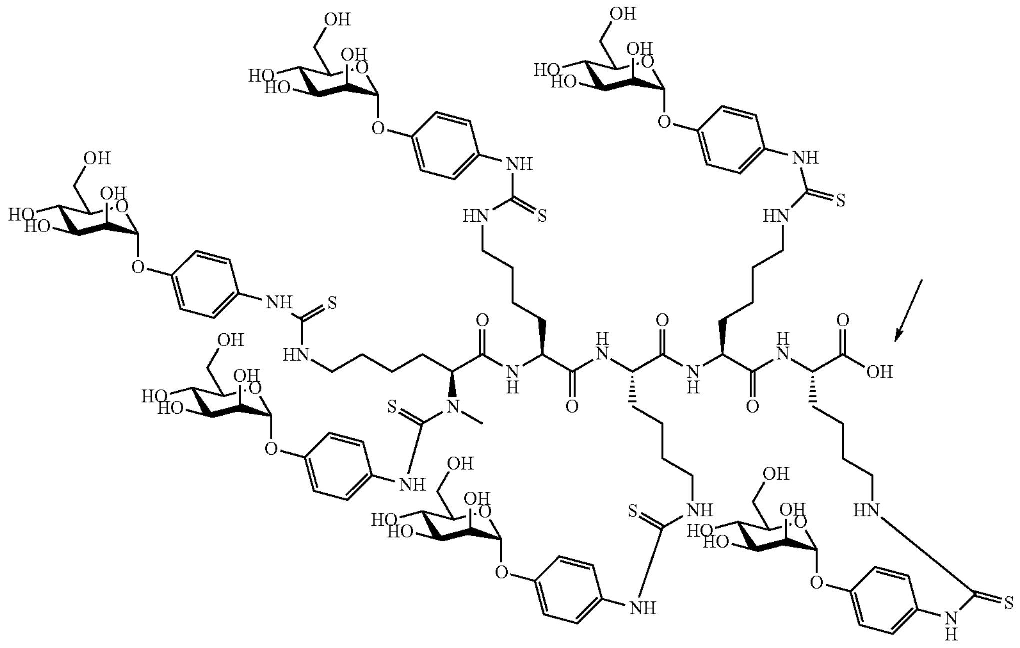
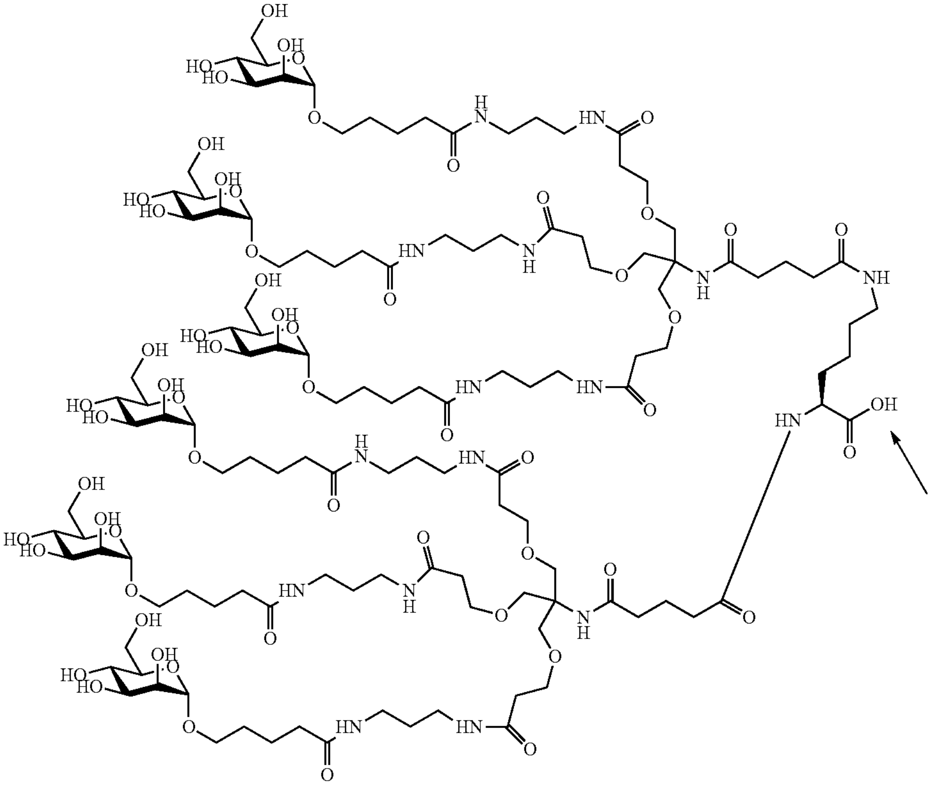

-continued
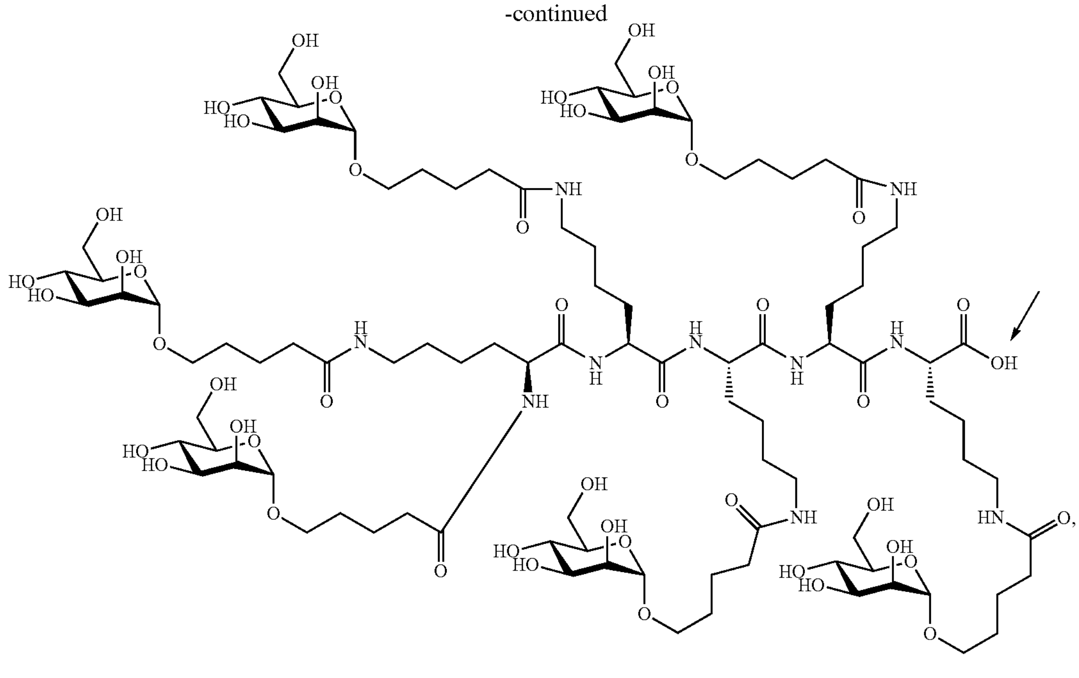
where the arrow indicates a —COOH which can be used to conjugate the additional component to an oligonucleotide, optionally via a linker.
A non-limiting example of a procedure for preparing an additional component comprising a mannose receptor ligand is shown here:
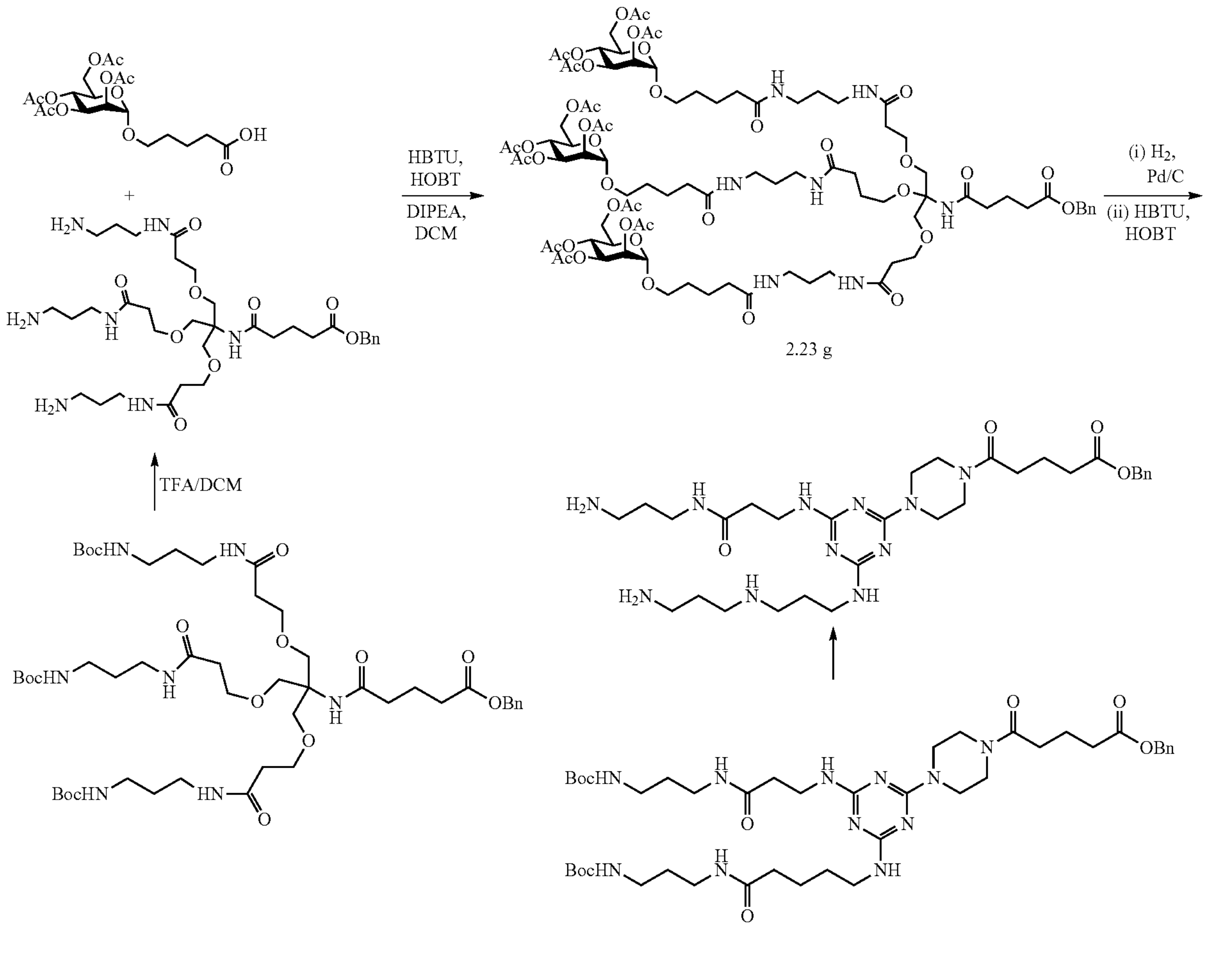

-continued
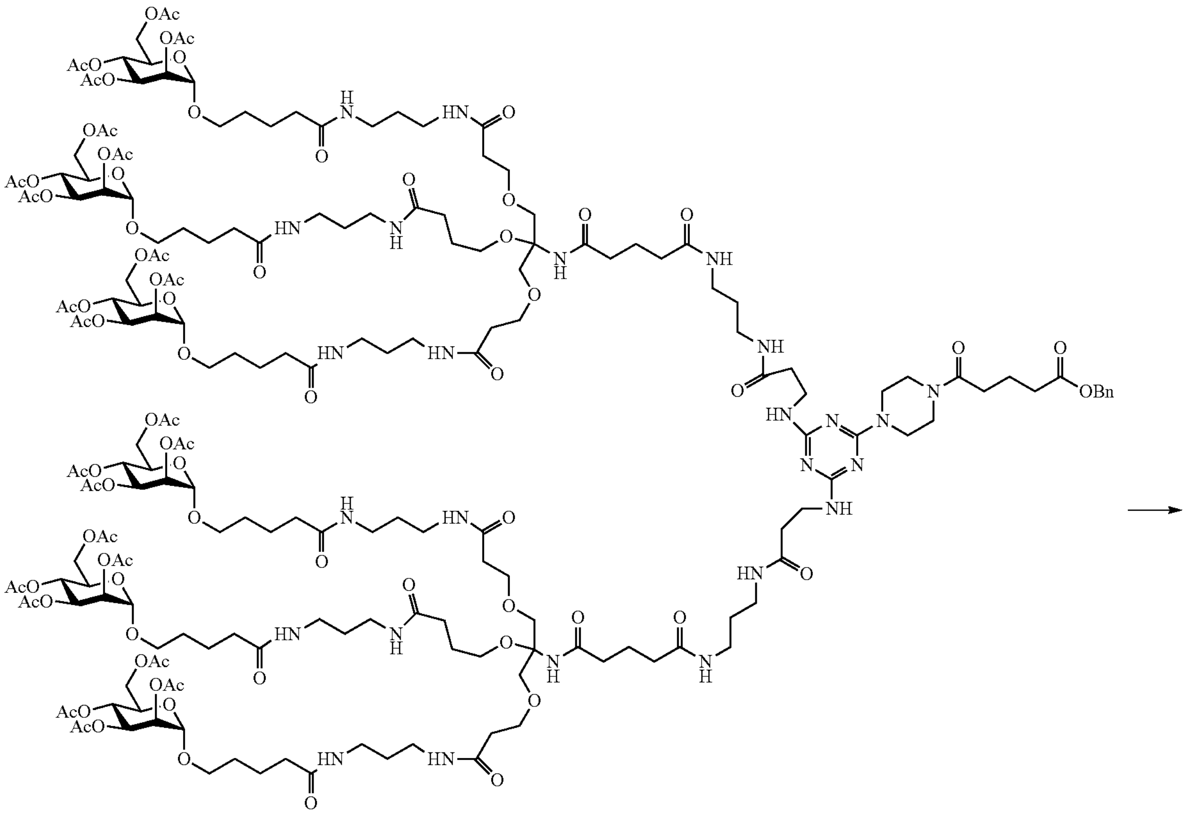
0.43 g, 41%

-continued

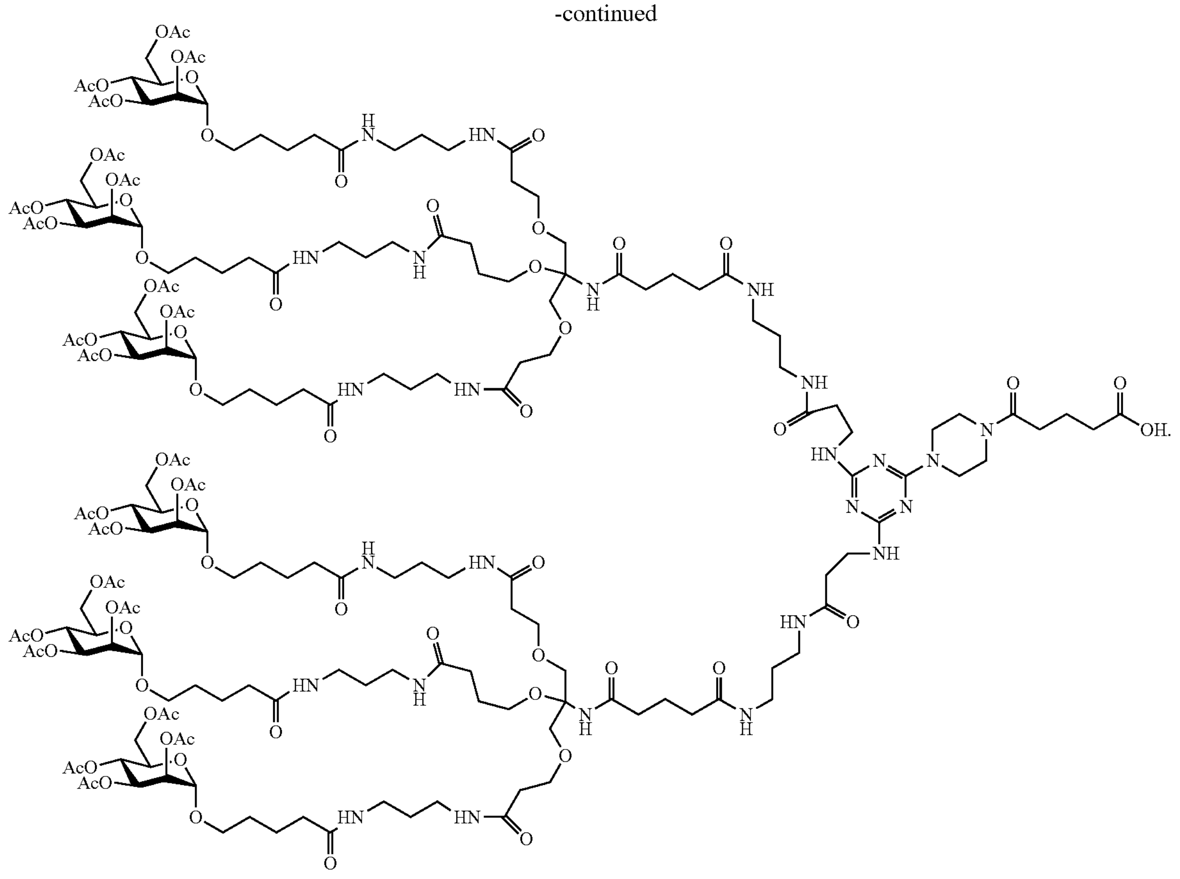

0.40 g, 97%

In some embodiments, a composition comprising an oligonucleotide, e.g., a DMD oligonucleotide comprises an additional component which is a ligand (or derivative thereof) that binds to a glucose or Glut4 receptor. In some embodiments, a composition comprising an oligonucleotide, e.g., a DMD oligonucleotide comprises an additional component which is a ligand (or derivative thereof) that binds to a glucose receptor. In some embodiments, a composition comprising an oligonucleotide, e.g., a DMD oligonucleotide comprises an additional component which is a ligand (or derivative thereof) that binds to and inhibits a glucose receptor. In some embodiments, a ligand (or derivative thereof) that binds to a glucose or Glut4 receptor is mono-, bi-, tri, or hex-antennary. In some embodiments, a composition comprising an oligonucleotide, e.g., a DMD oligonucleotide comprises an additional component which is derived from:

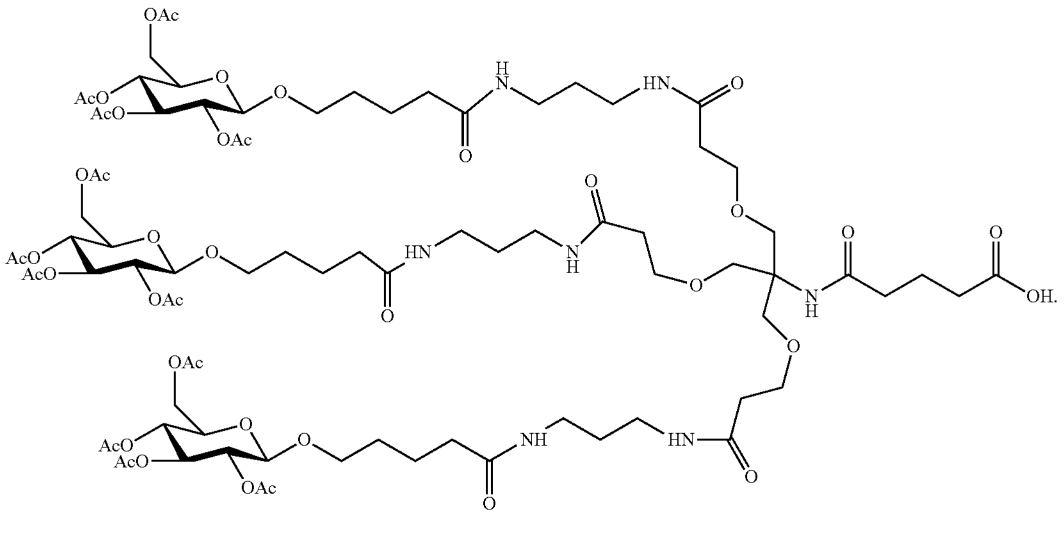

A non-limiting example of a procedure for synthesis of a tri-antennary glucose receptor inhibitor is shown here:
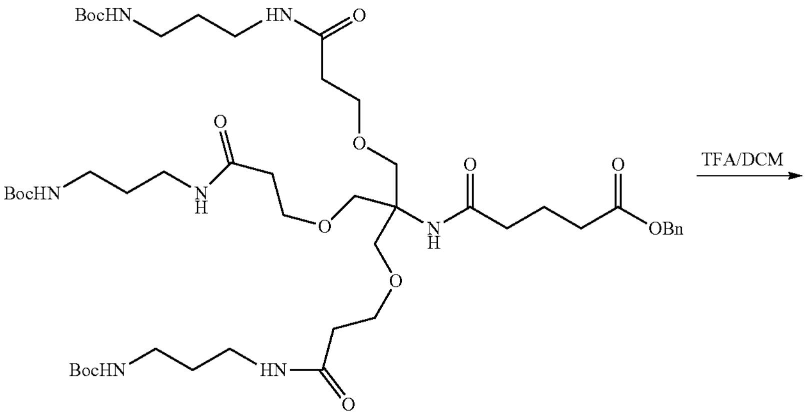
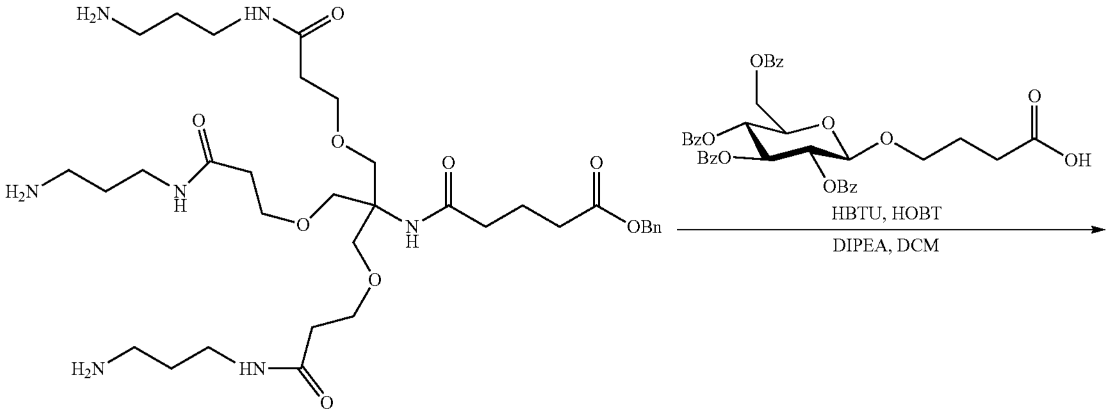

-continued
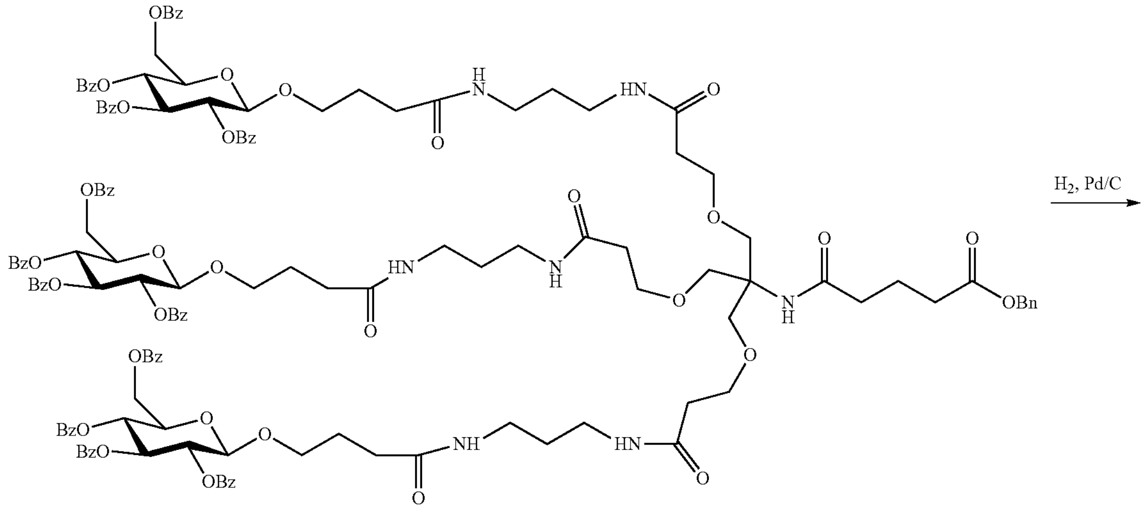
1.14 g, 92%
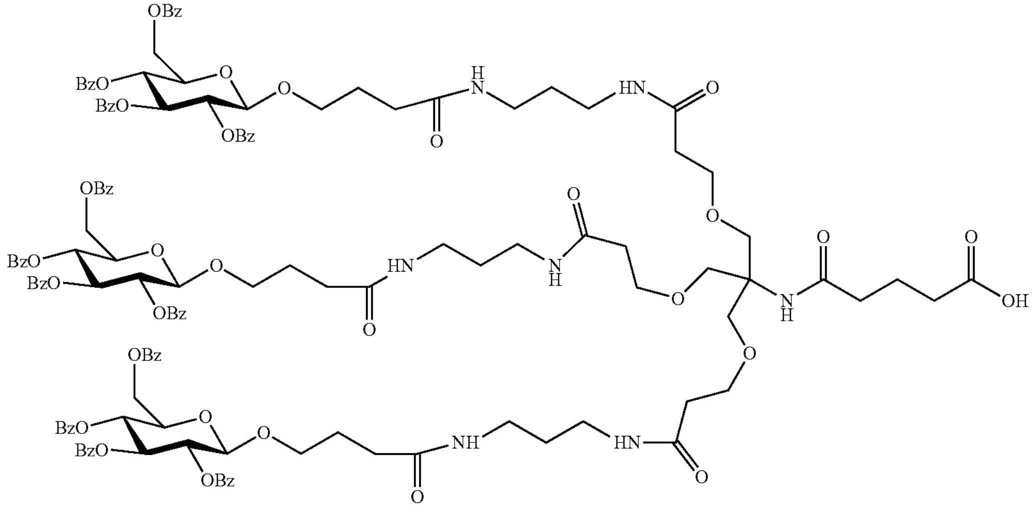
1.05 g, 100%

A non-limiting example of a procedure for synthesis of a hex-antennary glucose receptor inhibitor is shown here:
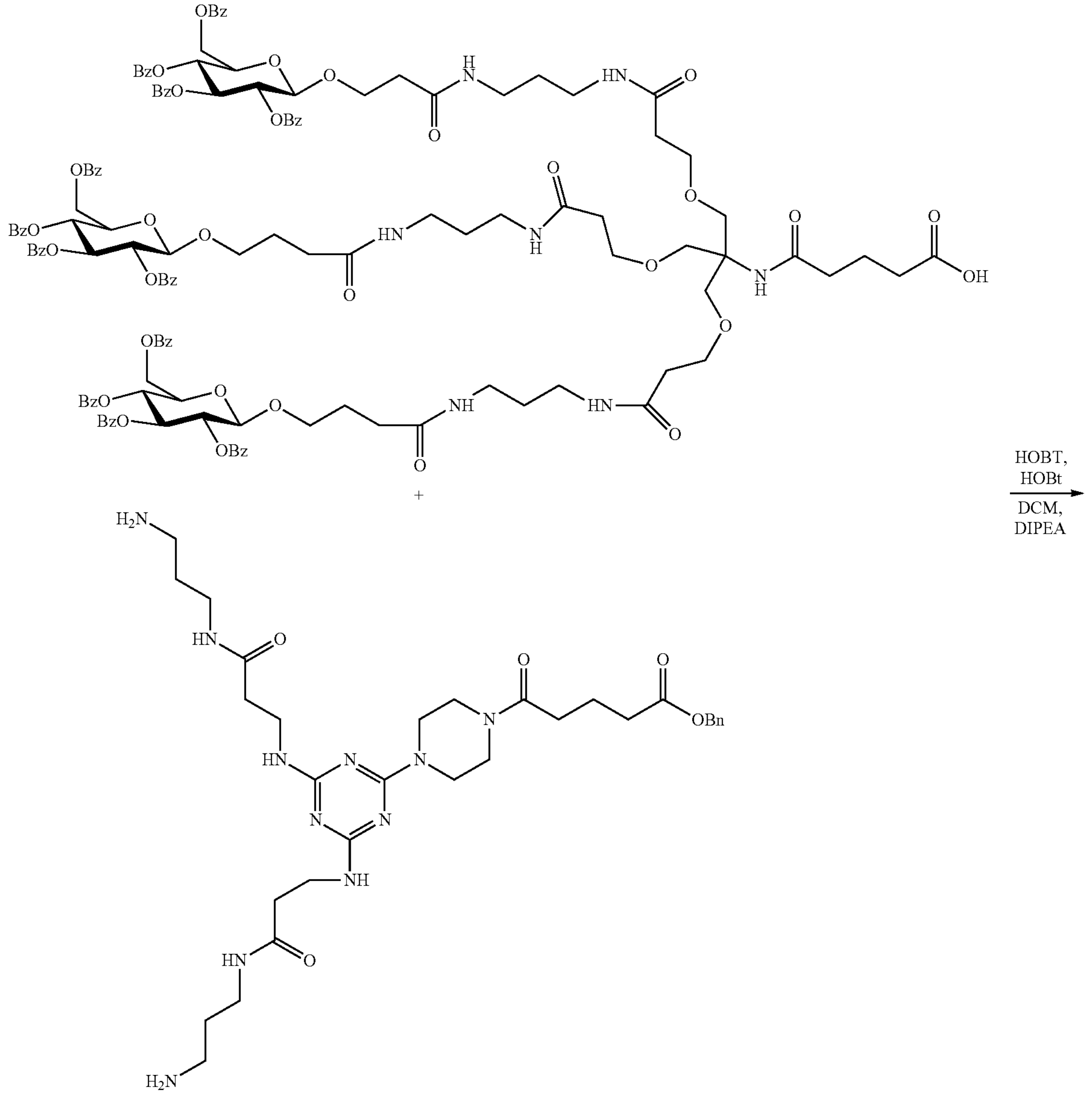

-continued
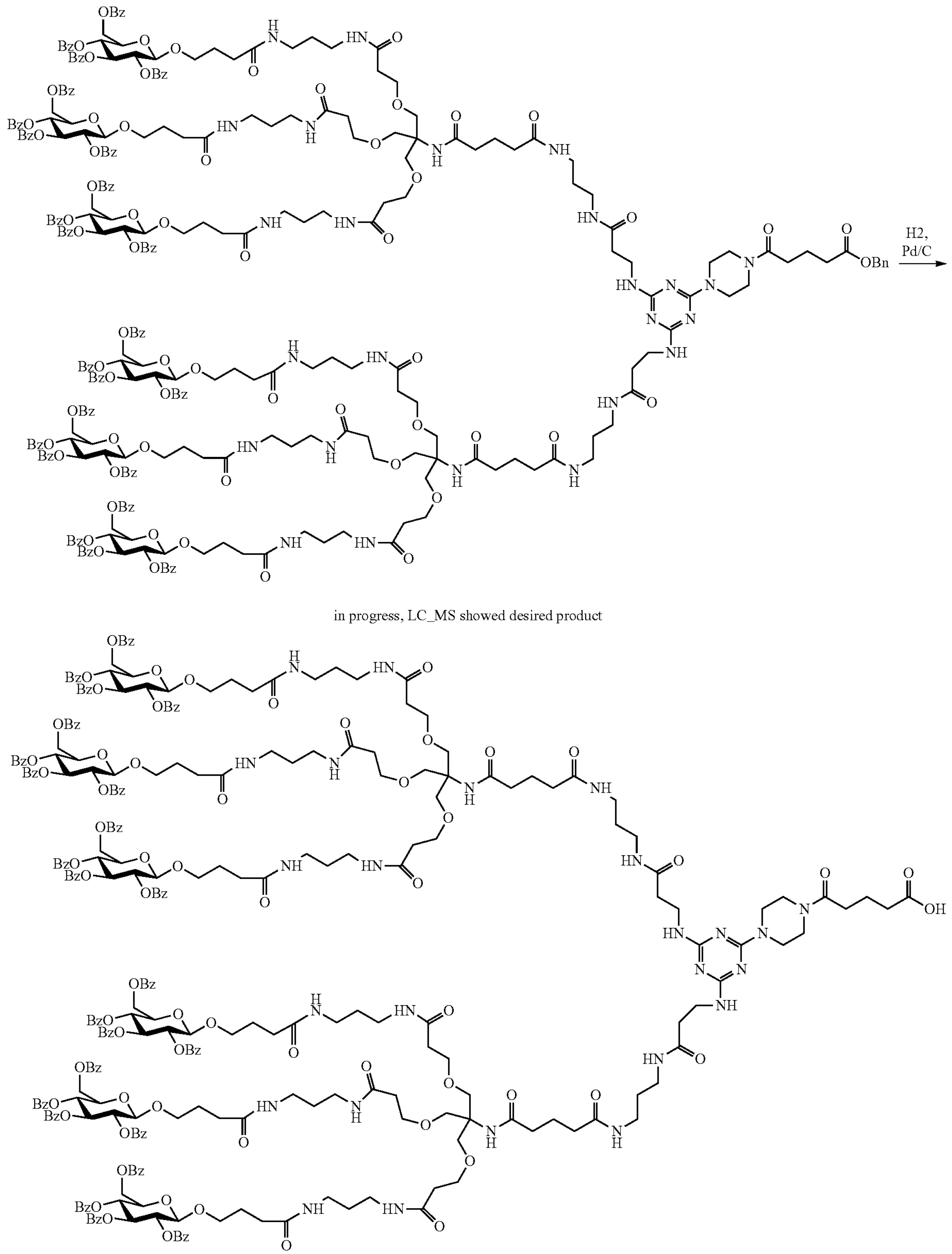

In some embodiments, an oligonucleotide, e.g., a DMD oligonucleotide comprises an additional component, wherein the additional component increases internalization of the oligonucleotide via receptor -mediated endocytosis.

In some embodiments, an oligonucleotide, e.g., a DMD oligonucleotide comprises an additional component, wherein the additional component is an aptamer.

In some embodiments, an oligonucleotide, e.g., a DMD oligonucleotide comprises an additional component, wherein the additional component is an aptamer which is a peptide aptamer, a RNA apatamer, a DNA aptamer, or an aptamer which comprises a RNA nucleotide, a DNA nucleotide, a modified nucleotide, and/or an amino acid and/or peptide.

In some embodiments, an oligonucleotide, e.g., a DMD oligonucleotide comprises an additional component, wherein the additional component is an aptamer which binds to a receptor.

In some embodiments, an oligonucleotide, e.g., a DMD oligonucleotide comprises an additional component, wherein the additional component is an aptamer which binds to a receptor which is a mannose receptor, a mannose-6-phosphate receptor or transferrin receptor.

In some embodiments, an oligonucleotide, e.g., a DMD oligonucleotide comprises an additional component, wherein the additional component is an aptamer that increases internalization of the oligonucleotide.

In some embodiments, an oligonucleotide, e.g., a DMD oligonucleotide comprises an additional component, wherein the additional component is an aptamer that increases internalization of the oligonucleotide via receptor -mediated endocytosis.

In some embodiments, an oligonucleotide, e.g., a DMD oligonucleotide comprises an additional component, wherein the additional component is or comprises a peptide. In some embodiments, a peptide is a cell-penetrating peptide (CPP). In some embodiments, a CPP is arginine-rich. In some embodiments, a CPP has or comprises the amino acid sequence of RRQPPRSISSHPC (SEQ ID NO: 3252) or RRQPPRSISSHP (SEQ ID NO: 3253).

A non-limiting example of a procedure for conjugating a peptide to a DMD oligonucleotide is shown here (SEQ ID NOS 3253 and 3253, respectively, in order of appearance):

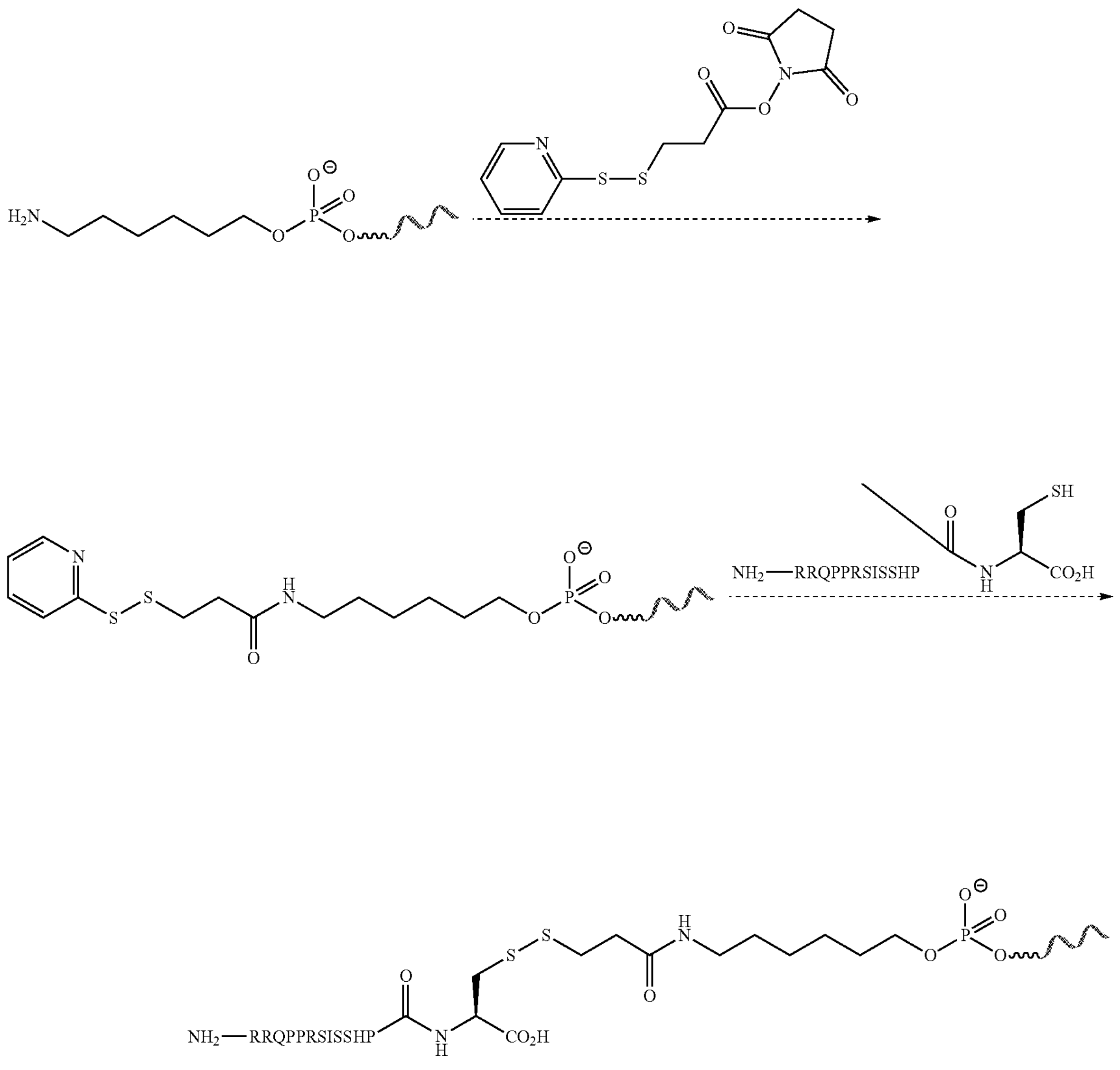

In some embodiments, a peptide comprises the amino acid sequence of RC or RRC. In some embodiments, a peptide comprises a structure of either of:

WV-DL-020

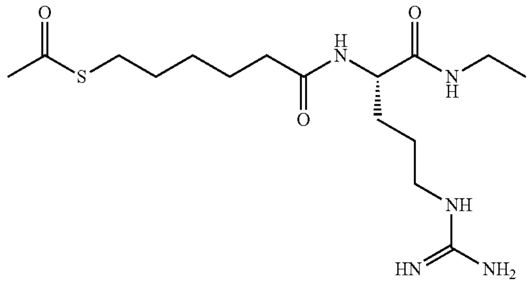

WV-DL-021

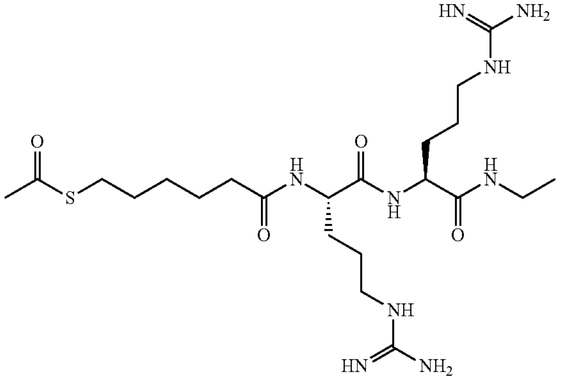

Provided oligonucleotides, e.g., DMD oligonucleotides, may be conjugated as PMOs to cell-penetrating peptides. Yokota et al. 2012 Nucl. Acid Ther. 22: 306; Wu et al. 2009 Mol. Ther. 17: 864-871; Goyenvalle et al. 2010 Mol. Ther. 18, 198-205; Jearawiriyapaisarn et al. 2010 Cardiovasc. Res. 85, 444-453; Crisp et al. 2011 Hum. Mol. Genet. 20, 413-421; Widrick et al. 2011; Wu et al. 2011 PLOS One 6, e19906.

In some embodiments, a composition comprising an oligonucleotide, e.g., a DMD oligonucleotide comprises one or more peptide and/or peptide tag. In some embodiments, a peptide is or comprises a muscle-targeting heptapeptide (MSP). In some embodiments, the sequence of a muscle-targeting helptapeptide is or comprises the sequence of ASSLNIAXB (SEQ ID NO: 3254). In some embodiments, a peptide is or comprises a cell-penetrating peptide. In some embodiments, the sequence of a cell-penetrating peptide comprises multiple arginines. In some embodiments, the sequence of a cell-penetrating peptide is or comprises RXRRBRRXRRBRXB (SEQ ID NO: 3255).

In some embodiments, the sequence of a peptide is or comprises a sequence of: ASSLNIAXB (SEQ ID NO: 3254), RXRRBRRXRRBRXB (SEQ ID NO: 3255), RXRRXRRXRRXRXB (SEQ ID NO: 3256), ASSLNIAXB-RXRRBRRXRRBRXB (SEQ ID NO: 3257), RXRRBRRXRRBRXB-ASSLNIAXB (SEQ ID NO: 3258), or any sequence comprising both ASSLNIAXB and either RXRRBRRXRRBRXB (SEQ ID NO: 3255) or RXRRXRRXRRXRXB(SEQ ID NO: 3256), wherein R is L-arginine, X is 6-aminohexanoic acid, and B is beta-alanine.

A muscle-targeting heptapeptide (MSP) fused to an arginine-rich cell-penetrating peptide (B-peptide) may be conjugated to provided oligonucleotides in accordance with the present disclosure. Yin et al. 2009 Hum. Mol. Genet. 18: 4405-4414. Yokota et al. 2009 Arch. Neurol. 66: 32.

In some embodiments, a composition comprising an oligonucleotide, e.g., a DMD oligonucleotide comprises anisamide or a derivative thereof.

In some embodiments, a composition comprising an oligonucleotide, e.g., a DMD oligonucleotide comprises one or more guanidinium group. vPMOs are reportedly morpholino oligomers conjugated with delivery moiety containing eight terminal guanidinium groups on a dendrimer scaffold that enable entry into cells. Morcos et al. 2008 Biotechniques 45: 613-618; Yokota et al. 2012 Nucl. Acid Ther. 22: 306.

In some embodiments, an oligonucleotide, e.g., DMD oligonucleotide is delivered using a leash. A non-limiting example of a leash is reported in: Gebski et al. 2003 Hum. Mol. Gen. 12: 1801-1811.

In some embodiments, an additional chemical moiety is cholesterol; L-carnitine (amide and carbamate bond); Folic acid; Cleavable lipid (1,2-dilaurin and ester bond); Insulin receptor ligand; Gambogic acid; CPP; Glucose (tri- and hex-antennary); or Mannose (tri- and hex-antennary, alpha and beta).

Certain chemical moieties, e.g., lipid moieties, carbohydrate moieties, targeting moieties, etc. and linker moieties for connecting such moieties to oligonucleotide chains (e.g., via sugars, nucleobases, internucleotidic linkages, etc.) are described in the Tables as example; some of such chemical and linker moieties and related technologies for their preparation, conjugation with oligonucleotide chains, and uses are described in e.g., WO 2017/062862, WO 2017/192679, WO 2017/210647, etc.

Lipids

In some embodiments, an additional chemical moiety/component is a lipid moiety. In some embodiments, the present disclosure provided oligonucleotide compositions further comprise one or more lipids. In some embodiments, incorporation of lipid moieties into oligonucleotides can provide unexpected, greatly improved properties (e.g., activities, toxicities, distribution, pharmacokinetics, etc.).

A composition can be obtained by combining an active compound with a lipid. In some embodiments, the lipid is conjugated to an active compound. In some embodiments, the lipid is not conjugated to an active compound. In some embodiments, a lipid comprises a $C_{10}$-$C_{40}$ linear, saturated or partially unsaturated, aliphatic chain. In some embodiments, a lipid comprises a $C_{10}$-$C_{40}$ linear, saturated or partially unsaturated, aliphatic chain, optionally substituted with one or more $C_{1-4}$ aliphatic group. In some embodiments, a lipid comprises a $C_{10}$-$C_{60}$ linear, saturated or partially unsaturated, aliphatic chain. In some embodiments, a lipid comprises a $C_{10}$-$C_{60}$ linear, saturated or partially unsaturated, aliphatic chain, optionally substituted with one or more $C_{1-4}$ aliphatic group. In some embodiments, a lipid comprises a $C_{10}$-$C_{80}$ linear, saturated or partially unsaturated, aliphatic chain. In some embodiments, a lipid comprises a $C_{10}$-$C_{80}$ linear, saturated or partially unsaturated, aliphatic chain, optionally substituted with one or more $C_{1-4}$ aliphatic group. In some embodiments, a lipid comprises a $C_{10}$-$C_{100}$ linear, saturated or partially unsaturated, aliphatic chain. In some embodiments, a lipid comprises a $C_{10}$-$C_{100}$ linear, saturated or partially unsaturated, aliphatic chain, optionally substituted with one or more $C_{1-4}$ aliphatic group.

In some embodiments, a lipid comprises an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein. In some embodiments, a lipid comprises an optionally substituted $C_{10}$-$C_{80}$ saturated or partially unsaturated, aliphatic chain. In some embodiments, a lipid comprises an optionally substituted $C_{10}$-$C_{80}$ linear, saturated or partially unsaturated, aliphatic chain. In some embodiments, a lipid comprises a $C_{10}$-$C_{80}$ linear, saturated or partially unsaturated, aliphatic chain, optionally substituted with one or more $C_{1-4}$ aliphatic group. In some embodiments, a lipid comprises an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein. In some embodiments, a lipid comprises an optionally substituted $C_{10}$-$C_{60}$ saturated or partially unsaturated, aliphatic chain. In some embodiments, a lipid comprises an optionally substituted $C_{10}$-$C_{60}$ linear, saturated or partially unsaturated, aliphatic chain. In some embodiments, a lipid comprises a $C_{10}$-$C_{60}$ linear, saturated or partially unsaturated, aliphatic chain, optionally substituted with one or more $C_{1-4}$ aliphatic group. In some embodiments, a lipid comprises an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein. In some embodiments, a lipid comprises an optionally substituted $C_{10}$-$C_{40}$ saturated or partially unsaturated, aliphatic chain. In some embodiments, a lipid comprises an optionally substituted $C_{10}$-$C_{40}$ linear, saturated or partially unsaturated, aliphatic chain. In some embodiments, a lipid comprises a $C_{10}$-$C_{40}$ linear, saturated or partially unsaturated, aliphatic chain, optionally substituted with one or more $C_{1-4}$ aliphatic group. In some embodiments, a lipid comprises an unsubstituted $C_{10}$-$C_{80}$ linear, saturated or partially unsaturated, aliphatic chain. In some embodiments, a lipid comprises no more than one optionally substituted $C_{10}$-$C_{80}$ linear, saturated or partially unsaturated, aliphatic chain. In some embodiments, a lipid comprises two or more optionally substituted $C_{10}$-$C_{80}$ linear, saturated or partially unsaturated, aliphatic chain. In some embodiments, a lipid comprises an unsubstituted $C_{10}$-$C_{60}$ linear, saturated or partially unsaturated, aliphatic chain. In some embodiments, a lipid comprises no more than one optionally substituted $C_{10}$-$C_{60}$ linear, saturated or partially unsaturated, aliphatic chain. In some embodiments, a lipid comprises two or more optionally substituted $C_{10}$-$C_{60}$ linear, saturated or partially unsaturated, aliphatic chain. In some embodiments, a lipid comprises an unsubstituted $C_{10}$-$C_{40}$ linear, saturated or partially unsaturated, aliphatic chain. In some embodiments, a lipid comprises no more than one optionally substituted $C_{10}$-$C_{40}$ linear, saturated or partially unsaturated, aliphatic chain. In some embodiments, a lipid comprises two or more optionally substituted $C_{10}$-$C_{40}$ linear, saturated or partially unsaturated, aliphatic chain. In some embodiments, a lipid comprises a $C_{10}$-$C_{40}$ linear, saturated or partially unsaturated, aliphatic chain. In some embodiments, a lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. In some embodiments, a lipid is not conjugated to an oligonucleotide chain (whether through one or more linker moieties or not). In some embodiments, a lipid is conjugated to an oligonucleotide chain, optionally through one or more linker moieties.

In some embodiments, a lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. In some embodiments, a lipid has a structure of any of:

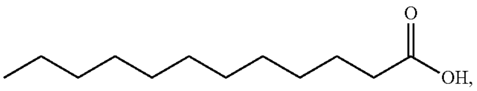

Lauric acid

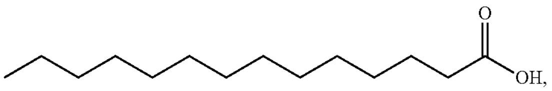

Myristic Acid

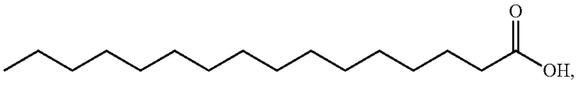

Palmitic Acid

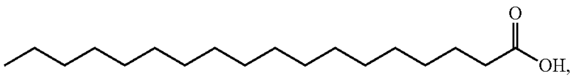

Stearic Acid

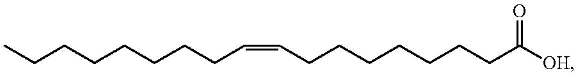

Oleic Acid

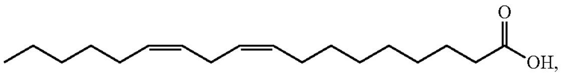

Linoleic acid

-continued

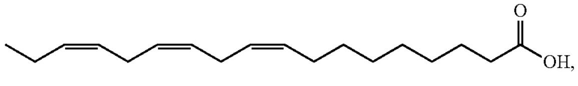

Alpha Linolenic acid

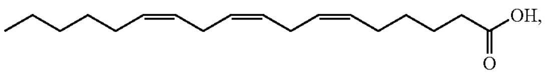

Gamma Linolenic acid

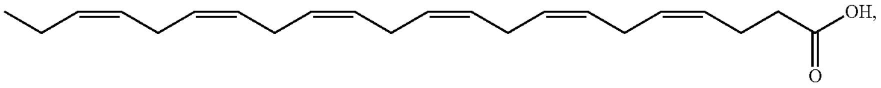

Docosahexaenoic acid

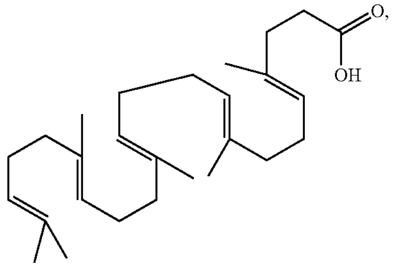

Turbinaric acid

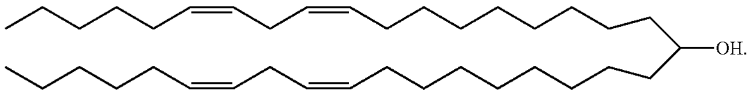

Dilinoleyl alcohol

In some embodiments, an active compound is an oligonucleotide described herein. In some embodiments, an active compound is an oligonucleotide capable of mediating skipping of an exon in dystrophin. In some embodiments, an active compound is an oligonucleotide capable of mediating skipping of exon 51 in dystrophin. In some embodiments, an active compound is a nucleic acid of a sequence comprising or consisting of any sequence of any nucleic acid described herein. In some embodiments, an active compound is a nucleic acid of a sequence comprising or consisting of any sequence of any oligonucleotide listed in Table A1. In some embodiments, a composition comprises a lipid and an an active compound, and further comprises another component selected from: another lipid, and a targeting compound or moiety. In some embodiments, a lipid includes, without limitation: an amino lipid; an amphipathic lipid; an anionic lipid; an apolipoprotein; a cationic lipid; a low molecular weight cationic lipid; a cationic lipid such as CLinDMA and DLinDMA; an ionizable cationic lipid; a cloaking component; a helper lipid; a lipopeptide; a neutral lipid; a neutral zwitterionic lipid; a hydrophobic small molecule; a hydrophobic vitamin; a PEG-lipid; an uncharged lipid modified with one or more hydrophilic polymers; phospholipid; a phospholipid such as 1,2-dioleoyl-sn-glycero-3-phosphoethanolamine; a stealth lipid; a sterol; a cholesterol; and a targeting lipid; and any other lipid described herein or reported in the art. In some embodiments, a composition comprises a lipid and a portion of another lipid capable of mediating at least one function of another lipid. In some embodiments, a targeting compound or moiety is capable of targeting a compound (e.g., a composition comprising a lipid and a active compound) to a particular cell or tissue or subset of cells or tissues. In some embodiments, a targeting moiety is designed to take advantage of cell- or tissue-specific expression of particular targets, receptors, proteins, or other subcellular components; In some embodiments, a targeting moiety is a ligand (e.g., a small molecule, antibody, peptide, protein, carbohydrate, aptamer, etc.) that targets a composition to a cell or tissue, and/or binds to a target, receptor, protein, or other subcellular component.

In some embodiments, incorporation of a lipid moiety for delivery of an active compound allow (e.g., do not prevent or interfere with) the function of an active compound. Non-limiting example lipids include: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl.

In some embodiments, lipid conjugation, such as conjugation with fatty acids, may improve one or more properties of oligonucleotides. In some embodiments, lipid conjugation improves delivery.

In some embodiments, as supported by experimental data, conjugation with lipids can increase skipping efficiency.

In some embodiments, a composition for delivery of an active compound is capable of targeting an active compound to particular cells or tissues, as desired. In some embodiments, a composition for delivery of an active compound is capable of targeting an active compound to a muscle cell or tissue. In some embodiments, the present disclosure pertains to compositions and methods related to delivery of active compounds, wherein the compositions comprise an active compound a lipid. In some embodiments to a muscle cell or tissue, the lipid is selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. Example compositions were prepared comprising an active compound (WV-942) and a lipid, and these compositions were capable of delivering an active compound to target cells and tissues, e.g., muscle cells and tissues. The example lipids used include stearic acid, oleic acid, alpha-linolenic acid, gamma-linolenic acids, cis-DHA, turbinaric acid and dilinoleyl acid.

Various compositions comprising an active compound and any of: stearic acid, oleic acid, alpha-linolenic acid, gamma-linolenic acid, cis-DHA or turbinaric acid, were able to deliver an active compound to various tissues, including gastrocnemius muscle tissue, heart muscle tissue, quadriceps muscle tissue, gastrocnemius muscle tissue, and diaphragm muscle tissue.

In some embodiments, a composition comprising a lipid, selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, and an active compound is capable of delivering an active compound to extra-hepatic cells and tissues, e.g., muscle cells and tissues.

In some embodiments, a lipid has the structure of $R^{LD}$—OH, wherein wherein $R^{LD}$ is an optionally substituted, $C_{10}$-$C_{80}$ saturated or partially unsaturated aliphatic group, wherein one or more methylene units are optionally and independently replaced by $C_1$-$C_6$ alkylene, $C_1$-$C_6$ alkenylene, —C≡C—, a $C_1$-$C_6$ heteroaliphatic moiety, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—. In some embodiments, a lipid has the structure of $R^{LD}$—C(O)OH. In some embodiments, $R^{LD}$ is

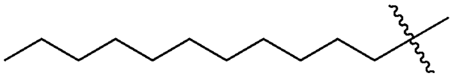
,
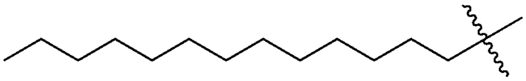
,
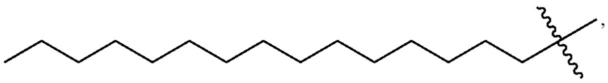
,
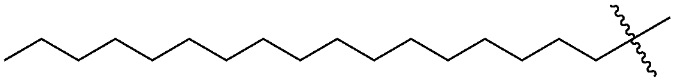
,
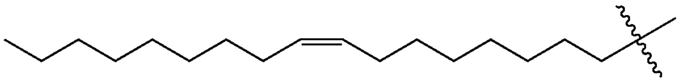
,
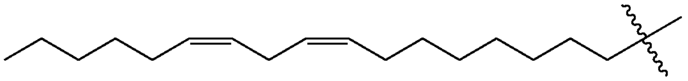
,
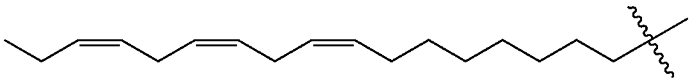
,
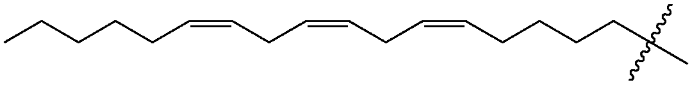
,
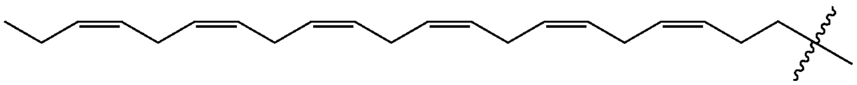
,
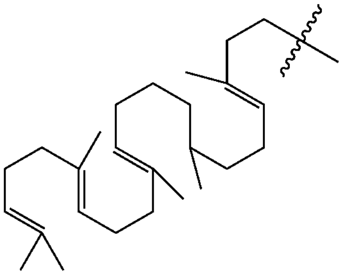
, or
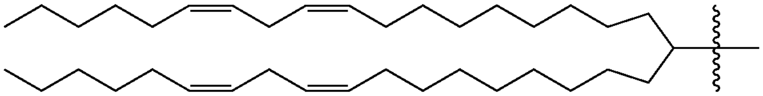
.

Example oligonucleotides comprising such $R^{LD}$ groups are described herein and in WO 2017/062862, the description of $R^{LD}$ is incorporated herein by reference.

In some embodiments, a lipid is conjugated to an active compound optionally through a linker moiety. In some embodiments, a linker is $L^M$. In some embodiments, a linker is L. In some embodiments, -L-comprises a bivalent aliphatic chain. In some embodiments, -L-comprises a phosphate group. In some embodiments, -L-comprises a phosphorothioate group. In some embodiments, -L- has the structure of —C(O)NH—(CH$_2$)$_6$—OP(═O)(S$^-$)—. In some embodiments, -L- has the structure of —C(O)NH —(CH$_2$)$_6$—OP(═O)(O$^-$)—.

Lipids, optionally through linkers, can be conjugated to oligonucleotides at various suitable locations. In some embodiments, lipids are conjugated through the 5'-OH group. In some embodiments, lipids are conjugated through the 3'-OH group. In some embodiments, lipids are conjugated through one or more sugar moieties. In some embodiments, lipids are conjugated through one or more bases. In some embodiments, lipids are incorporated through one or more internucleotidic linkages. In some embodiments, an oligonucleotide may contain multiple conjugated lipids which are independently conjugated through its 5'-OH, 3'-OH, sugar moieties, base moieties and/or internucleotidic linkages.

In some embodiments, a composition comprises an oligonucleotide, e.g., DMD oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid, arachidonic acid, and dilinoleyl, wherein the lipid is directly conjugated to the biologically active agent (without a linker interposed between the lipid and the biologically active agent). In some embodiments, a composition comprises an oligonucleotide and a lipid selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, wherein the lipid is directly conjugated to the biologically active agent (without a linker interposed between the lipid and the biologically active agent).

In some embodiments, a composition comprises a DMD oligonucleotide and any lipid known in the art, wherein the lipid is conjugated or not conjugated to the oligonucleotide.

Non-limiting examples of lipids, and methods of making them and conjugating them are provided in, for example, WO 2017/062862, the lipids and related methods of which are incorporated herein by reference.

Targeting Moieties

In some embodiments, an additional chemical moiety/component is a targeting moiety. In some embodiments, a provided composition further comprises a targeting moiety. In some embodiments, a targeting moiety is conjugated to an oligonucleotide chain. In some embodiments, a biologically active agent is conjugated to both a lipid and an oligonucleotide chain. Various targeting moieties can be used in accordance with the present disclosure, e.g., lipids, antibodies, peptides, carbohydrates, etc.

Targeting moieties can be incorporated into provided technologies through many types of methods in accordance with the present disclosure. In some embodiments, targeting moieties are chemically conjugated with oligonucleotides.

In some embodiments, provided compositions comprise two or more targeting moieties. In some embodiments, provided oligonucleotides comprise two or more conjugated targeting moieties. In some embodiments, the two or more conjugated targeting moieties are the same. In some embodiments, the two or more conjugated targeting moieties are different. In some embodiments, provided oligonucleotides comprise no more than one targeting moiety. In some embodiments, oligonucleotides of a provided composition comprise different types of conjugated targeting moieties. In some embodiments, oligonucleotides of a provided composition comprise the same type of targeting moieties.

Targeting moieties can be conjugated to oligonucleotides optionally through linkers. Various types of linkers in the art can be utilized in accordance of the present disclosure. In some embodiments, a linker comprises a phosphate group, which can, for example, be used for conjugating targeting moieties through chemistry similar to those employed in oligonucleotide synthesis. In some embodiments, a linker comprises an amide, ester, or ether group. In some embodiments, a linker is $L^M$. In some embodiments, a linker has the structure of -L-. Targeting moieties can be conjugated through either the same or different linkers compared to lipids.

Targeting moieties, optionally through linkers, can be conjugated to oligonucleotides at various suitable locations. In some embodiments, targeting moieties are conjugated through the 5'-OH group. In some embodiments, targeting moieties are conjugated through the 3'-OH group. In some embodiments, targeting moieties are conjugated through one or more sugar moieties. In some embodiments, targeting moieties are conjugated through one or more bases. In some embodiments, targeting moieties are incorporated through one or more internucleotidic linkages. In some embodiments, an oligonucleotide may contain multiple conjugated targeting moieties which are independently conjugated through its 5'-OH, 3'-OH, sugar moieties, base moieties and/or internucleotidic linkages. Targeting moieties and lipids can be conjugated either at the same, neighboring and/or separated locations. In some embodiments, a targeting moiety is conjugated at one end of an oligonucleotide, and a lipid is conjugated at the other end.

In some embodiments, a targeting moiety interacts with a protein on the surface of targeted cells. In some embodiments, such interaction facilitates internalization into targeted cells. In some embodiments, a targeting moiety comprises a sugar moiety. In some embodiments, a targeting moiety comprises a polypeptide moiety. In some embodiments, a targeting moiety comprises an antibody. In some embodiments, a targeting moiety is an antibody. In some embodiments, a targeting moiety comprises an inhibitor. In some embodiments, a targeting moiety is a moiety from a small molecule inhibitor. In some embodiments, an inhibitor is an inhibitor of a protein on the surface of targeted cells. In some embodiments, an inhibitor is a carbonic anhydrase inhibitor. In some embodiments, an inhibitor is a carbonic anhydrase inhibitor expressed on the surface of target cells. In some embodiments, a carbonic anhydrase is I, II, III, IV, V, VI, VII, VIII, IX, X, XI, XII, XIII, XIV, XV or XVI. In some embodiments, a carbonic anhydrase is membrane bound. In some embodiments, a carbonic anhydrase is IV, IX, XII or XIV. In some embodiments, an inhibitor is for IV, IX, XII and/or XIV. In some embodiments, an inhibitor is a carbonic anhydrase III inhibitor. In some embodiments, an inhibitor is a carbonic anhydrase IV inhibitor. In some embodiments, an inhibitor is a carbonic anhydrase IX inhibitor. In some embodiments, an inhibitor is a carbonic anhydrase XII inhibitor. In some embodiments, an inhibitor is a carbonic anhydrase XIV inhibitor. In some embodiments, an inhibitor comprises or is a sulfonamide (e.g., those described in Supuran, CT. *Nature Rev Drug Discover* 2008, 7, 168-181, which sulfonamides are incorporated herein by reference). In some embodiments, an inhibitor is a sulfonamide. In some embodiments, targeted cells are muscle cells.

In some embodiments, a targeting moiety is $R^{LD}$ or $R^{CD}$ or $R^{TD}$ as defined and described in the present disclosure. In some embodiments, $R^{CD}$ comprises or is

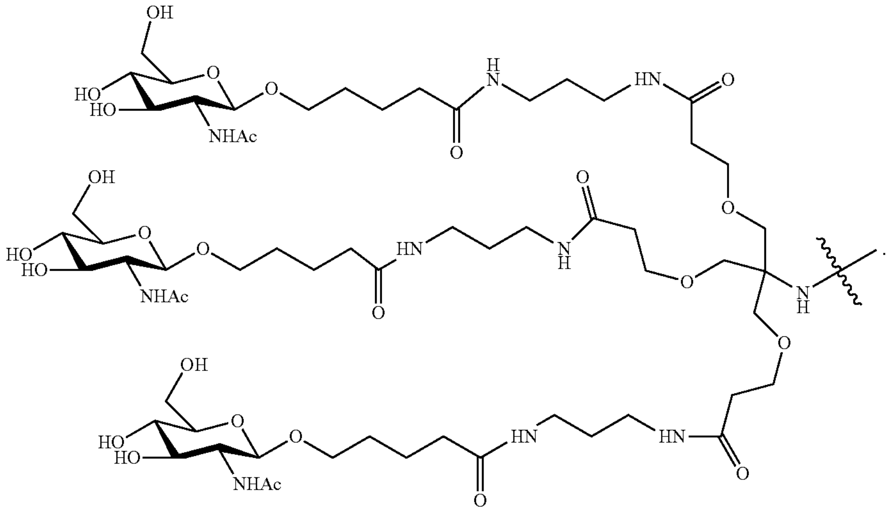
In some embodiments, $R^{CD}$ comprises or is
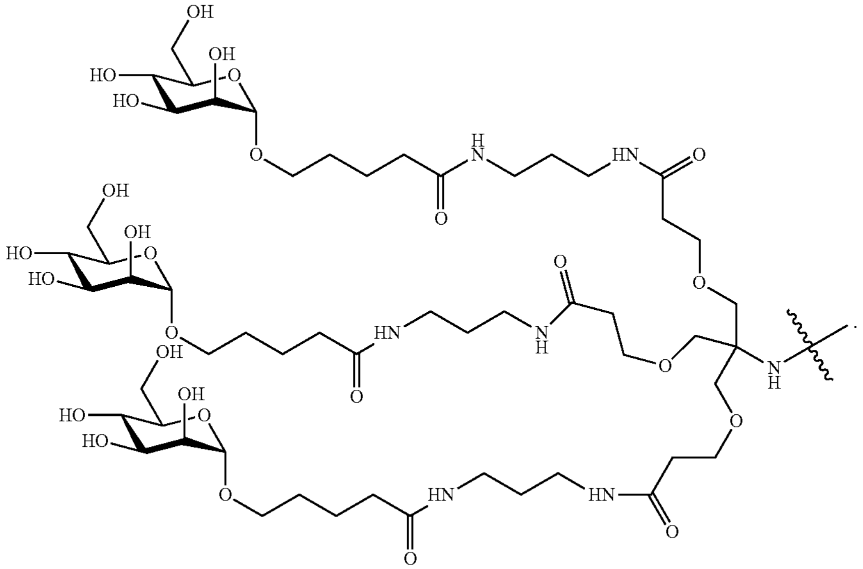
In some embodiments, $R^{CD}$ comprises or is
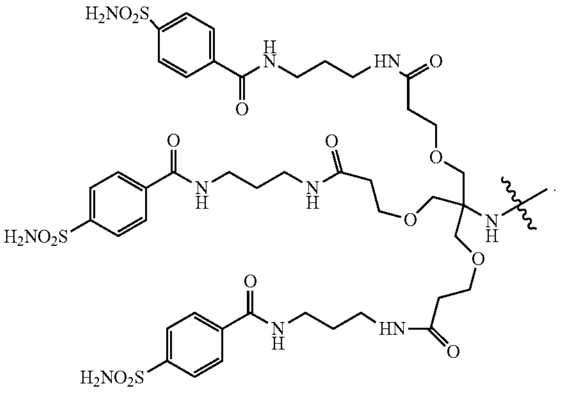 [SMILES: *NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]

In some embodiments, $R^{TD}$ is a sulfonamide moiety as described in the present disclosure. In some embodiments, $R^{TD}$ comprises or is
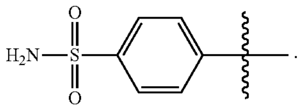 [SMILES: *c1ccc(S(N)(=O)=O)cc1]
In some embodiments, $R^{TD}$ or $R^{CD}$ comprises or is
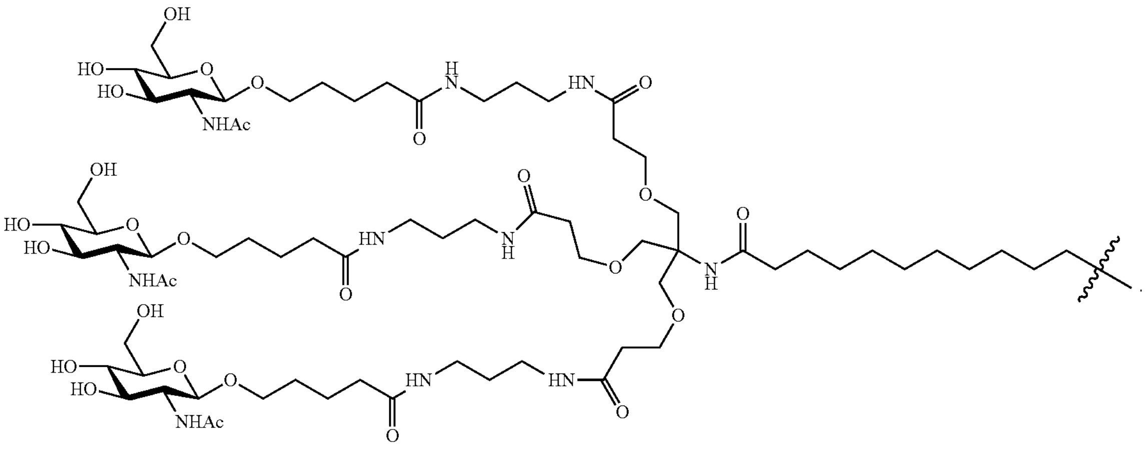
In some embodiments, $R^{TD}$ or $R^{CD}$ comprises or is
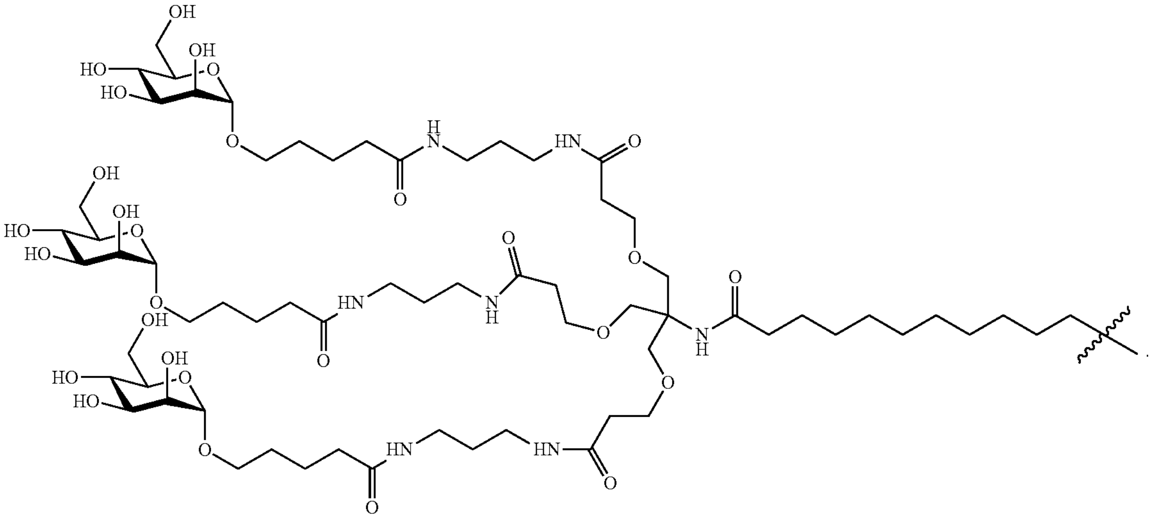

In some embodiments, $R^{TD}$ comprises or is
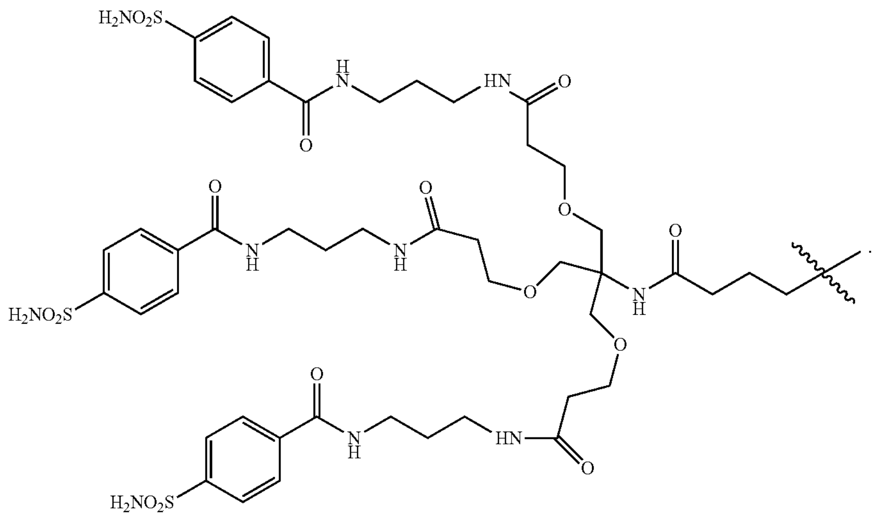 [SMILES: *CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]
In some embodiments, $R^{TD}$ or $R^{CD}$ comprises or is
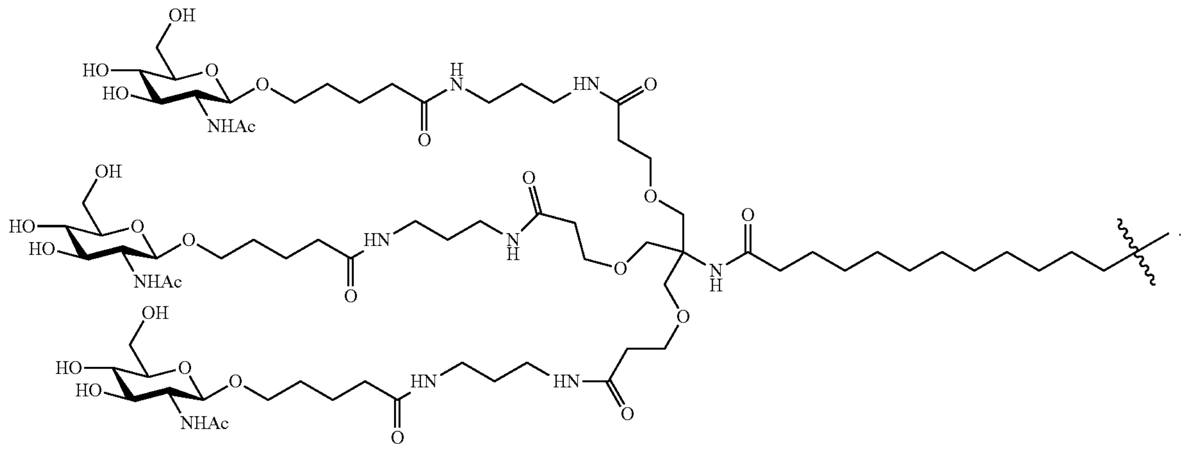

In some embodiments, $R^{TD}$ or $R^{CD}$ comprises or is
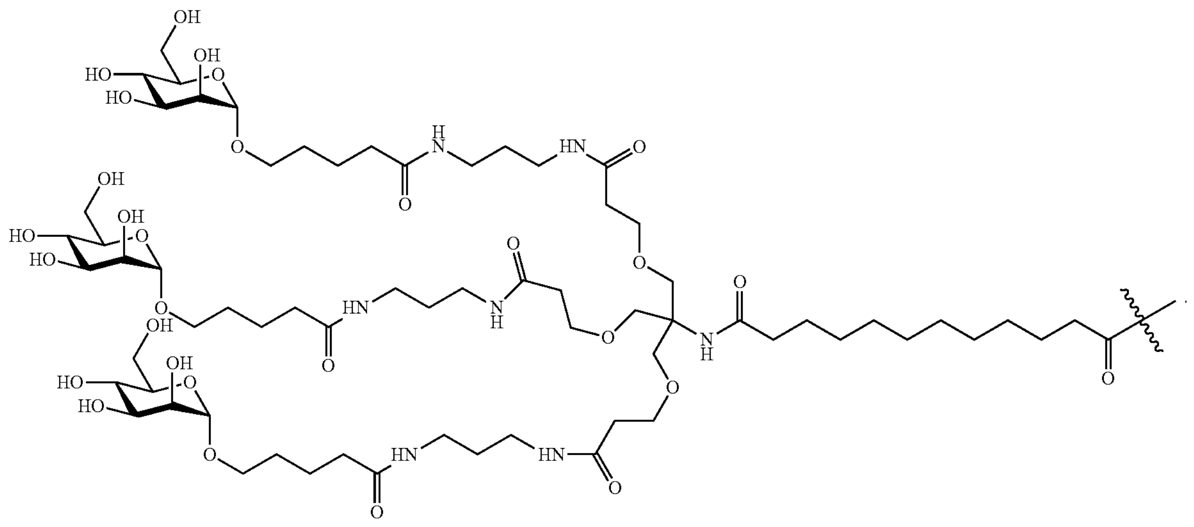
In some embodiments, $R^{TD}$ comprises or is
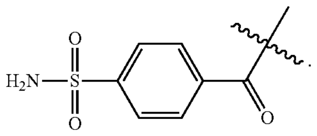 [SMILES: *C(=O)c1ccc(S(N)(=O)=O)cc1]
In some embodiments, $R^{TD}$ comprises or is
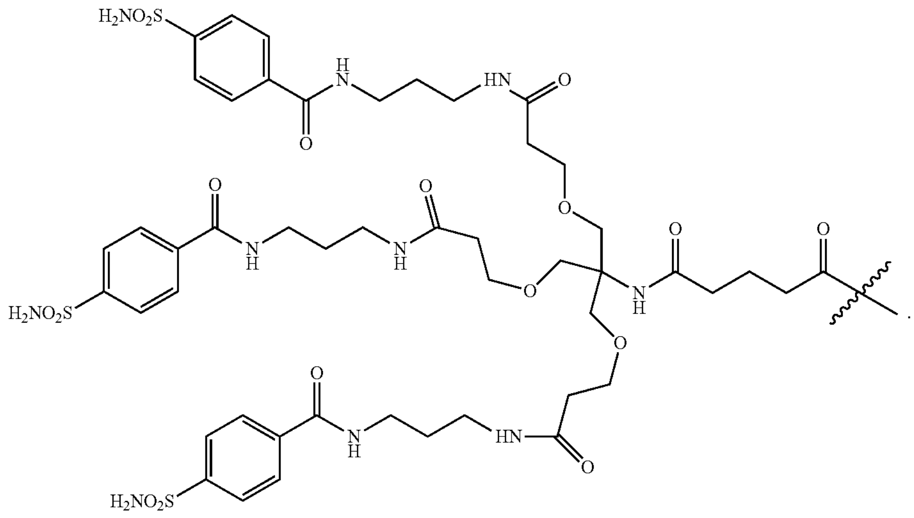 [SMILES: *C(=O)CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]

In some embodiments, $R^{TD}$ or $R^{CD}$ comprises or is
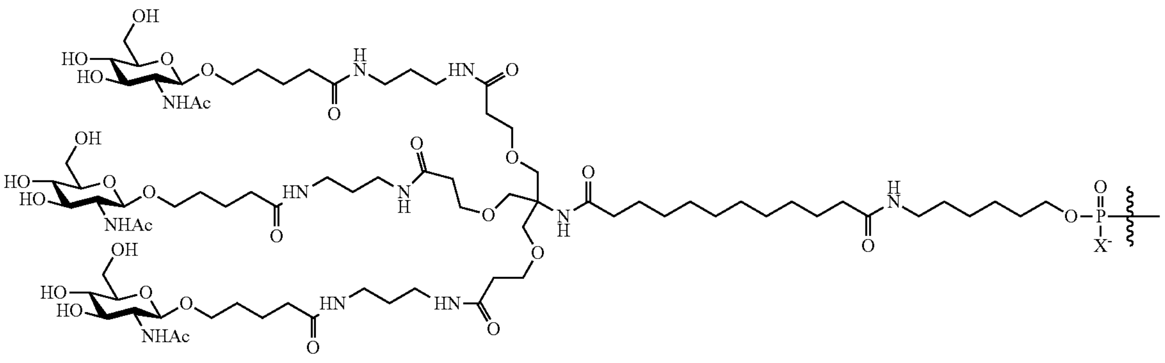
X = O or S
In some embodiments, $R^{TD}$ or $R^{CD}$ comprises or is
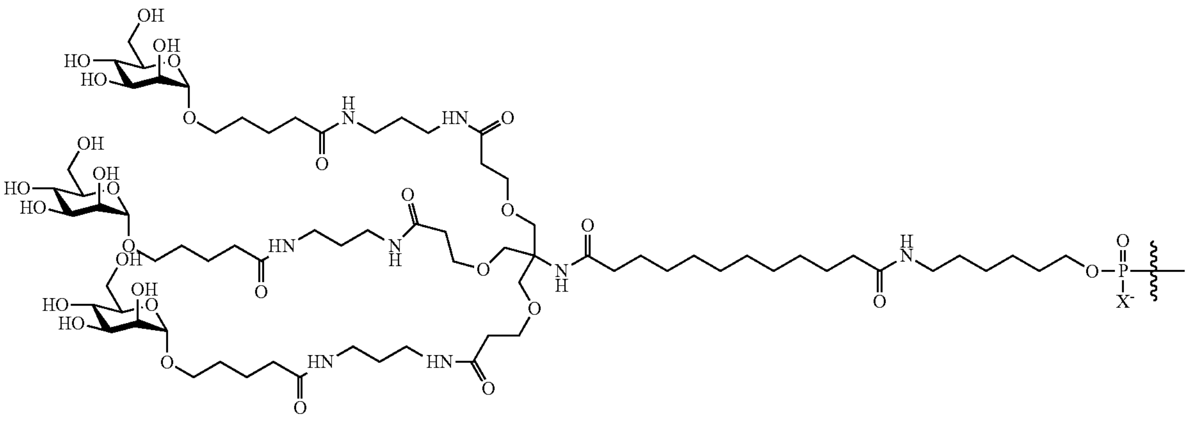
X = O or S
In some embodiments, $R^{TD}$ comprises or is
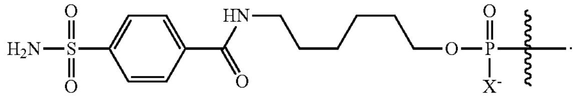
X = O or S In some embodiments, $R^{TD}$ comprises or is

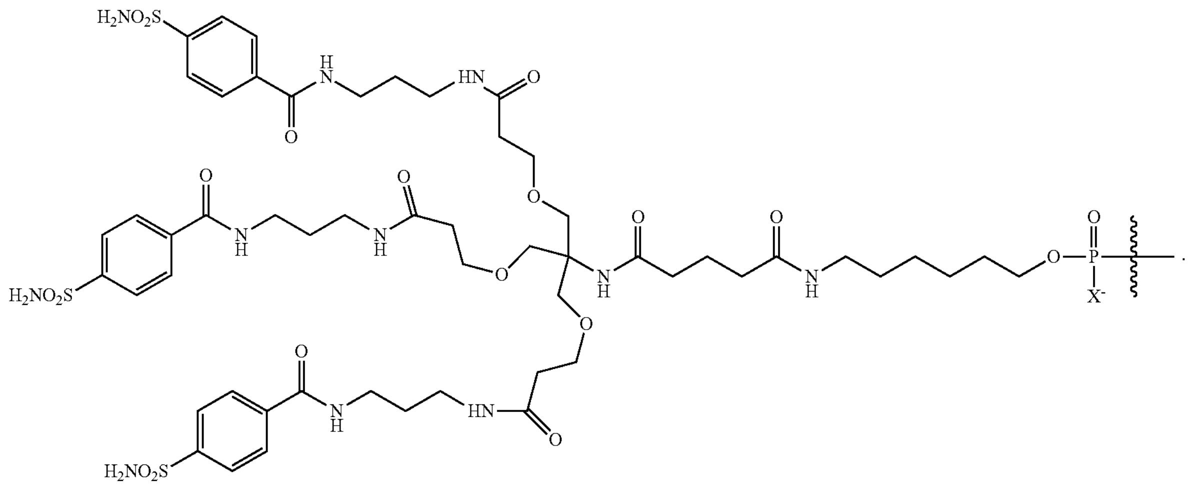

X = O or S

In some embodiments, $R^{LD}$ is a targeting moiety that comprises or is a lipid moiety. In some embodiments, X is O. In some embodiments, X is S.

In some embodiments, the present disclosure provides technologies (e.g., reagents, methods, etc.) for conjugating various moieties to oligonucleotide chains. In some embodiments, the present disclosure provides technologies for conjugating targeting moiety to oligonucleotide chains. In some embodiments, the present disclosure provides acids comprising targeting moieties for conjugation, e.g., $R^{LD}$—COOH. In some embodiments, the present disclosure provides linkers for conjugation, e.g., $L^{LD}$. A person having ordinary skill in the art understands that many known and widely practiced technologies can be utilized for conjugation with oligonucleotide chains in accordance with the present disclosure. In some embodiments, a provided acid is

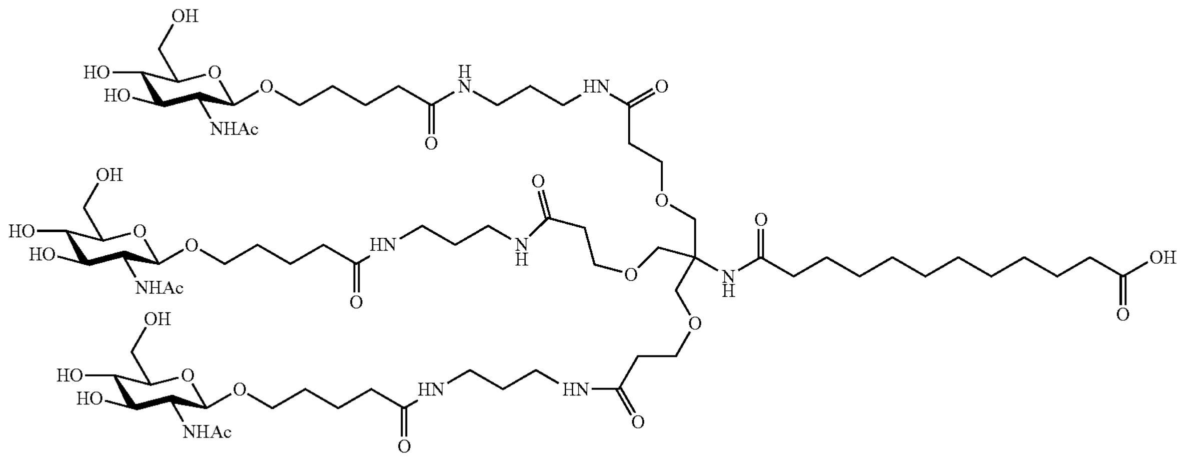

In some embodiments, a provided acid is

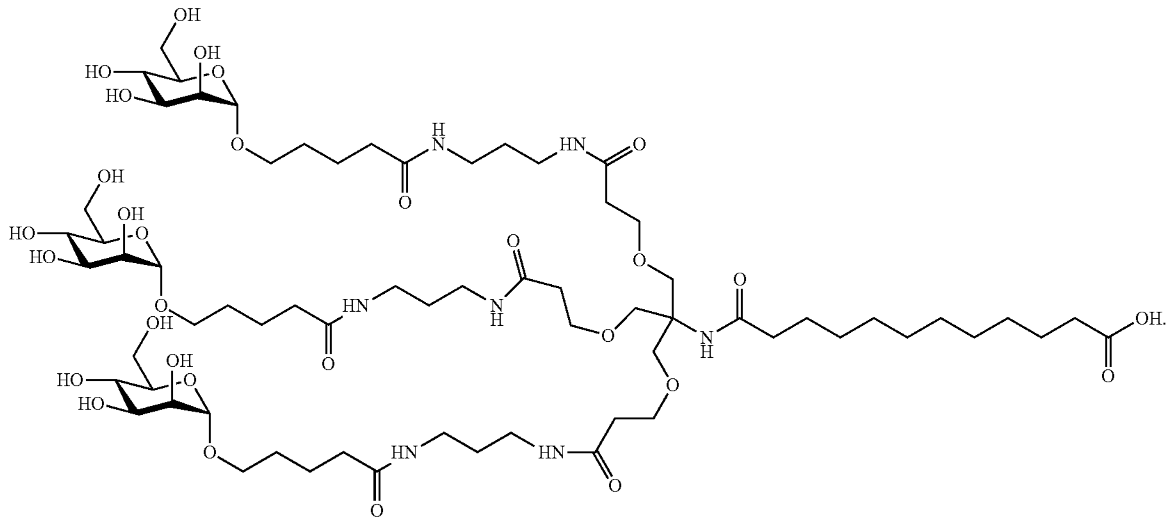

In some embodiments, a provided acid is

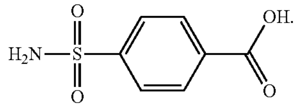 [SMILES: NS(=O)(=O)c1ccc(C(=O)O)cc1]

In some embodiments, a provided acid is

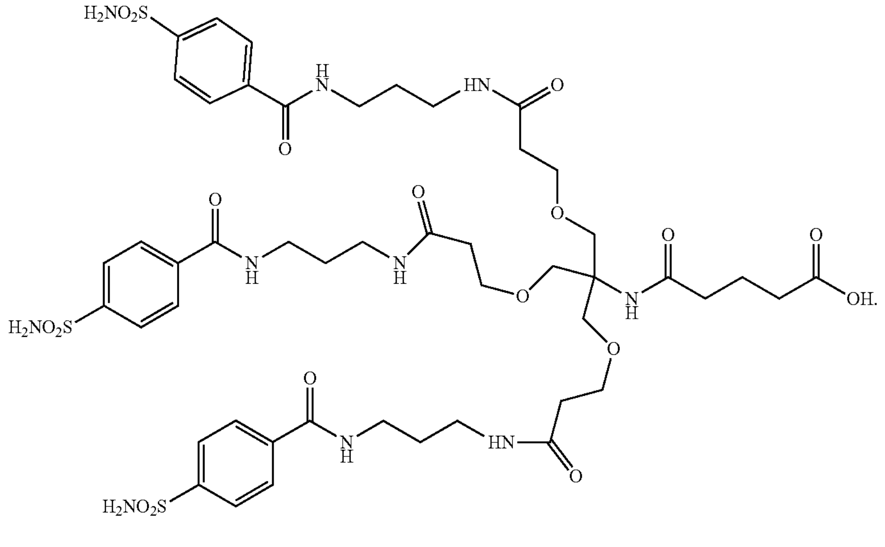 [SMILES: NS(=O)(=O)c1ccc(C(=O)NCCCNC(=O)CCOCC(COCCC(=O)NCCCNC(=O)c2ccc(S(N)(=O)=O)cc2)(COCCC(=O)NCCCNC(=O)c2ccc(S(N)(=O)=O)cc2)NC(=O)CCCC(=O)O)cc1]

In some embodiments, a provided acid is a fatty acid, which can provide a lipid moiety as a targeting moiety. In some embodiments, the present disclosure provides methods and reagents for preparing such acids.

In some embodiments, an additional chemical moiety, e.g., one comprising a guanidine moiety, may be incorporated into an oligonucleotide to improve one or more properties and/or activities. In some embodiments, such an additional chemical moiety is useful for improving delivery. In some embodiments, an additional chemical moiety comprises one or more group having the structure of formula I-n-1, I-n-2, I-n-3, I-n-4, II, II-a-1, II-a-2, II-b-1, II-b-2, II-c-1, II-c-2, II-d-1, or II-d-2 as described herein. In some embodiments, an additional chemical moiety comprises one or more group having the structure of formula I-n-1, I-n-2, I-n-3, I-n-4, II-a-1, II-a-2, II-b-1, II-b-2, II-c-1, II-c-2, II-d-1, or II-d-2 as described herein. In some embodiments, such a chemical moiety has the structure of formula $R^1$-[-L-$L^P$]n-, wherein each $L^P$ independently has the structure of formula I-n-1, I-n-2, I-n-3, I-n-4, II, II-a-1, II-a-2, II-b-1, II-b-2, II-c-1, II-c-2, II-d-1, or II-d-2 as described herein, and each other variable is independently as described herein. In some embodiments, $R^1$ is —OH. In some embodiments, $R^1$ is —H. In some embodiments, each L is independently optionally substituted bivalent $C_{1-10}$ aliphatic. In some embodiments, each L is independently —$(CH_2)_3$— alkylene. In some embodiments, each L is independently $C_{1-6}$ alkylene. In some embodiments, each $L^P$ is independently n001

(
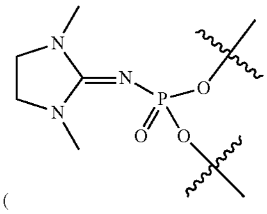
).

In some embodiments, an additional chemical moiety is

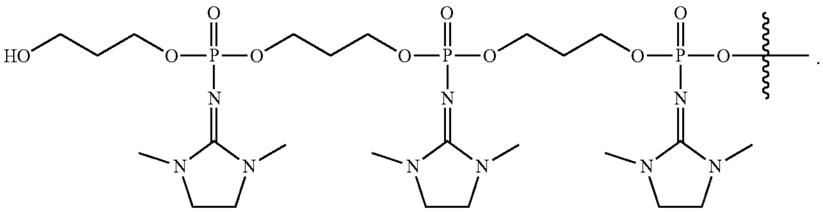 [SMILES: *OP(=O)(N=C1N(C)CCN1C)OCCCOP(=O)(N=C1N(C)CCN1C)OCCCOP(=O)(N=C1N(C)CCN1C)OCCCO]

In some embodiments, an additional chemical moiety is bonded to 5'-end carbon of an oligonucleotide chain. In some embodiments, it may be incorporated, e.g., using reagents including those illustrated below:

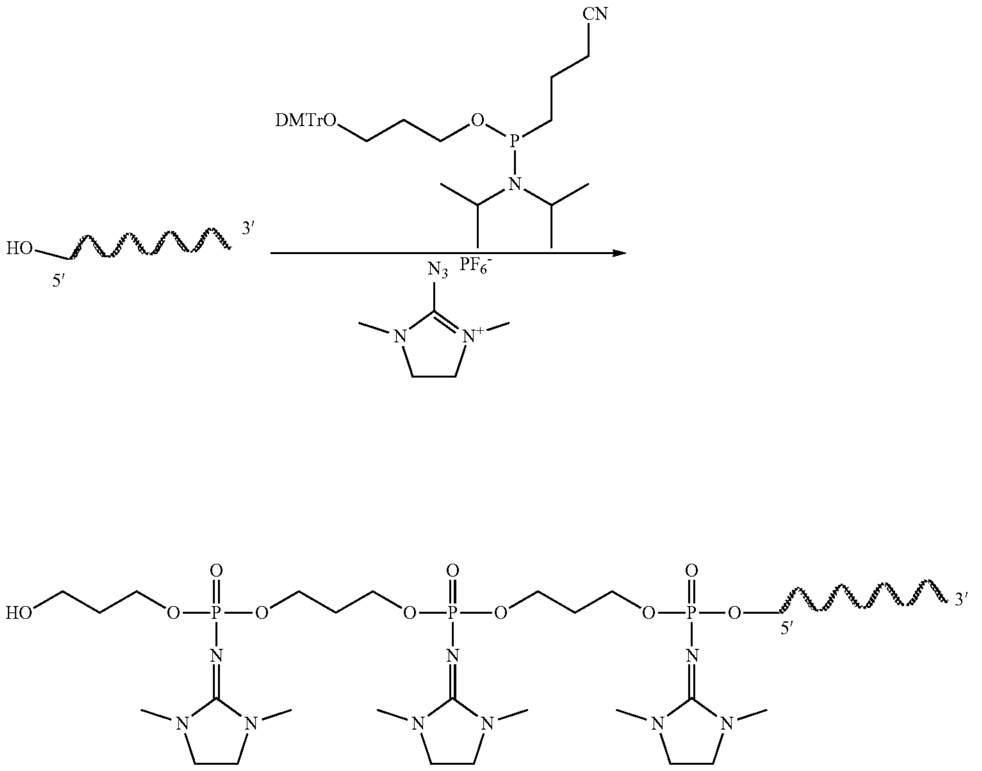

In some embodiments, an additional chemical moiety may be linked to an oligonucleotide chain through a cleavable group, e.g., a phosphate group, to an oligonucleotide chain (e.g., at the 5'-end carbon):

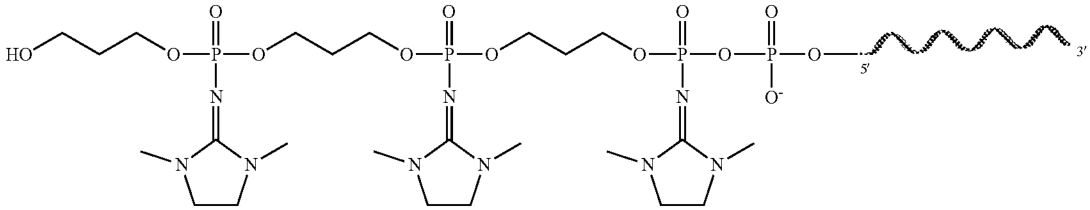 [SMILES: COP(=O)([O-])OP(=O)(N=C1N(C)CCN1C)OCCCOP(=O)(N=C1N(C)CCN1C)OCCCOP(=O)(N=C1N(C)CCN1C)OCCCO]
In some embodiments, L is a sugar moiety as described herein. For example, in some embodiments, L is
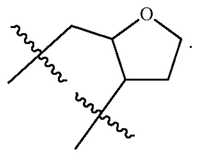 [SMILES: *CC1OCCC1*]
In some embodiments, an additional chemical moiety is
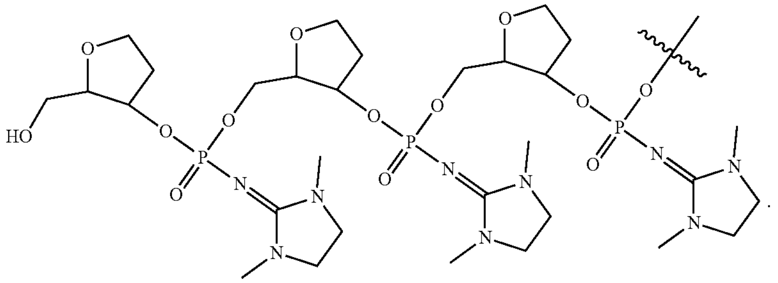 [SMILES: *OP(=O)(N=C1N(C)CCN1C)OC1CCOC1COP(=O)(N=C1N(C)CCN1C)OC1CCOC1COP(=O)(N=C1N(C)CCN1C)OC1CCOC1CO]
In some embodiments, it is bonded to 5'-end carbon of an oligonucleotide chain. In some embodiments, it may be incorporated, e.g., using reagents including those illustrated below:
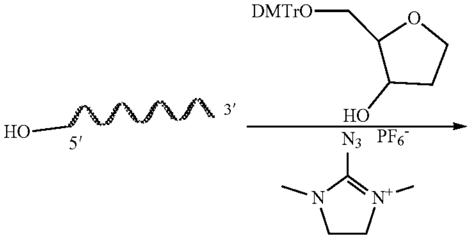
-continued
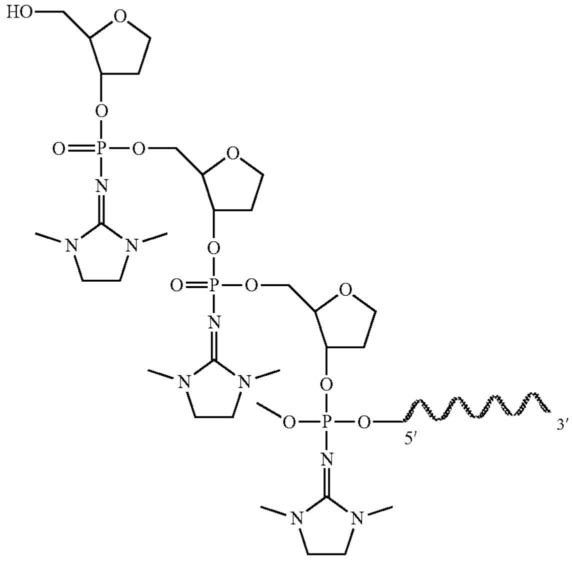

In some embodiments, additional chemical moieties described herein may comprise one or more alkyl chain. In some embodiments, additional chemical moieties described herein may comprise one or more lipid moieties. Those skilled in the art appreciates that many other embodiments of $L^P$, including neutral internucleotidic linkage moieties, may be utilized in additional chemical moieties, e.g., n009. In some embodiments, an additional chemical moiety is

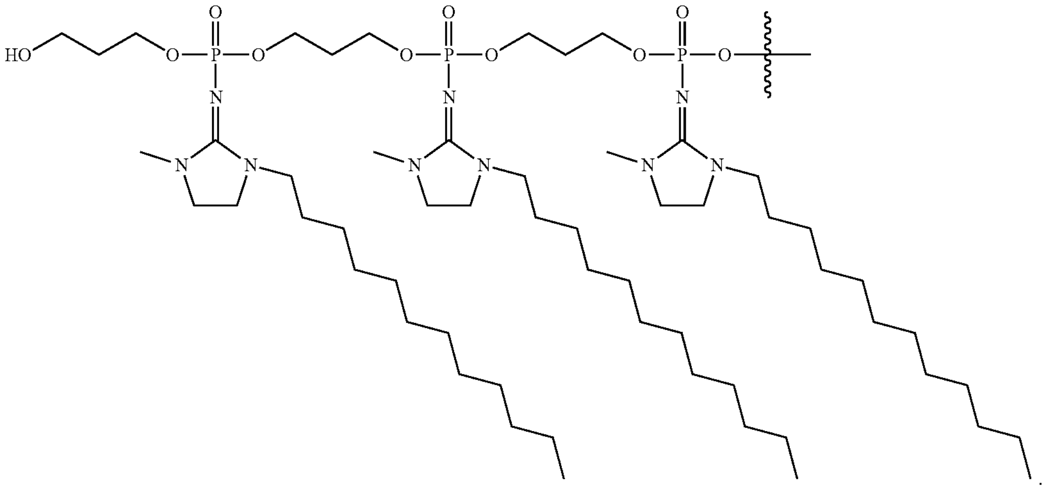 [SMILES: *OP(=O)(N=C1N(C)CCN1CCCCCCCCCCCC)OCCCOP(=O)(N=C1N(C)CCN1CCCCCCCCCCCC)OCCCOP(=O)(N=C1N(C)CCN1CCCCCCCCCCCC)OCCCO]

In some embodiments, an additional chemical moiety is

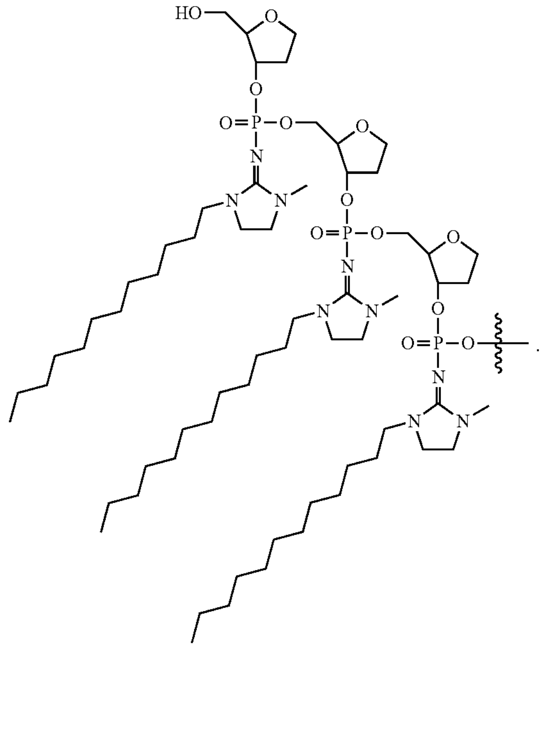 [SMILES: *OP(=O)(N=C1N(C)CCN1CCCCCCCCCCCC)OC1CCOC1COP(=O)(N=C1N(C)CCN1CCCCCCCCCCCC)OC1CCOC1COP(=O)(N=C1N(C)CCN1CCCCCCCCCCCC)OC1CCOC1CO]

As described herein, in some embodiments, an additional chemical moiety may be bonded to the 5'-end carbon of an oligonucleotide chain. In some embodiments, an additional chemical moiety may be incorporated, e.g., using reagents including those illustrated below:

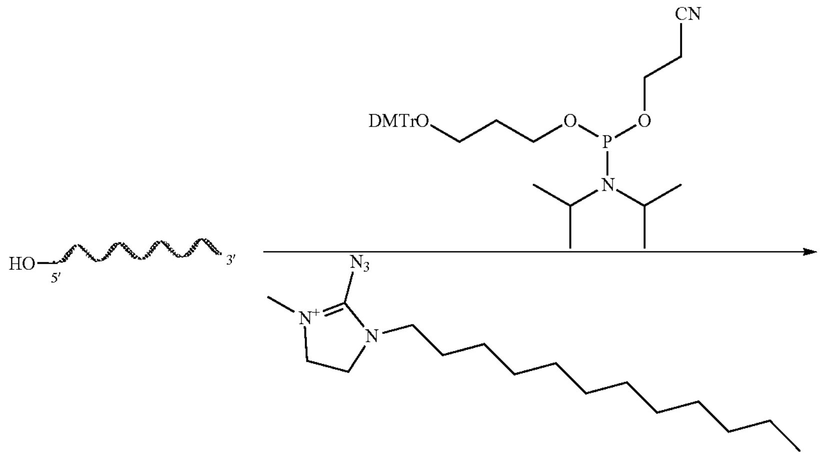
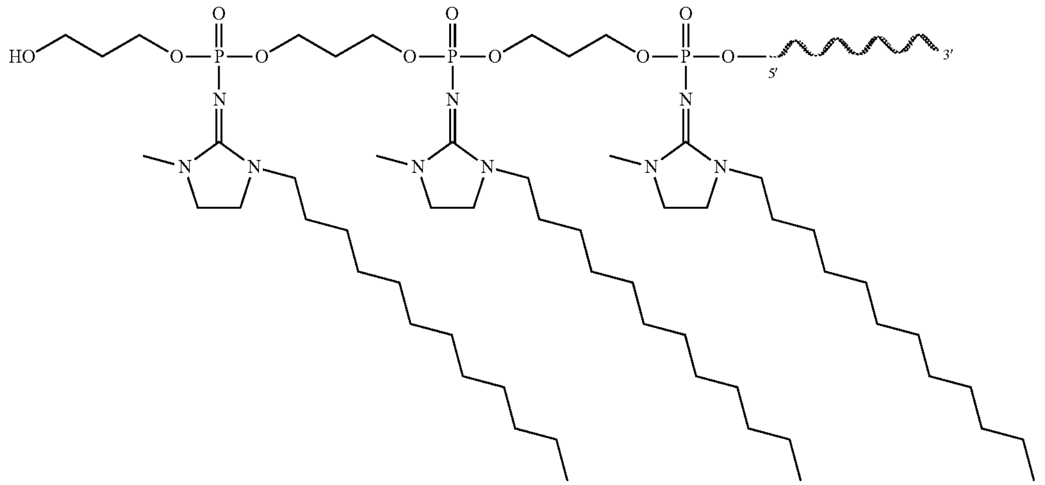
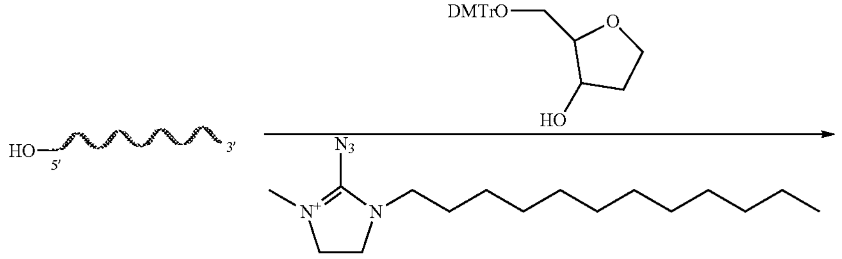

-continued

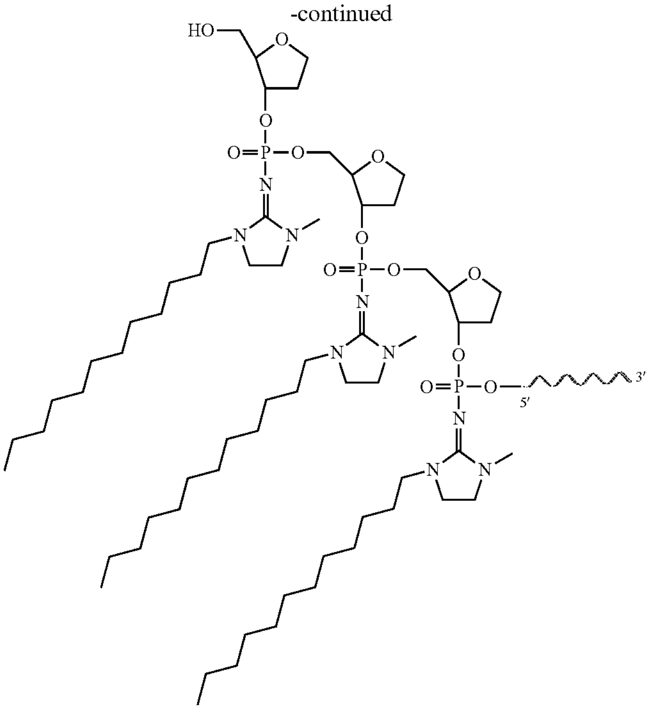

Those skilled in the art will appreciate that many other technologies, including synthetic chemical technologies, can be utilized in accordance with the present disclosure to provide compounds, e.g., oligonucleotides, reagents for incorporating additional chemical moieties, etc.

In some embodiments, provided compounds, e.g., reagents, products (e.g., oligonucleotides, amidites, etc.) etc. are at least 10%, 20%, 30%, 40%, 50%, 60%, 70%, 75%, 80%, 81%, 82%, 83%, 84%, 85%, 86%, 87%, 88%, 89%, 90%, 91%, 92%, 93%, 94%, 95%, 96%, 97%, 97% or 99% pure. In some embodiments, the purity is at least 50%. In some embodiments, the purity is at least 75%. In some embodiments, the purity is at least 80%. In some embodiments, the purity is at least 85%. In some embodiments, the purity is at least 90%. In some embodiments, the purity is at least 95%. In some embodiments, the purity is at least 96%. In some embodiments, the purity is at least 97%. In some embodiments, the purity is at least 98%. In some embodiments, the purity is at least 99%.

Combination Therapy

In some embodiments, a subject is administered an additional treatment (including, but not limited to, a therapeutic agent or method) in additional to provided oligonucleotide or oligonucleotide composition, e.g., a composition comprising a DMD oligonucleotide. In some embodiments, a composition comprising a DMD oligonucleotide(s) (or two or more compositions, each comprising a DMD oligonucleotide) is administered to a patient along with an additional treatment.

In some embodiments, the present disclosure pertains to a method for treating muscular dystrophy, Duchenne (Duchenne's) muscular dystrophy (DMD), or Becker (Becker's) muscular dystrophy (BMD), comprising (a) administering to a subject susceptible thereto or suffering therefrom a composition comprising a provided oligonucleotide, and (b) administering to the subject an additional treatment which is capable of preventing, treating, ameliorating or slowing the progress of muscular dystrophy. In some embodiments, an additional treatment is a composition comprising a second oligonucleotide.

In some embodiments, an additional treatment is capable of preventing, treating, ameliorating or slowing the progress of muscular dystrophy by itself. In some embodiments, an additional treatment is capable of preventing, treating, ameliorating or slowing the progress of muscular dystrophy when administered with a provided oligonucleotide.

In some embodiments, an additional treatment is administered to the subject prior to, after or simultaneously with a composition comprising a provided oligonucleotide, e.g., a provided DMD oligonucleotide. In some embodiments, a composition comprises both a DMD oligonucleotide(s) and an additional treatment. In some embodiments, a DMD oligonucleotide(s) and an additional treatment(s) are in separate compositions. In some embodiments, the present disclosure provides technologies (e.g., compositions, methods, etc.) for combination therapy, for example, with other therapeutic agents and/or medical procedures. In some embodiments, provided oligonucleotides and/or compositions may be used together with one or more other therapeutic agents. In some embodiments, provided compositions comprise provided oligonucleotides, and one or more other therapeutic agents. In some embodiments, the one or more other therapeutic agents may have one or more different targets, and/or one or more different mechanisms toward targets, when compared to provided oligonucleotides in the composition. In some embodiments, a therapeutic agent is an oligonucleotide. In some embodiments, a therapeutic agent is a small molecule drug. In some embodiments, a therapeutic agent is a protein. In some embodiments, a therapeutic agent is an antibody. A number of therapeutic agents may be utilized in accordance with the present disclosure. For example, oligonucleotides for DMD may be used together with one or more therapeutic agents that modulate utrophin production (utrophin modulators). In some embodiments, a utrophin modulator promotes production of utrophin. In some embodiments, a utrophin modulator is ezutromid. In some embodiments, a utrophin modulator is

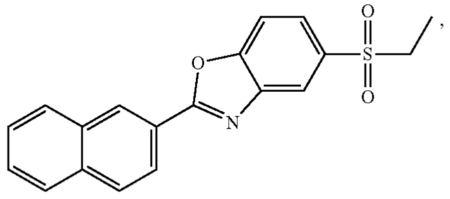 [SMILES: CCS(=O)(=O)c1ccc2oc(-c3ccc4ccccc4c3)nc2c1]

or a pharmaceutically acceptable salt thereof. In some embodiments, provided oligonucleotides or compositions thereof are administered prior to, concurrently with, or subsequent to one or more other therapeutic agents and/or medical procedures. In some embodiments, provided oligonucleotides or compositions thereof are administered concurrently with one or more other therapeutic agents and/or medical procedures. In some embodiments, provided oligonucleotides or compositions thereof are administered prior to one or more other therapeutic agents and/or medical procedures. In some embodiments, provided oligonucleotides or compositions thereof are administered subsequent to one or more other therapeutic agents and/or medical procedures. In some embodiments, provide compositions comprise one or more other therapeutic agents.

In some embodiments, a composition comprising a DMD oligonucleotide is co-administered with an additional agent in order to improve skipping of a DMD exon of interest. In some embodiments, an additional agent is an antibody, oligonucleotide, protein or small molecule. In some embodiments, an additional agent interferes with a protein involved in splicing. In some embodiments, an additional agent interferes with a protein involved in splicing, wherein the protein is a SR protein.

In some embodiments, an additional agent interferes with a protein involved in splicing, wherein the protein is a SR protein, which contains a protein domain with one or more long repeats of serine (S) and arginine (R) amino acid residues. SR proteins are reportedly heavily phosphorylated in cells and are involved in constitutive and alternative splicing. Long et al. 2009 Biochem. J. 417: 15-27; Shepard et al. 2009 Genome Biol. 10: 242. In some embodiments, an additional agent is a chemical compound that inhibits or decreases a SR protein kinase. In some embodiments, a chemical compound that inhibits or decreases a SR protein kinase is SRPIN340. SRPIN340 is reported in, for example, Fukuhura et al. 2006 Proc. Natl. Acad. Sci. USA 103: 11329-11333. In some embodiments, a chemical compound is a kinase inhibitor specific for Cdc-like kinases (Clks) that are also able to phosphorylate SR proteins. In some embodiments, a kinase inhibitor specific for Cdc-like kinases (Clks) that are also able to phosphorylate SR proteins is TG003. TG003 reportedly affected splicing both in vitro and in vivo. Nowak et al. 2010 J. Biol. Chem. 285: 5532-5540; Muraki et al. 2004 J. Biol. Chem. 279: 24246-24254; Yomoda et al. 2008 Genes Cells 13: 233-244; and Nishida et al. 2011 Nat Commun. 2: 308.

In some embodiments, in a patient afflicted with muscular dystrophy, muscle tissue is replaced by fat and connective tissue, and affected muscles may look larger due to increased fat content, a condition known as pseudohypertrophy. In some embodiments, a composition comprising a DMD oligonucleotide(s) is administered along with a treatment which reduces or prevents development of fat or fibrous or connective tissue, or replacement of muscle tissue by fat or fibrous or connective tissue.

In some embodiments, a composition comprising a DMD oligonucleotide(s) is administered along with a treatment which reduces or prevents development of fat or fibrous or connective tissue, or replacement of muscle tissue by fat or fibrous or connective tissue, wherein the treatment is an antibody to connective tissue growth factor (CTGF), a central mediator of fibrosis (e.g., FG-3019). In some embodiments, a composition comprising a DMD oligonucleotide(s) is administered along with an agent which reduces the fat content of the human body.

Additional treatments incude: slowing the progression of the disease by immune modulators (eg, steroids and transforming growth factor -beta inhibitors), inducing or introducing proteins that may compensate for dystrophin deficiency in the myofiber (eg, utrophin, biglycan, and laminin), or bolstering the muscle's regenerative response (eg, myostatin and activin 2B).

In some embodiments, an additional treatment is a small molecule capable of restoring normal balance of calcium within muscle cells.

In some embodiments, an additional treatment is a small molecule capable of restoring normal balance of calcium within muscle cells by correcting the activity of a type of channel called the ryanodine receptor calcium channel complex (RyR). In some embodiments, such a small molecule is Rycal ARM210 (ARMGO Pharma, Tarry Town, NY).

In some embodiments, an additional treatment is a flavonoid.

In some embodiments, an additional treatment is a flavonoid such as Epicatechin. Epicatechin is a flavonoid found in dark chocolate harvested from the cacao tree which has been reported in animals and humans to increase the production of new mitochondria in heart and muscle (e.g., mitochondrial biogenesis) while concurrently stimulating the regeneration of muscle tissue.

In some embodiments, an additional treatment is follistatin gene therapy.

In some embodiments, an additional treatment is adeno-associated virus delivery of follistatin 344 to increase muscle strength and prevent muscle wasting and fibrosis.

In some embodiments, an additional treatment is glucocorticoid.

In some embodiments, an additional treatment is prednisone.

In some embodiments, an additional treatment is deflazacort.

In some embodiments, an additional treatment is vamorolone (VBP15).

In some embodiments, an additional treatment is delivery of an exogenous Dystrophin gene or synthetic version or portion thereof, such as a microdystrophin gene.

In some embodiments, an additional treatment is delivery of an exogenous Dystrophin gene or portion thereof, such as a microdystrophin gene, such as SGT-001, an adeno-associated viral (AAV) vector -mediated gene transfer system for delivery of a synthetic dystrophin gene or microdystrophin (Solid BioSciences, Cambridge, Mass.).

In some embodiments, an additional treatment is stem cell treatment.

In some embodiments, an additional treatment is a steroid.

In some embodiments, an additional treatment is a corticosteroid.

In some embodiments, an additional treatment is prednisone.

In some embodiments, an additional treatment is a beta-2 agonist.

In some embodiments, an additional treatment is an ion channel inhibitor.

In some embodiments, an additional treatment is a calcium channel inhibitor which is a xanthin. In some embodiments, an additional treatment is a calcium channel inhibitor which is methylxanthine. In some embodiments, an additional treatment is a calcium channel inhibitor which is pentoxifylline. In some embodiments, an additional treatment is a calcium channel inhibitor which is a methylxanthine derivative selected from: pentoxifylline, furafylline, lisofylline, propentofylline, pentifylline, theophylline, torbafylline, albifylline, enprofylline and derivatives thereof.

In some embodiments, an additional treatment is a treatment for heart disease or cardiovascular disease.

In some embodiments, an additional treatment is a calcium channel inhibitor.

In some embodiments, an additional treatment is a blood pressure medicine.

In some embodiments, an additional treatment is surgery.

In some embodiments, an additional treatment is surgery to fix shortened muscles, straighten the spine, or treat a heart or lung problem.

In some embodiments, an additional treatment is a brace, walker, standing walker, or other mechanical aid for walking.

In some embodiments, an additional treatment is exercise and/or physical therapy.

In some embodiments, an additional treatment is assisted ventilation.

In some embodiments, an additional treatment is anticonvulsant, immunosuppressant or treatment for constipation.

In some embodiments, an additional treatment is an inhibitor of NF-κB.

In some embodiments, an additional treatment comprises salicylic acid and/or docosahexaenoic acid (DHA).

In some embodiments, an additional treatment is edasalonexent (CAT-1004, Catabasis), a conjugate of salicylic acid and docosahexaenoic acid (DHA).

In some embodiments, an additional treatment is a cell-based therapeutic.

In some embodiments, an additional treatment is comprises allogeneic cardiosphere-derived cells.

In some embodiments, an additional treatment is CAP-1002 (Capricor).

Certain Embodiments of Variables

Embodiments of variables are extensive described in the present disclosure. Those skilled in the art appreciate that an embodiment described for one variable may be optionally and independently combined with embodiments for other variables, and such combinations, wherever and whenever appropriate, are within the scope of the present disclosure. Embodiments of a variable (e.g. R) given when describing one variable that can be such variable (e.g., $R^1$, which can be R) are generally applicable to other variables that can be the same variable (e.g., $R^s$, which can be R). Various embodiments of many variables are also described in other sections of the present disclosure.

In some embodiments, $P^L$ is P(=W). In some embodiments, $P^L$ is P. In some embodiments, $P^L$ is a chiral P(P*). In some embodiments, $P^L$ is P→B(R')$_3$.

In some embodiments, W is O. In some embodiments, W is S. In some embodiments, W is Se. In some embodiments, W is —N(-L-$R^5$).

In some embodiments, X is O. In some embodiments, X is S. In some embodiments, X is —N(-L-$R^5$)—. In some embodiments, -L-$R^5$ is —R, which is taken together with a R group of -L-$R^1$ (e.g., a —C(R')— in L) to form a double bond or a ring as described in the present disclosure. In some embodiments, X is L.

In some embodiments, Y is O. In some embodiments, Y is S. In some embodiments, Z is O. In some embodiments, Z is S. In some embodiments, Y is O and Z is O.

In some embodiments, W is O, Y is O and Z is O. In some embodiments, W is S, Y is O and Z is O.

In some embodiments, $R^1$ is —H. In some embodiments, $R^1$ is -L-R. In some embodiments, $R^1$ is halogen. In some embodiments, $R^1$ is —CN. In some embodiments, $R^1$ is —$NO_2$. In some embodiments, $R^1$ is -L-Si(R)$_3$. In some embodiments, $R^1$ is —OR. In some embodiments, $R^1$ is —SR. In some embodiments, $R^1$ is —N(R)$_2$.

In some embodiments, $R^1$ is R as described in the present disclosure.

In some embodiments, —X-L-$R^1$ comprises or is an optionally substituted moiety of a chiral auxiliary (e.g., H—X-L-$R^1$ is an optionally substituted (e.g., capped) chiral auxiliary), e.g., as used in chirally controlled oligonucleotide synthesis, such as those described in US20150211006, US 20150211006, WO 2017015555, WO 2017015575, WO 2017062862, or WO 2017160741, chiral auxiliaries of each of which are incorporated herein by reference.

In some embodiments, —X-L-$R^1$ is —OR. In some embodiments, —X-L-$R^1$ is —OH. In some embodiments, —X-L-$R^1$ is —SR. In some embodiments, —X-L-$R^1$ is —SH.

In some embodiments, —X-L-$R^1$ is —R. In some embodiments, R is —$CH_3$. In some embodiments, R is —$CH_2CH_3$. In some embodiments, R is —$CH_2CH_2CH_3$. In some embodiments, R is —$CH_2OCH_3$. In some embodiments, R is $CH_3CH_2OCH_2$—. In some embodiments, R is $PhCH_2OCH_2$—. In some embodiments, R is HC≡C—$CH_2$—. In some embodiments, R is $H_3C$—C≡C—$CH_2$—. In some embodiments, R is $CH_2$=$CHCH_2$—. In some embodiments, R is $CH_3SCH_2$—. In some embodiments, R is —$CH_2COOCH_3$. In some embodiments, R is —$CH_2COOCH_2CH_3$. In some embodiments, R is —$CH_2CONHCH_3$.

In some embodiments, —X-L-$R^1$ is comprises a guanidine moiety. In some embodiments, —X-L-$R^1$ is or comprises

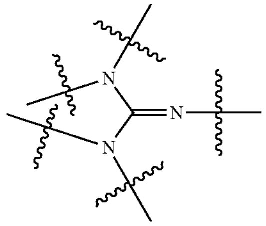

.

In some embodiments, —X-L-$R^1$ is -L-$W^z$, wherein $W^z$ is selected from

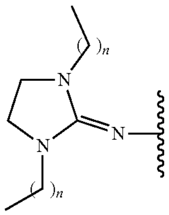
,
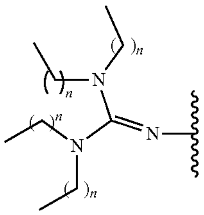
,
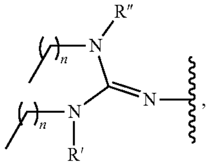
,
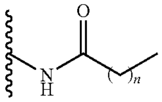
,
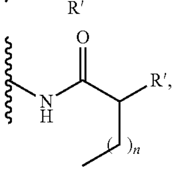
,
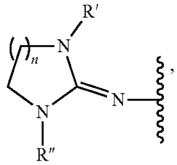
,
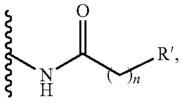
,
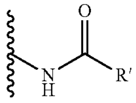
, and
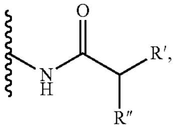
, wherein R" is R' and n is 0-15. In some embodiments, R' and R" are independently

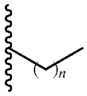
,
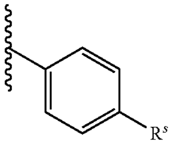
,
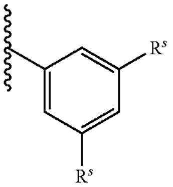
,
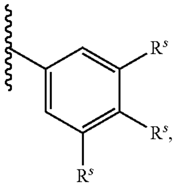
, or
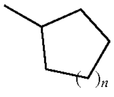
.

In some embodiments, L is —O—$CH_2CH_2$—. In some embodiments, n is 0-3. In some embodiments, each $R^s$ is independently —H, —$OCH_3$, —F, —CN, —$CH_3$, —$NO_2$, —$CF_3$, or —$OCF_3$. In some embodiments, R' and R" are the same. In some embodiments, R' and R" are different.

In some embodiments, In some embodiments, —X-L-$R^1$ is

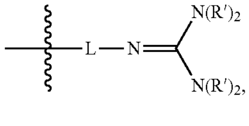

wherein each R' is independently as described in the present disclosure. In some embodiments, two R' on two different nitrogen atoms are taken together to form an optionally substituted ring as described in the present disclosure. In some embodiments, a ring is saturated. In some embodiments, a ring is monocyclic. In some embodiments, a ring is 3-10 membered. In some embodiments, a ring is 3-membered. In some embodiments, a ring is 4-membered. In some embodiments, a ring is 5-membered. In some embodiments, a ring is 6-membered. In some embodiments, a ring is 7-membered. In some embodiments, a ring has no additional ring heteroatoms in addition to the two nitrogen atoms.

In some embodiments, $R^5$ is $R^1$ as described in the present disclosure. In some embodiments, $R^5$ is —H. In some embodiments, $R^5$ is R as described in the present disclosure.

In some embodiments, L is a bivalent optionally substituted methylene group. In some embodiments, L is —$CH_2$—. In some embodiments, each L is independently a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus and silicon, wherein one or more methylene units are optionally and independently replaced by an optionally substituted group selected from $C_{1-6}$ alkylene, $C_{1-6}$ alkenylene, —C≡C—, a bivalent $C_1$-$C_6$ heteroaliphatic group having 1-5 heteroatoms independently selected from oxygen, nitrogen, sulfur, phosphorus and silicon, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with $Cy^L$.

In some embodiments, L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus and silicon, wherein one or more methylene units are optionally and independently replaced by an optionally substituted group selected from $C_{1-6}$ alkylene, $C_{1-6}$ alkenylene, —C≡C—, a bivalent $C_1$-$C_6$ heteroaliphatic group having 1-5 heteroatoms independently selected from oxygen, nitrogen, sulfur, phosphorus and silicon, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with $Cy^L$. In some embodiments, L is a covalent bond, or a bivalent, optionally substituted, linear or branched $C_{1-30}$ aliphatic group, wherein one or more methylene units are optionally and independently replaced by an optionally substituted group selected from $C_{1-6}$ alkylene, $C_{1-6}$ alkenylene, —C≡C—, a bivalent $C_1$-$C_6$ heteroaliphatic group having 1-5 heteroatoms independently selected from oxygen, nitrogen, sulfur, phosphorus and silicon, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with Cy$^L$. In some embodiments, L is a covalent bond, or a bivalent, optionally substituted, linear or branched $C_{1-30}$ heteroaliphatic group having 1-10 heteroatoms independently selected from oxygen, nitrogen, sulfur, phosphorus and silicon, wherein one or more methylene units are optionally and independently replaced by an optionally substituted group selected from $C_{1-6}$ alkylene, $C_{1-6}$ alkenylene, —C≡C—, a bivalent $C_1$-$C_6$ heteroaliphatic group having 1-5 heteroatoms independently selected from oxygen, nitrogen, sulfur, phosphorus and silicon, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with Cy$^L$. In some embodiments, L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus and silicon, wherein one or more methylene units are optionally and independently replaced by an optionally substituted group selected from $C_{1-6}$ alkylene, $C_{1-6}$ alkenylene, —C≡C—, a bivalent $C_1$-$C_6$ heteroaliphatic group having 1-5 heteroatoms independently selected from oxygen, nitrogen, sulfur, phosphorus and silicon, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, or —C(O)O—, and one or more CH or carbon atoms are optionally and independently replaced with Cy$^L$. In some embodiments, L is a covalent bond, or a bivalent, optionally substituted, linear or branched group selected from a $C_{1-10}$ aliphatic group and a $C_{1-10}$ heteroaliphatic group having 1-5 heteroatoms independently selected from oxygen, nitrogen, sulfur, phosphorus and silicon, wherein one or more methylene units are optionally and independently replaced by an optionally substituted group selected from $C_{1-6}$ alkylene, $C_{1-6}$ alkenylene, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, and —C(O)O—, and one or more CH or carbon atoms are optionally and independently replaced with Cy$^L$. In some embodiments, L is a covalent bond, or a bivalent, optionally substituted, linear or branched group selected from a $C_{1-10}$ aliphatic group and a $C_{1-10}$ heteroaliphatic group having 1-5 heteroatoms independently selected from oxygen, nitrogen, sulfur, phosphorus and silicon, wherein one or more methylene units are optionally and independently replaced by an optionally substituted group selected from —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, and —C(O)O—.

In some embodiments, L is a covalent bond. In some embodiments, L is optionally substituted bivalent $C_{1-30}$ aliphatic. In some embodiments, L is optionally substituted bivalent $C_{1-30}$ heteroaliphatic having 1-10 heteroatoms independently selected from boron, oxygen, nitrogen, sulfur, phosphorus and silicon.

In some embodiments, aliphatic moieties, e.g. those of L, $L^s$, $L^M$, R, etc., either monovalent or bivalent or multivalent, and can contain any number of carbon atoms (before any optional substitution) within its range, e.g., $C_1$, $C_2$, $C_3$, $C_4$, $C_5$, $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{21}$, $C_{22}$, $C_{23}$, $C_{24}$, $C_{25}$, $C_{26}$, $C_{27}$, $C_{28}$, $C_{29}$, $C_{30}$, etc. In some embodiments, heteroaliphatic moieties, e.g. those of L, R, etc., either monovalent or bivalent or multivalent, and can contain any number of carbon atoms (before any optional substitution) within its range, e.g., $C_1$, $C_2$, $C_3$, $C_4$, $C_5$, $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{21}$, $C_{22}$, $C_{23}$, $C_{24}$, $C_{25}$, $C_{26}$, $C_{27}$, $C_{28}$, $C_{29}$, $C_{30}$, etc.

In some embodiments, a methylene unit of a linker, e.g., L, $L^s$, $L^M$, etc., is replaced with —Cy—, wherein —Cy— is as described in the present disclosure. In some embodiments, one or more methylene unit is optionally and independently substituted with —O—, —S—, —N(R')—, —C(O)—, —S(O)—, —S(O)$_2$—, —P(O)(OR')—, —P(O)(SR')—, —P(S)(OR')—, or —P(S)(OR')—. In some embodiments, a methylene unit is replaced with —O—. In some embodiments, a methylene unit is replaced with —S—. In some embodiments, a methylene unit is replaced with —N(R')—. In some embodiments, a methylene unit is replaced with —C(O)—. In some embodiments, a methylene unit is replaced with —S(O)—. In some embodiments, a methylene unit is replaced with —S(O)$_2$—. In some embodiments, a methylene unit is replaced with —P(O)(OR')—. In some embodiments, a methylene unit is replaced with —P(O)(SR')—. In some embodiments, a methylene unit is replaced with —P(O)(R')—. In some embodiments, a methylene unit is replaced with —P(O)(NR')—. In some embodiments, a methylene unit is replaced with —P(S)(OR')—. In some embodiments, a methylene unit is replaced with —P(S)(SR')—. In some embodiments, a methylene unit is replaced with —P(S)(R')—. In some embodiments, a methylene unit is replaced with —P(S)(NR')—. In some embodiments, a methylene unit is replaced with —P(R')—. In some embodiments, a methylene unit is replaced with —P(OR')—. In some embodiments, a methylene unit is replaced with —P(SR')—. In some embodiments, a methylene unit is replaced with —P(NR')—. In some embodiments, a methylene unit is replaced with —P(OR')[B(R')$_3$]—. In some embodiments, one or more methylene unit is optionally and independently substituted with —O—, —S—, —N(R')—, —C(O)—, —S(O)—, —S(O)$_2$—, —P(O)(OR')—, —P(O)(SR')—, —P(S)(OR')—, or —P(S)(OR')—. In some embodiments, a methylene unit is replaced with —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, each of which may independently be an internucleotidic linkage.

In some embodiments, L or $L^s$ (e.g., when $L^s$ is L), e.g., when connected to $R^s$ or a sugar ring, is $—CH_2—$. In some embodiments, L is $—C(R)_2—$, wherein at least one R is not hydrogen. In some embodiments, L is —CHR—. In some embodiments, R is hydrogen. In some embodiments, L is —CHR—, wherein R is not hydrogen. In some embodiments, C of —CHR— is chiral. In some embodiments, L is —(R)—CHR—, wherein C of —CHR— is chiral. In some embodiments, L is —(S)—CHR—, wherein C of —CHR— is chiral. In some embodiments, R is optionally substituted $C_{1-6}$ aliphatic. In some embodiments, R is optionally substituted $C_{1-6}$ alkyl. In some embodiments, R is optionally substituted $C_{1-5}$ aliphatic. In some embodiments, R is optionally substituted $C_{1-5}$ alkyl. In some embodiments, R is optionally substituted $C_{1-4}$ aliphatic. In some embodiments, R is optionally substituted $C_{1-4}$ alkyl. In some embodiments, R is optionally substituted $C_{1-3}$ aliphatic. In some embodiments, R is optionally substituted $C_{1-3}$ alkyl. In some embodiments, R is optionally substituted $C_2$ aliphatic. In some embodiments, R is optionally substituted methyl. In some embodiments, R is $C_{1-6}$ aliphatic. In some embodiments, R is $C_{1-6}$ alkyl. In some embodiments, R is $C_{1-5}$ aliphatic. In some embodiments, R is $C_{1-5}$ alkyl. In some embodiments, R is $C_{1-4}$ aliphatic. In some embodiments, R is $C_{1-4}$ alkyl. In some embodiments, R is $C_{1-3}$ aliphatic. In some embodiments, R is $C_{1-3}$ alkyl. In some embodiments, R is $C_2$ aliphatic. In some embodiments, R is methyl. In some embodiments, R is $C_{1-6}$ haloaliphatic. In some embodiments, R is $C_{1-6}$ haloalkyl. In some embodiments, R is $C_{1-5}$ haloaliphatic. In some embodiments, R is $C_{1-5}$ haloalkyl. In some embodiments, R is $C_{1-4}$ haloaliphatic. In some embodiments, R is $C_{1-4}$ haloalkyl. In some embodiments, R is $C_{1-3}$ haloaliphatic. In some embodiments, R is $C_{1-3}$ haloalkyl. In some embodiments, R is $C_2$ haloaliphatic. In some embodiments, R is methyl substituted with one or more halogen. In some embodiments, R is $—CF_3$. In some embodiments, L is optionally substituted —CH═CH—. In some embodiments, L is optionally substituted (E)-CH═CH—. In some embodiments, L is optionally substituted (Z)—CH═CH—. In some embodiments, L is —C≡C—.

In some embodiments, L comprises at least one phosphorus atom. In some embodiments, at least one methylene unit of L is replaced with —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, $—P(OR')[B(R')_3]—$, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or $—OP(OR')[B(R')_3]O—$.

In some embodiments, L is bonded to a phosphorus of an linkage (e.g., when X is a covalent bond), e.g., the phosphorus of a linkage having formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, such an linkage is an internucleotidic linkage. In some embodiments, such an linkage is a chirally controlled internucleotidic linkage.

In some embodiments, L is —Cy—. In some embodiments, L is —C≡C—.

In some embodiments, Lis a bivalent, optionally substituted, linear or branched $C_{1-30}$ aliphatic group wherein one or more methylene units are optionally and independently replaced as described in the present disclosure. In some embodiments, Lis a bivalent, optionally substituted, linear or branched $C_{1-30}$ heteroaliphatic group having 1-10 heteroatoms wherein one or more methylene units are optionally and independently replaced as described in the present disclosure.

In some embodiments, a heteroaliphatic group in the present disclosure, e.g., of L, R (including any variable that can be R), etc., comprises a

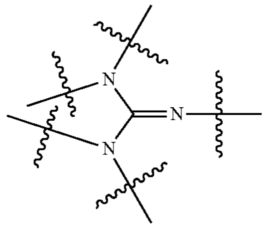 [SMILES: *N=C(N(*)*)N(*)*]

moiety. In some embodiments, ═N— is directly bonded to a phosphorus atom. In some embodiments, a heteroaliphatic group comprises a

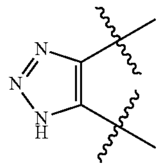 [SMILES: *c1nn[nH]c1*]

moiety. In some embodiments, a heteroaliphatic group comprises

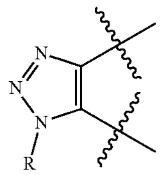

a moiety. In some embodiments, such a moiety is directly bonded to a phosphorus atom. In some embodiments, R is optionally substituted $C_{1-6}$ aliphatic. In some embodiments, R is optionally substituted $C_{1-6}$ alkyl. In some embodiments, R is isopropyl.

In some embodiments, —Cy— is optionally substituted bivalent monocyclic, bicyclic or polycyclic $C_{3-20}$ cycloaliphatic. In some embodiments, —Cy— is optionally substituted bivalent monocyclic, bicyclic or polycyclic $C_{6-20}$ aryl. In some embodiments, —Cy— is optionally substituted monocyclic, bicyclic or polycyclic 3-20 membered heterocyclyl ring having 1-5 heteroatoms. In some embodiments, —Cy— is optionally substituted monocyclic, bicyclic or polycyclic 5-20 membered heterocyclyl ring having 1-5 heteroatoms, wherein at least one heteroatom is oxygen. In some embodiments, —Cy— is 3-10 membered. In some embodiments, —Cy— is 3-membered. In some embodiments, —Cy— is 4-membered. In some embodiments, Cy- is 5-membered. In some embodiments, —Cy— is 6-membered. In some embodiments, Cy- is 7-membered. In some embodiments, —Cy— is 8-membered. In some embodiments, —Cy— is 9-membered. In some embodiments, —Cy— is 10-membered. In some embodiments, —Cy— is optionally substituted bivalent tetrahydrofuran ring. In some embodiments, —Cy— is an optionally substituted furanose moiety. In some embodiments, —Cy— is an optionally substituted bivalent 5-membered heteroaryl ring having 1-4 heteroatoms. In some embodiments, at least one heteroatom is nitrogen. In some embodiments, each heteroatom is nitrogen. In some embodiments, —Cy— is an optionally substituted bivalent triazole ring. In some embodiments, In some embodiments, —Cy— is optionally substituted

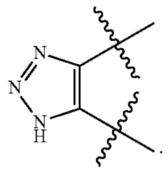 [SMILES: *c1nn[nH]c1*]

In some embodiments, —Cy— is

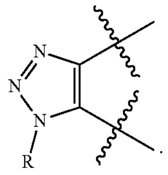

In some embodiments, R is optionally substituted $C_{1-6}$ aliphatic. In some embodiments, R is optionally substituted $C_{1-6}$ alkyl. In some embodiments, R is isopropyl.

In some embodiments, $Cy^L$ is an optionally substituted trivalent or tetravalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon. In some embodiments, $Cy^L$ is trivalent. In some embodiments, $Cy^L$ is tetravalent. In some embodiments, one or more CH in a moiety, e.g., L, $L^s$, $L^M$, etc. are independently substituted with a trivalent $Cy^L$ group. In some embodiments, one or more carbon atoms in a moiety, e.g., L, $L^s$, $L^M$, etc. are independently substituted with a tetravalent $Cy^L$ group. In some embodiments, one or more CH in a moiety, e.g., L, $L^s$, $L^M$, etc. are independently substituted with a trivalent $Cy^L$ group, and one or more carbon atoms in a moiety, e.g., L, $L^s$, $L^M$, etc. are independently substituted with a tetravalent $Cy^L$ group.

In some embodiments, $Cy^L$ is monocyclic. In some embodiments, $Cy^L$ is bicyclic. In some embodiments, $Cy^L$ is polycyclic.

In some embodiments, $Cy^L$ is saturated. In some embodiments, $Cy^L$ is partially unsaturated. In some embodiments, $Cy^L$ is aromatic. In some embodiments, $Cy^L$ is or comprises a saturated ring moiety. In some embodiments, $Cy^L$ is or comprises a partially unsaturated ring moiety. In some embodiments, $Cy^L$ is or comprises an aromatic ring moiety.

In some embodiments, $Cy^L$ is an optionally substituted $C_{3-20}$ cycloaliphatic ring as described in the present disclosure (for example, those described for R but tetravalent). In some embodiments, a ring is an optionally substituted saturated $C_{3-20}$ cycloaliphatic ring. In some embodiments, a ring is an optionally substituted partially unsaturated $C_{3-20}$ cycloaliphatic ring. A cycloaliphatic ring can be of various sizes as described in the present disclosure. In some embodiments, a ring is 3, 4, 5, 6, 7, 8, 9, or 10-membered. In some embodiments, a ring is 3-membered. In some embodiments, a ring is 4-membered. In some embodiments, a ring is 5-membered. In some embodiments, a ring is 6-membered. In some embodiments, a ring is 7-membered. In some embodiments, a ring is 8-membered. In some embodiments, a ring is 9-membered. In some embodiments, a ring is 10-membered. In some embodiments, a ring is an optionally substituted cyclopropyl moiety. In some embodiments, a ring is an optionally substituted cyclobutyl moiety. In some embodiments, a ring is an optionally substituted cyclopentyl moiety. In some embodiments, a ring is an optionally substituted cyclohexyl moiety. In some embodiments, a ring is an optionally substituted cycloheptyl moiety. In some embodiments, a ring is an optionally substituted cyclooctanyl moiety. In some embodiments, a cycloaliphatic ring is a cycloalkyl ring. In some embodiments, a cycloaliphatic ring is monocyclic. In some embodiments, a cycloaliphatic ring is bicyclic. In some embodiments, a cycloaliphatic ring is polycyclic. In some embodiments, a ring is a cycloaliphatic moiety as described in the present disclosure for R with more valences.

In some embodiments, $Cy^L$ is an optionally substituted 6-20 membered aryl ring. In some embodiments, a ring is an optionally substituted trivalent or tetravalent phenyl moiety. In some embodiments, a ring is a tetravalent phenyl moiety. In some embodiments, a ring is an optionally substituted naphthalene moiety. A ring can be of different size as described in the present disclosure. In some embodiments, an aryl ring is 6-membered. In some embodiments, an aryl ring is 10-membered. In some embodiments, an aryl ring is 14-membered. In some embodiments, an aryl ring is monocyclic. In some embodiments, an aryl ring is bicyclic. In some embodiments, an aryl ring is polycyclic. In some embodiments, a ring is an aryl moiety as described in the present disclosure for R with more valences.

In some embodiments, $Cy^L$ is an optionally substituted 5-20 membered heteroaryl ring having 1-10 heteroatoms, e.g., independently selected from oxygen, nitrogen, sulfur, phosphorus and silicon. In some embodiments, $Cy^L$ is an optionally substituted 5-20 membered heteroaryl ring having 1-10 heteroatoms, e.g., independently selected from oxygen, nitrogen, and sulfur. In some embodiments, $Cy^L$ is an optionally substituted 5-6 membered heteroaryl ring having 1-4 heteroatoms, e.g., independently selected from oxygen, nitrogen, and sulfur. In some embodiments, $Cy^L$ is an optionally substituted 5-membered heteroaryl ring having 1-4 heteroatoms, e.g., independently selected from oxygen, nitrogen, and sulfur. In some embodiments, $Cy^L$ is an optionally substituted 6-membered heteroaryl ring having 1-4 heteroatoms, e.g., independently selected from oxygen, nitrogen, and sulfur. In some embodiments, as described in the present disclosure, heteroaryl rings can be of various sizes and contain various numbers and/or types of heteroatoms. In some embodiments, a heteroaryl ring contains no more than one heteroatom. In some embodiments, a heteroaryl ring contains more than one heteroatom. In some embodiments, a heteroaryl ring contains no more than one type of heteroatom. In some embodiments, a heteroaryl ring contains more than one type of heteroatoms. In some embodiments, a heteroaryl ring is 5-membered. In some embodiments, a heteroaryl ring is 6-membered. In some embodiments, a heteroaryl ring is 8-membered. In some embodiments, a heteroaryl ring is 9-membered. In some embodiments, a heteroaryl ring is 10-membered. In some embodiments, a heteroaryl ring is monocyclic. In some embodiments, a heteroaryl ring is bicyclic. In some embodiments, a heteroaryl ring is polycyclic. In some embodiments, a heteroaryl ring is a nucleobase moiety, e.g., A, T, C, G, U, etc. In some embodiments, a ring is a heteroaryl moiety as described in the present disclosure for R with more valences. In some embodiments, as in linkers described in the present disclosure, $Cy^L$ is In some embodiments, $Cy^L$ is a 3-20 membered heterocyclyl ring having 1-10 heteroatoms independently selected from oxygen, nitrogen, sulfur, phosphorus and silicon. In some embodiments, $Cy^L$ is a 3-20 membered heterocyclyl ring having 1-10 heteroatoms independently selected from oxygen, nitrogen, and sulfur. In some embodiments, a heterocyclyl ring is saturated. In some embodiments, a heterocyclyl ring is partially unsaturated. A heterocyclyl ring can be of various sizes as described in the present disclosure. In some embodiments, a ring is 3, 4, 5, 6, 7, 8, 9, or 10-membered. In some embodiments, a ring is 3-membered. In some embodiments, a ring is 4-membered. In some embodiments, a ring is 5-membered. In some embodiments, a ring is 6-membered. In some embodiments, a ring is 7-membered. In some embodiments, a ring is 8-membered. In some embodiments, a ring is 9-membered. In some embodiments, a ring is 10-membered. Heterocyclyl rings can contain various numbers and/or types of heteroatoms. In some embodiments, a heterocyclyl ring contains no more than one heteroatom. In some embodiments, a heterocyclyl ring contains more than one heteroatom. In some embodiments, a heterocyclyl ring contains no more than one type of heteroatom. In some embodiments, a heterocyclyl ring contains more than one type of heteroatoms. In some embodiments, a heterocyclyl ring is monocyclic. In some embodiments, a heterocyclyl ring is bicyclic. In some embodiments, a heterocyclyl ring is polycyclic. In some embodiments, a ring is a heterocyclyl moiety as described in the present disclosure for R with more valences.

As readily appreciated by a person having ordinary skill in the art, many suitable ring moieties are extensively described in and can be used in accordance with the present disclosure, for example, those described for R (which may have more valences for $Cy^L$).

In some embodiments, $Cy^L$ is a sugar moiety in a nucleic acid. In some embodiments, $Cy^L$ is an optionally substituted furanose moiety. In some embodiments, $Cy^L$ is a pyranose moiety. In some embodiments, $Cy^L$ is an optionally substituted furanose moiety found in DNA. In some embodiments, $Cy^L$ is an optionally substituted furanose moiety found in RNA. In some embodiments, $Cy^L$ is an optionally substituted 2'-deoxyribofuranose moiety. In some embodiments, $Cy^L$ is an optionally substituted ribofuranose moiety. In some embodiments, substitutions provide sugar modifications as described in the present disclosure. In some embodiments, an optionally substituted 2'-deoxyribofuranose moiety and/or an optionally substituted ribofuranose moiety comprise substitution at a 2'-position. In some embodiments, a 2'-position is a 2'-modification as described in the present disclosure. In some embodiments, a 2'-modification is —F. In some embodiments, a 2'-modification is —OR, wherein R is as described in the present disclosure. In some embodiments, R is not hydrogen. In some embodiments, $Cy^L$ is a modified sugar moiety, such as a sugar moiety in LNA, alpha-L-LNA or GNA. In some embodiments, $Cy^L$ is a modified sugar moiety, such as a sugar moiety in ENA. In some embodiments, $Cy^L$ is a terminal sugar moiety of an oligonucleotide, connecting an internucleotidic linkage and a nucleobase. In some embodiments, $Cy^L$ is a terminal sugar moiety of an oligonucleotide, for example, when that terminus is connected to a solid support optionally through a linker. In some embodiments, $Cy^L$ is a sugar moiety connecting two internucleotidic linkages and a nucleobase. Example sugars and sugar moieties are extensively described in the present disclosure.

In some embodiments, $Cy^L$ is a nucleobase moiety. In some embodiments, a nucleobase is a natural nucleobase, such as A, T, C, G, U, etc. In some embodiments, a nucleobase is a modified nucleobase. In some embodiments, $Cy^L$ is optionally substituted nucleobase moiety selected from A, T, C, G, U, and 5mC. Example nucleobases and nucleobase moieties are extensively described in the present disclosure.

In some embodiments, two $Cy^L$ moieties are bonded to each other, wherein one $Cy^L$ is a sugar moiety and the other is a nucleobase moiety. In some embodiments, such a sugar moiety and nucleobase moiety forms a nucleoside moiety. In some embodiments, a nucleoside moiety is natural. In some embodiments, a nucleoside moiety is modified. In some embodiments, $Cy^L$ is an optionally substituted natural nucleoside moiety selected from adenosine, 5-methyluridine, cytidine, guanosine, uridine, 5-methylcytidine, 2'-deoxyadenosine, thymidine, 2'-deoxycytidine, 2'-deoxyguanosine, 2'-deoxyuridine, and 5-methyl-2'-deoxycytidine. Example nucleosides and nucleosides moieties are extensive described in the present disclosure.

Ring $A^L$ can be either be monovalent, bivalent or polyvalent. In some embodiments, Ring $A^L$ is monovalent (e.g., when g is 0 and no substitution). In some embodiments, Ring $A^L$ is bivalent. In some embodiments, Ring $A^L$ is polyvalent. In some embodiments, Ring $A^L$ is bivalent and is —Cy—. In some embodiments, Ring $A^L$ is an optionally substituted bivalent triazole ring. In some embodiments, Ring $A^L$ is trivalent and is $Cy^L$. In some embodiments, Ring $A^L$ is tetravalent and is $Cy^L$. In some embodiments, Ring $A^L$ is optionally substituted

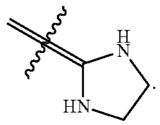

In some embodiments, —X-L-$R^1$ is optionally substituted alkynyl. In some embodiments, —X-L-$R^1$ is —C≡CH. In some embodiments, an alkynyl group, e.g., C≡CH, can react with a number of reagents through various reactions to provide further modifications. For example, in some embodiments, an alkynyl group can react with azides through click chemistry. In some embodiments, an azide has the structure of $R^1$—$N_3$.

In some embodiments, each $R^s$ is independently —H, halogen, —CN, —$N_3$, —NO, —$NO_2$, -L-R', -L-Si$(R)_3$, -L-OR', -L-SR', -L-N$(R')_2$, —O-L-R', —O-L-Si$(R)_3$, —O-L-OR', —O-$L^s$SR', or —O-$L^s$N$(R')_2$ as described in the present disclosure.

In some embodiments, $R^s$ is R', wherein R' is as described in the present disclosure. In some embodiments, $R^s$ is R, wherein R is as described in the present disclosure. In some embodiments, $R^s$ is optionally substituted $C_{1-6}$ aliphatic. In some embodiments, $R^s$ is methyl. In some embodiments, $R^s$ is optionally substituted $C_{1-30}$ heteroaliphatic. In some embodiments, $R^s$ comprises one or more silicon atoms. In some embodiments, $R^s$ is —$CH_2Si(Ph)_2CH_3$.

In some embodiments, $R^s$ is -L-R'. In some embodiments, $R^s$ is -L-R' wherein -L- is a bivalent, optionally substituted $C_{1-30}$ heteroaliphatic group. In some embodiments, $R^s$ is —$CH_2Si(Ph)_2CH_3$.

In some embodiments, $R^s$ is —F. In some embodiments, $R^s$ is —Cl. In some embodiments, $R^s$ is —Br. In some embodiments, $R^s$ is —I. In some embodiments, $R^s$ is —CN. In some embodiments, $R^s$ is —$N_3$. In some embodiments, $R^s$ is —NO. In some embodiments, $R^s$ is —$NO_2$. In some embodiments, $R^s$ is -L-Si$(R)_3$. In some embodiments, $R^s$ is —Si$(R)_3$. In some embodiments, $R^s$ is -L-R'. In some embodiments, $R^s$ is —R'. In some embodiments, $R^s$ is -L-OR'. In some embodiments, $R^s$ is —OR'. In some embodiments, $R^s$ is -L-SR'. In some embodiments, $R^s$ is —SR'. In some embodiments, $R^s$ is -L-N$(R')_2$. In some embodiments, $R^s$ is —N$(R')_2$. In some embodiments, $R^s$ is —O-L-R'. In some embodiments, $R^s$ is —O-L-Si$(R)_3$. In some embodiments, $R^s$ is —O-L-OR'. In some embodiments, $R^s$ is —O-L-SR'. In some embodiments, $R^s$ is —O-L-N$(R')_2$. In some embodiments, $R^s$ is a 2'-modification as described in the present disclosure. In some embodiments, $R^s$ is —OR, wherein R is as described in the present disclosure. In some embodiments, $R^s$ is —OR, wherein R is optionally substituted $C_{1-6}$ aliphatic. In some embodiments, $R^s$ is —OMe. In some embodiments, $R^s$ is —$OCH_2CH_2OMe$. In some embodiments, $R^s$ is $R^{1s}$, $R^{2s}$, $R^{3s}$, $R^{4s}$, or $R^{5s}$ as described in the present disclosure.

In some embodiments, g is 0-20. In some embodiments, g is 1-20. In some embodiments, g is 1-5. In some embodiments, g is 1. In some embodiments, g is 2. In some embodiments, g is 3. In some embodiments, g is 4. In some embodiments, g is 5. In some embodiments, g is 6. In some embodiments, g is 7. In some embodiments, g is 8. In some embodiments, g is 9. In some embodiments, g is 10. In some embodiments, g is 11. In some embodiments, g is 12. In some embodiments, g is 13. In some embodiments, g is 14. In some embodiments, g is 15. In some embodiments, g is 16. In some embodiments, g is 17. In some embodiments, g is 18. In some embodiments, g is 19. In some embodiments, g is 20.

In some embodiments,

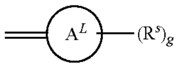

is

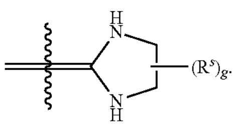

In some embodiments,

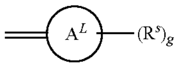

is

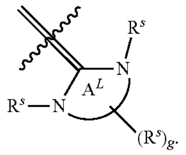

In some embodiments,

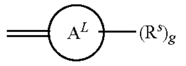

is

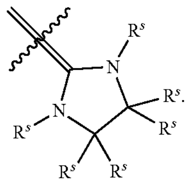

In some embodiments, each Ring A is independently an optionally substituted 3-20 membered monocyclic, bicyclic or polycyclic ring having 0-10 heteroatoms, e.g., independently selected from oxygen, nitrogen, sulfur, phosphorus and silicon. In some embodiments, Ring A is an optionally substituted ring, which ring is as described in the present disclosure. In some embodiments, Ring A comprises an oxygen ring atom. In some embodiments, Ring A is or comprises a ring of a sugar moiety. In some embodiments, a ring is

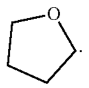

In some embodiments, a ring is

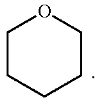

In some embodiments, a ring is

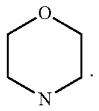

In some embodiments, a ring is a bicyclic ring, e.g., found in a sugar moiety of LNA.

In some embodiments, a sugar unit is of the structure

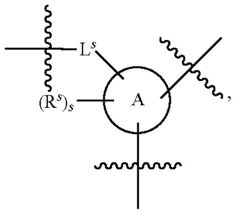

wherein each variable is independently as described in the present disclosure. In some embodiments, a nucleoside unit is of the structure

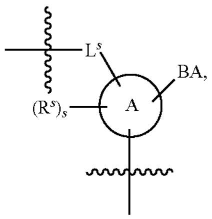

wherein each variable is independently as described in the present disclosure.

In some embodiments, $L^s$ is —$C(R^{5s})_2$— and

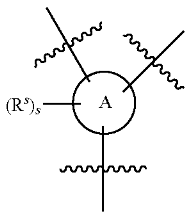

is as described in the present disclosure. In some embodiments, $L^s$ is —$CHR^{5s}$— and

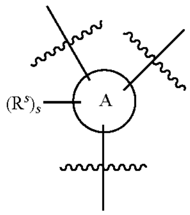

is as described in the present disclosure. In some embodiments, $L^s$ is —$C(R)_2$— and

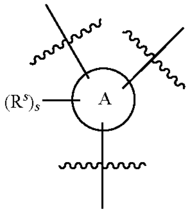

is as described in the present disclosure. In some embodiments, $L^s$ is —CHR— and

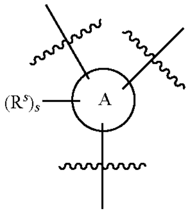

is as described in the present disclosure.

In some embodiments,

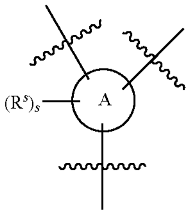

is

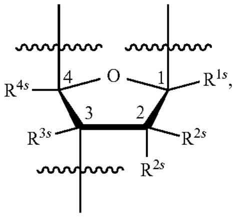

BA is connected at Cl, and each of $R^{1s}$, $R^{2s}$, $R^{3s}$, $R^{4s}$ and $R^{5s}$ is independently as described in the present disclosure. In some embodiments,

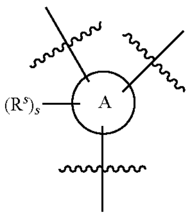

is

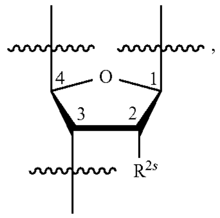

wherein $R^{2s}$ is as described in the present disclosure. In some embodiments,

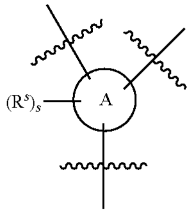

is

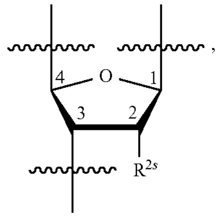

wherein $R^{2s}$ is not-OH. In some embodiments,

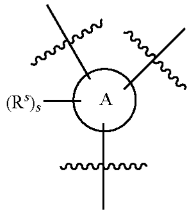

is

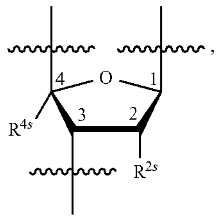

wherein $R^{2s}$ and $R^{4s}$ are R, and the two R groups are taken together with their intervening atoms to form an optionally substituted ring. In some embodiments,

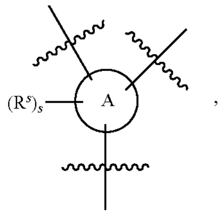

or Ring A, is optionally substituted

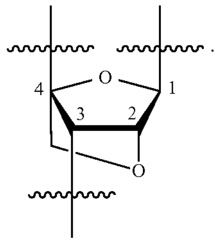

In some embodiments,

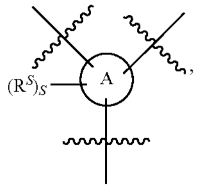

or Ring A, is

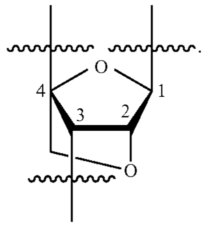

In some embodiments,

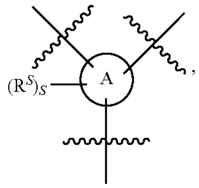

or Ring A, is

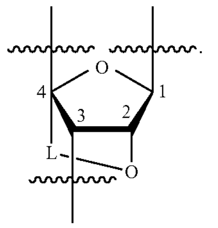

In some embodiments, each of $R^{1s}$, $R^{2s}$, $R^{3s}$, $R^{4s}$, and $R^{5s}$ is independently $R^s$, wherein $R^s$ is as described in the present disclosure.

In some embodiments, $R^{1s}$ is $R^s$ wherein $R^s$ is as described in the present disclosure. In some embodiments, $R^{1s}$ is at 1'-position (BA is at 1'-position). In some embodiments, $R^{1s}$ is —H. In some embodiments, $R^{1s}$ is —F. In some embodiments, $R^{1s}$ is —Cl. In some embodiments, $R^{1s}$ is —Br. In some embodiments, $R^{1s}$ is —I. In some embodiments, $R^{1s}$ is —CN. In some embodiments, $R^{1s}$ is —$N_3$. In some embodiments, $R^{1s}$ is —NO. In some embodiments, $R^{1s}$ is —$NO_2$. In some embodiments, $R^{1s}$ is -L-R'. In some embodiments, $R^{1s}$ is —R'. In some embodiments, $R^{1s}$ is -L-OR'. In some embodiments, $R^{1s}$ is —OR'. In some embodiments, $R^{1s}$ is -L-SR'. In some embodiments, $R^{1s}$ is —SR'. In some embodiments, $R^{1s}$ is L-L-N(R')$_2$. In some embodiments, $R^{1s}$ is —N(R')$_2$. In some embodiments, $R^{1s}$ is —OR', wherein R' is optionally substituted $C_{1-6}$ aliphatic. In some embodiments, $R^{1s}$ is —OR', wherein R' is optionally substituted $C_{1-6}$ alkyl. In some embodiments, $R^{1s}$ is —OMe. In some embodiments, $R^{1s}$ is -MOE. In some embodiments, $R^{1s}$ is hydrogen. In some embodiments, $R^s$ at one 1'-position is hydrogen, and $R^s$ at the other 1'-position is not hydrogen as described herein. In some embodiments, $R^s$ at both 1'-positions are hydrogen. In some embodiments, $R^s$ at one 1'-position is hydrogen, and the other 1'-position is connected to an internucleotidic linkage. In some embodiments, $R^{1s}$ is —F. In some embodiments, $R^{1s}$ is —Cl. In some embodiments, $R^{1s}$ is —Br. In some embodiments, $R^{1s}$ is —I. In some embodiments, $R^{1s}$ is —CN. In some embodiments, $R^{1s}$ is —$N_3$. In some embodiments, $R^{1s}$ is —NO. In some embodiments, $R^{1s}$ is —$NO_2$. In some embodiments, $R^{1s}$ is -L-R'. In some embodiments, $R^{1s}$ is —R'. In some embodiments, $R^{1s}$ is -L-OR'. In some embodiments, $R^{1s}$ is —OR'. In some embodiments, $R^{1s}$ is -L-SR'. In some embodiments, $R^{1s}$ is —SR'. In some embodiments, $R^{1s}$ is -L-N(R')$_2$. In some embodiments, $R^{1s}$ is —N(R')$_2$. In some embodiments, $R^{1s}$ is —OR', wherein R' is optionally substituted $C_{1-6}$ aliphatic. In some embodiments, $R^{1s}$ is —OR', wherein R' is optionally substituted $C_{1-6}$ alkyl. In some embodiments, $R^{1s}$ is —OH. In some embodiments, $R^{1s}$ is —OMe. In some embodiments, $R^{1s}$ is -MOE. In some embodiments, $R^{1s}$ is hydrogen. In some embodiments, one $R^{1s}$ at a 1'-position is hydrogen, and the other $R^{1s}$ at the other 1'-position is not hydrogen as described herein. In some embodiments, $R^{1s}$ at both 1'-positions are hydrogen. In some embodiments, $R^{1s}$ is —O-L-OR'. In some embodiments, $R^{1s}$ is —O-L-OR', wherein L is optionally substituted $C_{1-6}$ alkylene, and R' is optionally substituted $C_{1-6}$ aliphatic. In some embodiments, $R^{1s}$ is —O-(optionally substituted $C_{1-6}$ alkylene)-OR'. In some embodiments, $R^{15}$ is —O-(optionally substituted $C_{1-6}$ alkylene)-OR', wherein R' is optionally substituted $C_{1-6}$ alkyl. In some embodiments, $R^{1s}$ is —$OCH_2CH_2OMe$.

In some embodiments, $R^{2s}$ is $R^s$ wherein $R^s$ is as described in the present disclosure. In some embodiments, if there are two $R^{2s}$ at the 2'-position, one $R^{2s}$ is —H and the other is not. In some embodiments, $R^{2s}$ is at 2'-position (BA is at 1'-position). In some embodiments, $R^{2s}$ is —H. In some embodiments, $R^{2s}$ is —F. In some embodiments, $R^{2s}$ is —Cl. In some embodiments, $R^{2s}$ is —Br. In some embodiments, $R^{2s}$ is —I. In some embodiments, $R^{2s}$ is —CN. In some embodiments, $R^{2s}$ is —$N_3$. In some embodiments, $R^{2s}$ is —NO. In some embodiments, $R^{2s}$ is —$NO_2$. In some embodiments, $R^{2s}$ is -L-R'. In some embodiments, $R^{2s}$ is —R'. In some embodiments, $R^{2s}$ is -L-OR'. In some embodiments, $R^{2s}$ is —OR'. In some embodiments, $R^{2s}$ is -L-SR'. In some embodiments, $R^{2s}$ is —SR'. In some embodiments, $R^{2s}$ is L-L-N(R')$_2$. In some embodiments, $R^{2s}$ is —N(R')$_2$. In some embodiments, $R^{2s}$ is —OR', wherein R' is optionally substituted $C_{1-6}$ aliphatic. In some embodiments, $R^{2s}$ is —OR', wherein R' is optionally substituted $C_{1-6}$ alkyl. In some embodiments, $R^{2s}$ is —OMe. In some embodiments, $R^{2s}$ is -MOE. In some embodiments, $R^{2s}$ is hydrogen. In some embodiments, $R^s$ at one 2'-position is hydrogen, and $R^s$ at the other 2'-position is not hydrogen as described herein. In some embodiments, $R^s$ at both 2'-positions are hydrogen. In some embodiments, $R^s$ at one 2'-position is hydrogen, and the other 2'-position is connected to an internucleotidic linkage. In some embodiments, $R^{2s}$ is —F. In some embodiments, $R^{2s}$ is —Cl. In some embodiments, $R^{2s}$ is —Br. In some embodiments, $R^{2s}$ is —I. In some embodiments, $R^{2s}$ is —CN. In some embodiments, $R^{2s}$ is —$N_3$. In some embodiments, $R^{2s}$ is —NO. In some embodiments, $R^{2s}$ is —$NO_2$. In some embodiments, $R^{2s}$ is -L-R'. In some embodiments, $R^{2s}$ is —R'. In some embodiments, $R^{2s}$ is -L-OR'. In some embodiments, $R^{2s}$ is —OR'. In some embodiments, $R^{2s}$ is -L-SR'. In some embodiments, $R^{2s}$ is —SR'. In some embodiments, $R^{2s}$ is -L-N(R')$_2$. In some embodiments, $R^{2s}$ is —N(R')$_2$. In some embodiments, $R^{2s}$ is —OR', wherein R' is optionally substituted $C_{1-6}$ aliphatic. In some embodiments, $R^{2s}$ is —OR', wherein R' is optionally substituted $C_{1-6}$ alkyl. In some embodiments, $R^{2s}$ is —OH. In some embodiments, $R^{2s}$ is —OMe. In some embodiments, $R^{2s}$ is -MOE. In some embodiments, $R^{2s}$ is hydrogen. In some embodiments, one $R^{2s}$ at a 2'-position is hydrogen, and the other $R^{2s}$ at the other 2'-position is not hydrogen as described herein. In some embodiments, $R^{2s}$ at both 2'-positions are hydrogen. In some embodiments, $R^{2s}$ is —O-L-OR'. In some embodiments, $R^{2s}$ is —O-L-OR', wherein L is optionally substituted $C_{1-6}$ alkylene, and R' is optionally substituted $C_{1-6}$ aliphatic. In some embodiments, $R^{2s}$ is —O-(optionally substituted $C_{1-6}$ alkylene)-OR'. In some embodiments, $R^{2s}$ is —O-(optionally substituted $C_{1-6}$ alkylene)-OR', wherein R' is optionally substituted $C_{16}$ alkyl. In some embodiments, $R^{2s}$ is —$OCH_2CH_2OMe$.

In some embodiments, $R^{2s}$ comprises a guanidine moiety. In some embodiments, $R^{2s}$ comprises

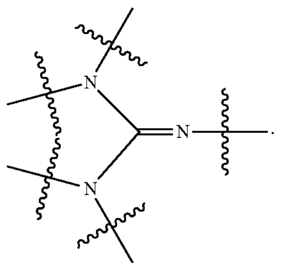

In some embodiments, $R^{2s}$ is -L-$W^z$, wherein $W^z$ is selected from

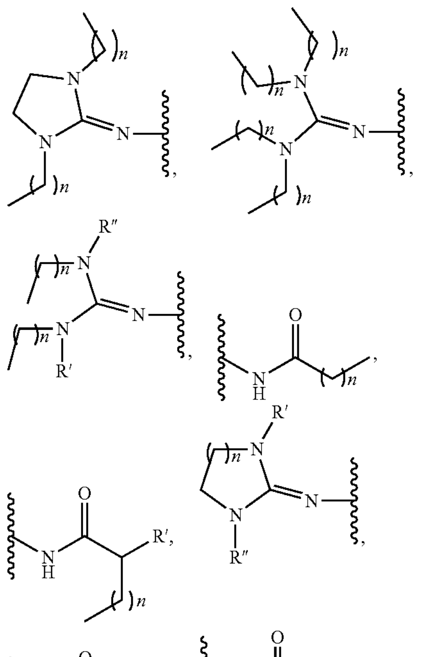

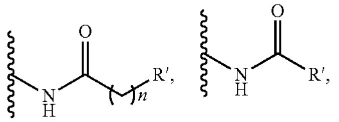

and

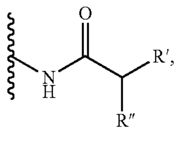

wherein R" is R' and n is 0-15. In some embodiments, R' and R" are independently

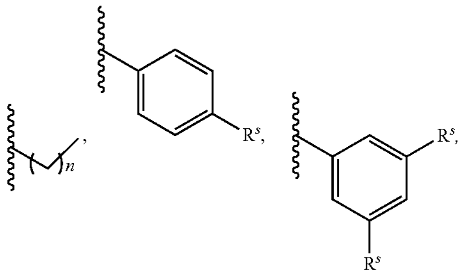

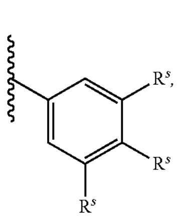

or

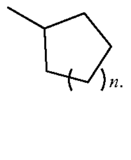

In some embodiments, L is —O—$CH_2CH_2$—. In some embodiments, n is 0-3. In some embodiments, each $R^s$ is independently —H, —$OCH_3$, —F, —CN, —$CH_3$, —$NO_2$, —$CF_3$, or —$OCF_3$. In some embodiments, R' and R" are the same. In some embodiments, R' and R" are different.

In some embodiments, $R^{3s}$ is $R^s$ wherein $R^s$ is as described in the present disclosure. In some embodiments, $R^{3s}$ is at 3'-position (BA is at 1'-position). In some embodiments, $R^{3s}$ is —H. In some embodiments, $R^{3s}$ is —F. In some embodiments, $R^{3s}$ is —Cl. In some embodiments, $R^{3s}$ is —Br. In some embodiments, $R^{3s}$ is —I. In some embodiments, $R^{3s}$ is —CN. In some embodiments, $R^{3s}$ is —$N_3$. In some embodiments, $R^{3s}$ is —NO. In some embodiments, $R^{3s}$ is —$NO_2$. In some embodiments, $R^{3s}$ is -L-R'. In some embodiments, $R^{3s}$ is —R'. In some embodiments, $R^{3s}$ is -L-OR'. In some embodiments, $R^{3s}$ is —OR'. In some embodiments, $R^{3s}$ is -L-SR'. In some embodiments, $R^{3s}$ is —SR'. In some embodiments, $R^{3s}$ is -L-N(R')$_2$. In some embodiments, $R^{3s}$ is —N(R')$_2$. In some embodiments, $R^{3s}$ is —OR', wherein R' is optionally substituted $C_{1-6}$ aliphatic. In some embodiments, $R^{3s}$ is —OR', wherein R' is optionally substituted $C_{1-6}$ alkyl. In some embodiments, $R^{3s}$ is —OMe. In some embodiments, $R^{3s}$ is -MOE. In some embodiments, $R^{3s}$ is hydrogen. In some embodiments, $R^s$ at one 3'-position is hydrogen, and $R^s$ at the other 3'-position is not hydrogen as described herein. In some embodiments, $R^s$ at both 3'-positions are hydrogen. In some embodiments, $R^s$ at one 3'-position is hydrogen, and the other 3'-position is connected to an internucleotidic linkage. In some embodiments, $R^{3s}$ is —F. In some embodiments, $R^{3s}$ is —Cl. In some embodiments, $R^{3s}$ is —Br. In some embodiments, $R^{3s}$ is —I. In some embodiments, $R^{3s}$ is —CN. In some embodiments, $R^{3s}$ is —$N_3$. In some embodiments, $R^{3s}$ is —NO. In some embodiments, $R^{3s}$ is —$NO_2$. In some embodiments, $R^{3s}$ is -L-R'. In some embodiments, $R^{3s}$ is —R'. In some embodiments, $R^{3s}$ is -L-OR'. In some embodiments, $R^{3s}$ is —OR'. In some embodiments, $R^{3s}$ is -L-SR'. In some embodiments, $R^{3s}$ is —SR'. In some embodiments, $R^{3s}$ is L-L-N(R')$_2$. In some embodiments, $R^{3s}$ is —N(R')$_2$. In some embodiments, $R^{3s}$ is —OR', wherein R' is optionally substituted $C_{1-6}$ aliphatic. In some embodiments, $R^{3s}$ is —OR', wherein R' is optionally substituted $C_{1-6}$ alkyl. In some embodiments, $R^{3s}$ is —OH. In some embodiments, $R^{3s}$ is —OMe. In some embodiments, $R^{3s}$ is -MOE. In some embodiments, $R^{3s}$ is hydrogen.

In some embodiments, $R^{4s}$ is $R^s$ wherein $R^s$ is as described in the present disclosure. In some embodiments, $R^{4s}$ is at 4'-position (BA is at 1'-position). In some embodiments, $R^{4s}$ is —H. In some embodiments, $R^{4s}$ is —F. In some embodiments, $R^{4s}$ is —Cl. In some embodiments, $R^{4s}$ is —Br. In some embodiments, $R^{4s}$ is —I. In some embodiments, $R^{4s}$ is —CN. In some embodiments, $R^{4s}$ is —$N_3$. In some embodiments, $R^{4s}$ is —NO. In some embodiments, $R^{4s}$ is —$NO_2$. In some embodiments, $R^{4s}$ is -L-R'. In some embodiments, $R^{4s}$ is —R'. In some embodiments, $R^{4s}$ is -L-OR'. In some embodiments, $R^{4s}$ is —OR'. In some embodiments, $R^{4s}$ is -L-SR'. In some embodiments, $R^{4s}$ is —SR'. In some embodiments, $R^{4s}$ is -L-N(R')$_2$. In some embodiments, $R^{4s}$ is —N(R')$_2$. In some embodiments, $R^{4s}$ is —OR', wherein R' is optionally substituted $C_{1-6}$ aliphatic. In some embodiments, $R^{4s}$ is —OR', wherein R' is optionally substituted $C_{1-6}$ alkyl. In some embodiments, $R^{4s}$ is —OMe. In some embodiments, $R^{4s}$ is -MOE. In some embodiments, $R^{4s}$ is hydrogen. In some embodiments, $R^s$ at one 4'-position is hydrogen, and $R^s$ at the other 4'-position is not hydrogen as described herein. In some embodiments, $R^s$ at both 4'-positions are hydrogen. In some embodiments, $R^s$ at one 4'-position is hydrogen, and the other 4'-position is connected to an internucleotidic linkage. In some embodiments, $R^{4s}$ is —F. In some embodiments, $R^{4s}$ is —Cl. In some embodiments, $R^{4s}$ is —Br. In some embodiments, $R^{4s}$ is —I. In some embodiments, $R^{4s}$ is —CN. In some embodiments, $R^{4s}$ is $—N_3$. In some embodiments, $R^{4s}$ is —NO. In some embodiments, $R^{4s}$ is $—NO_2$. In some embodiments, $R^{4s}$ is -L-R'. In some embodiments, $R^{4s}$ is —R'. In some embodiments, $R^{4s}$ is -L-OR'. In some embodiments, $R^{4s}$ is —OR'. In some embodiments, $R^{4s}$ is -L-SR'. In some embodiments, $R^{4s}$ is —SR'. In some embodiments, $R^{4s}$ is L-L-N(R')$_2$. In some embodiments, $R^{4s}$ is —N(R')$_2$. In some embodiments, $R^{4s}$ is —OR', wherein R' is optionally substituted $C_{1-6}$ aliphatic. In some embodiments, $R^{4s}$ is —OR', wherein R' is optionally substituted $C_{1-6}$ alkyl. In some embodiments, $R^{4s}$ is —OH. In some embodiments, $R^{4s}$ is —OMe. In some embodiments, $R^{4s}$ is -MOE. In some embodiments, $R^{4s}$ is hydrogen.

In some embodiments, $R^{5s}$ is $R^s$ wherein $R^s$ is as described in the present disclosure. In some embodiments, $R^{5s}$ is R' wherein R' is as described in the present disclosure. In some embodiments, $R^{5s}$ is —H. In some embodiments, two or more $R^{5s}$ are connected to the same carbon atom, and at least one is not —H. In some embodiments, $R^{5s}$ is not —H. In some embodiments, $R^{5s}$ is —F. In some embodiments, $R^{5s}$ is —Cl. In some embodiments, $R^{5s}$ is —Br. In some embodiments, $R^{5s}$ is —I. In some embodiments, $R^{5s}$ is —CN. In some embodiments, $R^{5s}$ is $—N_3$. In some embodiments, $R^{5s}$ is —NO. In some embodiments, $R^{5s}$ is $—NO_2$. In some embodiments, $R^{5s}$ is -L-R'. In some embodiments, $R^{5s}$ is —R'. In some embodiments, $R^{5s}$ is -L-OR'. In some embodiments, $R^{5s}$ is —OR'. In some embodiments, $R^{5s}$ is -L-SR'. In some embodiments, $R^{5s}$ is —SR'. In some embodiments, $R^{5s}$ is L-L-N(R')$_2$. In some embodiments, $R^{5s}$ is —N(R')$_2$. In some embodiments, $R^{5s}$ is —OR', wherein R' is optionally substituted $C_{1-6}$ aliphatic. In some embodiments, $R^{5s}$ is —OR', wherein R' is optionally substituted $C_{1-6}$ alkyl. In some embodiments, $R^{5s}$ is —OH. In some embodiments, $R^{5s}$ is —OMe. In some embodiments, $R^{5s}$ is -MOE. In some embodiments, $R^{5s}$ is hydrogen.

In some embodiments, $R^{5s}$ is optionally substituted $C_{1-6}$ aliphatic as described in the present disclosure, e.g., $C_{1-6}$ aliphatic embodiments described for R or other variables. In some embodiments, $R^{5s}$ is optionally substituted $C_{1-6}$ alkyl. In some embodiments, $R^{5s}$ is optionally substituted methyl, wherein each substituent, if any, independently comprises no more than one carbon atoms. In some embodiments, $R^{5s}$ is optionally substituted methyl, wherein each substituent, if any, independently is halogen. In some embodiments, $R^{5s}$ is methyl. In some embodiments, $R^{5s}$ is ethyl.

In some embodiments, $R^{5s}$ is a protected hydroxyl group suitable for oligonucleotide synthesis. In some embodiments, $R^{5s}$ is —OR', wherein R' is optionally substituted $C_{1-6}$ aliphatic. In some embodiments, $R^{5s}$ is DMTrO—. Example protecting groups are widely known for use in accordance with the present disclosure. For additional examples, see Greene, T. W.; Wuts, P. G. M. Protective Groups in Organic Synthesis, 2nd ed.; Wiley: New York, 1991, and U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, and/or WO 2017/210647, protecting groups of each of which are hereby incorporated by reference.

In some embodiments, two or more of $R^{1s}$, $R^{2s}$, $R^{3s}$, $R^{4s}$, and $R^{5s}$ are R and can be taken together with intervening atom(s) to form a ring as described in the present disclosure. In some embodiments, $R^{2s}$ and $R^{4s}$ are R taken together to form a ring, and a sugar moiety can be a bicyclic sugar moiety, e.g., a LNA sugar moiety.

In some embodiments, $L^s$ is L as described in the present disclosure.

In some embodiments, $L^s$ is —C($R^{5s}$)$_2$—, wherein each $R^{5s}$ is independently as described in the present disclosure. In some embodiments, one of $R^{5s}$ is H and the other is not H. In some embodiments, none of $R^{5s}$ is H. In some embodiments, L' is —CH$R^{5s}$—, wherein each $R^{5s}$ is independently as described in the present disclosure. In some embodiments, the carbon atom of —C($R^{5s}$)$_2$— is stereorandom. In some embodiments, it is of R configuration. In some embodiments, it is of S configuration. In some embodiments, —C($R^{5s}$)$_2$— is 5'-C, optionally substituted, of a sugar moiety. In some embodiments, the C of —C($R^{5s}$)$_2$— is of R configuration. In some embodiments, the C of —C($R^{5s}$)$_2$— is of S configuration. As described in the present disclosure, in some embodiments, $R^{5s}$ is optionally substituted $C_{1-6}$ aliphatic; in some embodiments, $R^{5s}$ is methyl.

In some embodiments, provided compounds comprise one or more bivalent or multivalent optionally substituted rings, e.g., Ring A, $Cy^L$, those formed by two or more R groups (R and (combinations of) variables that can be R) taken together, etc. In some embodiments, a ring is a cycloaliphatic, aryl, heteroaryl, or heterocyclyl group as described for R but bivalent or multivalent. As appreciated by those skilled in the art, ring moieties described for one variable, e.g., Ring A, can also be applicable to other variables, e.g., $Cy^L$, if requirements of the other variables, e.g., number of heteroatoms, valence, etc., are satisfied. Example rings are extensively described in the present disclosure.

In some embodiments, a ring, e.g., in Ring A, R, etc. which is optionally substituted, is a 3-20 membered monocyclic, bicyclic or polycyclic ring having 0-10 heteroatoms independently selected from oxygen, nitrogen, sulfur, phosphorus and silicon.

In some embodiments, a ring can be of any size within its range, e.g., 3, 4, 5, 6, 7, 8, 9, 10, 11, 12, 13, 14, 15, 16, 17, 18, 19, or 20-membered.

In some embodiments, a ring is monocyclic. In some embodiments, a ring is saturated and monocyclic. In some embodiments, a ring is monocyclic and partially saturated. In some embodiments, a ring is monocyclic and aromatic.

In some embodiments, a ring is bicyclic. In some embodiments, a ring is polycyclic. In some embodiments, a bicyclic or polycyclic ring comprises two or more monocyclic ring moieties, each of which can be saturated, partially saturated, or aromatic, and each which can contain no or 1-10 heteroatoms. In some embodiments, a bicyclic or polycyclic ring comprises a saturated monocyclic ring. In some embodiments, a bicyclic or polycyclic ring comprises a saturated monocyclic ring containing no heteroatoms. In some embodiments, a bicyclic or polycyclic ring comprises a saturated monocyclic ring comprising one or more heteroatoms. In some embodiments, a bicyclic or polycyclic ring comprises a partially saturated monocyclic ring. In some embodiments, a bicyclic or polycyclic ring comprises a partially saturated monocyclic ring containing no heteroatoms. In some embodiments, a bicyclic or polycyclic ring comprises a partially saturated monocyclic ring comprising one or more heteroatoms. In some embodiments, a bicyclic or polycyclic ring comprises an aromatic monocyclic ring. In some embodiments, a bicyclic or polycyclic ring comprises an aromatic monocyclic ring containing no heteroatoms. In some embodiments, a bicyclic or polycyclic ring comprises an aromatic monocyclic ring comprising one or more heteroatoms. In some embodiments, a bicyclic or polycyclic ring comprises a saturated ring and a partially saturated ring, each of which independently contains one or more heteroatoms. In some embodiments, a bicyclic ring comprises a saturated ring and a partially saturated ring, each of which independently comprises no, or one or more heteroatoms. In some embodiments, a bicyclic ring comprises an aromatic ring and a partially saturated ring, each of which independently comprises no, or one or more heteroatoms. In some embodiments, a polycyclic ring comprises a saturated ring and a partially saturated ring, each of which independently comprises no, or one or more heteroatoms. In some embodiments, a polycyclic ring comprises an aromatic ring and a partially saturated ring, each of which independently comprises no, or one or more heteroatoms. In some embodiments, a polycyclic ring comprises an aromatic ring and a saturated ring, each of which independently comprises no, or one or more heteroatoms. In some embodiments, a polycyclic ring comprises an aromatic ring, a saturated ring, and a partially saturated ring, each of which independently comprises no, or one or more heteroatoms. In some embodiments, a ring comprises at least one heteroatom. In some embodiments, a ring comprises at least one nitrogen atom. In some embodiments, a ring comprises at least one oxygen atom. In some embodiments, a ring comprises at least one sulfur atom.

As appreciated by those skilled in the art in accordance with the present disclosure, a ring is typically optionally substituted. In some embodiments, a ring is unsubstituted. In some embodiments, a ring is substituted. In some embodiments, a ring is substituted on one or more of its carbon atoms. In some embodiments, a ring is substituted on one or more of its heteroatoms. In some embodiments, a ring is substituted on one or more of its carbon atoms, and one or more of its heteroatoms. In some embodiments, two or more substituents can be located on the same ring atom. In some embodiments, all available ring atoms are substituted. In some embodiments, not all available ring atoms are substituted. In some embodiments, in provided structures where rings are indicated to be connected to other structures (e.g., Ring A in 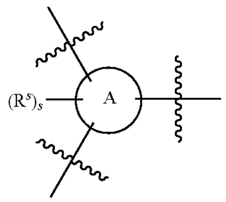 ), "optionally substituted" is to mean that, besides those structures already connected, remaining substitutable ring positions, if any, are optionally substituted.

In some embodiments, a ring is a bivalent or multivalent $C_{3-30}$ cycloaliphatic ring. In some embodiments, a ring is a bivalent or multivalent $C_{3-20}$ cycloaliphatic ring. In some embodiments, a ring is a bivalent or multivalent $C_{3-10}$ cycloaliphatic ring. In some embodiments, a ring is a bivalent or multivalent 3-30 membered saturated or partially unsaturated carbocyclic ring. In some embodiments, a ring is a bivalent or multivalent 3-7 membered saturated or partially unsaturated carbocyclic ring. In some embodiments, a ring is a bivalent or multivalent 3-membered saturated or partially unsaturated carbocyclic ring. In some embodiments, a ring is a bivalent or multivalent 4-membered saturated or partially unsaturated carbocyclic ring. In some embodiments, a ring is a bivalent or multivalent 5-membered saturated or partially unsaturated carbocyclic ring. In some embodiments, a ring is a bivalent or multivalent 6-membered saturated or partially unsaturated carbocyclic ring. In some embodiments, a ring is a bivalent or multivalent 7-membered saturated or partially unsaturated carbocyclic ring. In some embodiments, a ring is a bivalent or multivalent cyclohexyl ring. In some embodiments, a ring is a bivalent or multivalent cyclopentyl ring. In some embodiments, a ring is a bivalent or multivalent cyclobutyl ring. In some embodiments, a ring is a bivalent or multivalent cyclopropyl ring.

In some embodiments, a ring is a bivalent or multivalent $C_{6-30}$ aryl ring. In some embodiments, a ring is a bivalent or multivalent phenyl ring.

In some embodiments, a ring is a bivalent or multivalent 8-10 membered bicyclic saturated, partially unsaturated or aryl ring. In some embodiments, a ring is a bivalent or multivalent 8-10 membered bicyclic saturated ring. In some embodiments, a ring is a bivalent or multivalent 8-10 membered bicyclic partially unsaturated ring. In some embodiments, a ring is a bivalent or multivalent 8-10 membered bicyclic aryl ring. In some embodiments, a ring is a bivalent or multivalent naphthyl ring.

In some embodiments, a ring is a bivalent or multivalent 5-30 membered heteroaryl ring having 1-10 heteroatoms independently selected from oxygen, nitrogen, sulfur, phosphorus and silicon. In some embodiments, a ring is a bivalent or multivalent 5-30 membered heteroaryl ring having 1-10 heteroatoms independently selected from oxygen, nitrogen, and sulfur. In some embodiments, a ring is a bivalent or multivalent 5-30 membered heteroaryl ring having 1-5 heteroatoms independently selected from oxygen, nitrogen, sulfur, phosphorus and silicon. In some embodiments, a ring is a bivalent or multivalent 5-30 membered heteroaryl ring having 1-5 heteroatoms independently selected from oxygen, nitrogen, and sulfur.

In some embodiments, a ring is a bivalent or multivalent 5-6 membered monocyclic heteroaryl ring having 1-4 heteroatoms independently selected from nitrogen, oxygen, and sulfur. In some embodiments, a ring is a bivalent or multivalent 5-6 membered monocyclic heteroaryl ring having 1-3 heteroatoms independently selected from nitrogen, sulfur, and oxygen.

In some embodiments, a ring is a bivalent or multivalent 5-membered monocyclic heteroaryl ring having 1-4 heteroatoms independently selected from nitrogen, oxygen or sulfur. In some embodiments, a ring is a bivalent or multivalent 6-membered monocyclic heteroaryl ring having 1-4 heteroatoms independently selected from nitrogen, oxygen, and sulfur.

In certain embodiments, a ring is a bivalent or multivalent 8-10 membered bicyclic heteroaryl ring having 1-4 heteroatoms independently selected from nitrogen, oxygen, and sulfur. In some embodiments, a ring is a bivalent or multivalent 5,6-fused heteroaryl ring having 1-4 heteroatoms independently selected from nitrogen, oxygen, and sulfur. In some embodiments, a ring is a bivalent or multivalent 5,6-fused heteroaryl ring having 1-5 heteroatoms independently selected from nitrogen, oxygen, and sulfur. In certain embodiments, a ring is a bivalent or multivalent 6,6-fused heteroaryl ring having 1-4 heteroatoms independently selected from nitrogen, oxygen, and sulfur.

In some embodiments, a ring is a bivalent or multivalent 3-30 membered heterocyclic ring having 1-10 heteroatoms independently selected from oxygen, nitrogen, sulfur, phosphorus and silicon. In some embodiments, a ring is a bivalent or multivalent 3-7 membered saturated or partially unsaturated heterocyclic ring having 1-3 heteroatoms independently selected from nitrogen, oxygen, and sulfur. In certain embodiments, a ring is a bivalent or multivalent 5-7 membered partially unsaturated monocyclic ring having 1-3 heteroatoms independently selected from nitrogen, oxygen, and sulfur. In certain embodiments, a ring is a bivalent or multivalent 5-6 membered partially unsaturated monocyclic ring having 1-3 heteroatoms independently selected from nitrogen, oxygen, and sulfur. In certain embodiments, a ring is a bivalent or multivalent 5-membered partially unsaturated monocyclic ring having 1-3 heteroatoms independently selected from nitrogen, oxygen, and sulfur. In certain embodiments, a ring is a bivalent or multivalent 6-membered partially unsaturated monocyclic ring having 1-3 heteroatoms independently selected from nitrogen, oxygen, and sulfur. In certain embodiments, a ring is a bivalent or multivalent 7-membered partially unsaturated monocyclic ring having 1-3 heteroatoms independently selected from nitrogen, oxygen, and sulfur. In some embodiments, a ring is a bivalent or multivalent 3-membered heterocyclic ring having one heteroatom selected from nitrogen, oxygen or sulfur. In some embodiments, a ring is a bivalent or multivalent 4-membered heterocyclic ring having 1-3 heteroatoms independently selected from nitrogen, oxygen, and sulfur. In some embodiments, a ring is a bivalent or multivalent 5-membered heterocyclic ring having 1-3 heteroatoms independently selected from nitrogen, oxygen, and sulfur. In some embodiments, a ring is a bivalent or multivalent 6-membered heterocyclic ring having 1-3 heteroatoms independently selected from nitrogen, oxygen, and sulfur. In some embodiments, a ring is a bivalent or multivalent 7-membered heterocyclic ring having 1-3 heteroatoms independently selected from nitrogen, oxygen, and sulfur.

In some embodiments, a ring is a bivalent or multivalent 7-10 membered bicyclic saturated or partially unsaturated heterocyclic ring having 1-5 heteroatoms independently selected from nitrogen, oxygen, and sulfur. In some embodiments, a ring is a bivalent or multivalent 8-10 membered bicyclic heteroaryl ring having 1-5 heteroatoms independently selected from nitrogen, oxygen, and sulfur.

In some embodiments, a ring is a bivalent or multivalent 5,6-fused heteroaryl ring having 1-5 heteroatoms independently selected from nitrogen, oxygen, and sulfur. In certain embodiments, a ring is a bivalent or multivalent 6,6-fused heteroaryl ring having 1-5 heteroatoms independently selected from nitrogen, oxygen, and sulfur.

In some embodiments, a ring formed by two or more groups taken together, which is typically optionally substituted, is a monocyclic saturated 5-7 membered ring having no additional heteroatoms in addition to intervening heteroatoms, if any. In some embodiments, a ring formed by two or more groups taken together is a monocyclic saturated 5-membered ring having no additional heteroatoms in addition to intervening heteroatoms, if any. In some embodiments, a ring formed by two or more groups taken together is a monocyclic saturated 6-membered ring having no additional heteroatoms in addition to intervening heteroatoms, if any. In some embodiments, a ring formed by two or more groups taken together is a monocyclic saturated 7-membered ring having no additional heteroatoms in addition to intervening heteroatoms, if any.

In some embodiments, a ring formed by two or more groups taken together is a bicyclic, saturated, partially unsaturated, or aryl 5-30 membered ring having, in addition to the intervening heteroatoms, if any, 0-10 heteroatoms independently selected from oxygen, nitrogen, sulfur, phosphorus and silicon. In some embodiments, a ring formed by two or more groups taken together is a bicyclic, saturated, partially unsaturated, or aryl 5-30 membered ring having, in addition to the intervening heteroatoms, if any, 0-10 heteroatoms independently selected from oxygen, nitrogen, and sulfur. In some embodiments, a ring formed by two or more groups taken together is a bicyclic and saturated 8-10 membered bicyclic ring having no additional heteroatoms in addition to intervening heteroatoms, if any. In some embodiments, a ring formed by two or more groups taken together is a bicyclic and saturated 8-membered bicyclic ring having no additional heteroatoms in addition to intervening heteroatoms, if any. In some embodiments, a ring formed by two or more groups taken together is a bicyclic and saturated 9-membered bicyclic ring having no additional heteroatoms in addition to intervening heteroatoms, if any. In some embodiments, a ring formed by two or more groups taken together is a bicyclic and saturated 10-membered bicyclic ring having no additional heteroatoms in addition to intervening heteroatoms, if any. In some embodiments, a ring formed by two or more groups taken together is bicyclic and comprises a 5-membered ring fused to a 5-membered ring. In some embodiments, a ring formed by two or more groups taken together is bicyclic and comprises a 5-membered ring fused to a 6-membered ring. In some embodiments, the 5-membered ring comprises one or more intervening nitrogen, phosphorus and oxygen atoms as ring atoms. In some embodiments, a ring formed by two or more groups taken together comprises a ring system having the backbone structure of

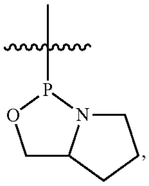,
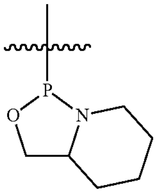,
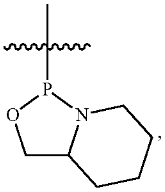, or
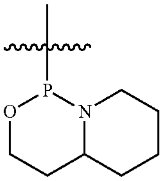.

In some embodiments, a ring formed by two or more groups taken together is a polycyclic, saturated, partially unsaturated, or aryl 3-30 membered ring having, in addition to the intervening heteroatoms, if any, 0-10 heteroatoms independently selected from oxygen, nitrogen, sulfur, phosphorus and silicon. In some embodiments, a ring formed by two or more groups taken together is a polycyclic, saturated, partially unsaturated, or aryl 3-30 membered ring having, in addition to the intervening heteroatoms, if any, 0-10 heteroatoms independently selected from oxygen, nitrogen, and sulfur.

In some embodiments, a ring formed by two or more groups taken together is monocyclic, bicyclic or polycyclic and comprises a 5-10 membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 5-9 membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 5-8 membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 5-7 membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 5-6 membered monocyclic ring whose ring atoms comprise one or more intervening nitrogen, phosphorus and/or oxygen atoms.

In some embodiments, a ring formed by two or more groups taken together is monocyclic, bicyclic or polycyclic and comprises a 5-membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 6-membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 7-membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 8-membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 9-membered monocyclic ring whose ring atoms comprise one or more intervening nitrogen, phosphorus and/or oxygen atoms. In some embodiments, a ring formed by two or more groups taken together is monocyclic, bicyclic or polycyclic and comprises a 10-membered monocyclic ring whose ring atoms comprise one or more intervening nitrogen, phosphorus and/or oxygen atoms.

In some embodiments, a ring formed by two or more groups taken together is monocyclic, bicyclic or polycyclic and comprises a 5-membered ring whose ring atoms consist of carbon atoms and the intervening nitrogen, phosphorus and oxygen atoms. In some embodiments, a ring formed by two or more groups taken together is monocyclic, bicyclic or polycyclic and comprises a 6-membered ring whose ring atoms consist of carbon atoms and the intervening nitrogen, phosphorus and oxygen atoms. In some embodiments, a ring formed by two or more groups taken together is monocyclic, bicyclic or polycyclic and comprises a 7-membered ring whose ring atoms consist of carbon atoms and the intervening nitrogen, phosphorus and oxygen atoms. In some embodiments, a ring formed by two or more groups taken together is monocyclic, bicyclic or polycyclic and comprises a 8-membered ring whose ring atoms consist of carbon atoms and the intervening nitrogen, phosphorus and oxygen atoms. In some embodiments, a ring formed by two or more groups taken together is monocyclic, bicyclic or polycyclic and comprises a 9-membered ring whose ring atoms consist of carbon atoms and the intervening nitrogen, phosphorus and oxygen atoms. In some embodiments, a ring formed by two or more groups taken together is monocyclic, bicyclic or polycyclic and comprises a 10-membered ring whose ring atoms consist of carbon atoms and the intervening nitrogen, phosphorus and oxygen atoms.

In some embodiments, rings described herein are unsubstituted. In some embodiments, rings described herein are substituted. In some embodiments, substituents are selected from those described in example compounds provided in the present disclosure.

In some embodiments, each BA is independently an optionally substituted group selected from $C_{5-30}$ heteroaryl having 1-10 heteroatoms independently selected from oxygen, nitrogen, sulfur, phosphorus and silicon, and $C_{3-30}$ heterocyclyl having 1-10 heteroatoms independently selected from oxygen, nitrogen, sulfur, phosphorus, boron and silicon;

each Ring A is independently an optionally substituted 3-20 membered monocyclic, bicyclic or polycyclic ring having 0-10 heteroatoms independently selected from oxygen, nitrogen, sulfur, phosphorus and silicon; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form there, wherein each variable is independently as described in the present disclosure.

In some embodiments, each BA is independently an optionally substituted $C_{5-30}$ heteroaryl having 1-10 heteroatoms independently selected from oxygen, nitrogen, sulfur, phosphorus and silicon, wherein the heteroaryl comprises one or more heteroatoms selected from oxygen and nitrogen;

each Ring A is independently an optionally substituted 5-10 membered monocyclic or bicyclic saturated ring having 0-5 heteroatoms independently selected from oxygen, nitrogen, sulfur, phosphorus and silicon, wherein the ring comprises at least one oxygen atom; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or salt form thereof, wherein each variable is independently as described in the present disclosure.

In some embodiments, each BA is independently an optionally substituted A, T, C, G, or U, or an optionally substituted tautomer of A, T, C, G, or U;

each Ring A is independently an optionally substituted 5-7 membered monocyclic or bicyclic saturated ring having one or more oxygen atoms; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or salt form thereof, wherein each variable is independently as described in the present disclosure.

In some embodiments, each BA is independently an optionally substituted or protected nucleobase selected from adenine, cytosine, guanosine, thymine, and uracil;

each Ring A is independently an optionally substituted 5-7 membered monocyclic or bicyclic saturated ring having one or more oxygen atoms; and each $L^P$ independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or salt form thereof, wherein each variable is independently as described in the present disclosure.

In some embodiments, $R^{5s}$-$L^s$- is —$CH_2OH$. In some embodiments, $R^{5s}$-$L^s$- is —CH($R^{5s}$)—OH, wherein $R^{5s}$ is as described in the present disclosure.

In some embodiments, BA is an optionally substituted group selected from $C_{3-30}$ cycloaliphatic, $C_{6-30}$ aryl, $C_{5-30}$ heteroaryl having 1-10 heteroatoms independently selected from oxygen, nitrogen, sulfur, phosphorus and silicon, $C_{3-30}$ heterocyclyl having 1-10 heteroatoms independently selected from oxygen, nitrogen, sulfur, phosphorus and silicon, a natural nucleobase moiety, and a modified nucleobase moiety. In some embodiments, BA is an optionally substituted group selected from $C_{5-30}$ heteroaryl having 1-10 heteroatoms independently selected from oxygen, nitrogen, sulfur, phosphorus and silicon, $C_{3-30}$ heterocyclyl having 1-10 heteroatoms independently selected from oxygen, nitrogen, sulfur, phosphorus and silicon, a natural nucleobase moiety, and a modified nucleobase moiety. In some embodiments, BA is an optionally substituted group selected from $C_{5-30}$ heteroaryl having 1-10 heteroatoms independently selected from oxygen, nitrogen, sulfur, phosphorus and silicon, a natural nucleobase moiety, and a modified nucleobase moiety. In some embodiments, BA is optionally substituted $C_{5-30}$ heteroaryl having 1-10 heteroatoms independently selected from oxygen, nitrogen, and sulfur. In some embodiments, BA is optionally substituted natural nucleobases and tautomers thereof. In some embodiments, BA is protected natural nucleobases and tautomers thereof. Various nucleobase protecting groups for oligonucleotide synthesis are known and can be utilized in accordance with the present disclosure. In some embodiments, BA is an optionally substituted nucleobase selected from adenine, cytosine, guanosine, thymine, and uracil, and tautomers thereof. In some embodiments, BA is an optionally protected nucleobase selected from adenine, cytosine, guanosine, thymine, and uracil, and tautomers thereof.

In some embodiments, BA is optionally substituted $C_{3-30}$ cycloaliphatic. In some embodiments, BA is optionally substituted $C_{6-30}$ aryl. In some embodiments, BA is optionally substituted $C_{3-30}$ heterocyclyl. In some embodiments, BA is optionally substituted $C_{5-30}$ heteroaryl. In some embodiments, BA is an optionally substituted natural base moiety. In some embodiments, BA is an optionally substituted modified base moiety. BA is an optionally substituted group selected from $C_{3-30}$ cycloaliphatic, $C_{6-30}$ aryl, $C_{3-30}$ heterocyclyl, and $C_{5-30}$ heteroaryl. In some embodiments, BA is an optionally substituted group selected from $C_{3-30}$ cycloaliphatic, $C_{6-30}$ aryl, $C_{3-30}$ heterocyclyl, $C_{5-30}$ heteroaryl, and a natural nucleobase moiety.

In some embodiments, BA is connected through an aromatic ring. In some embodiments, BA is connected through a heteroatom. In some embodiments, BA is connected through a ring heteroatom of an aromatic ring. In some embodiments, BA is connected through a ring nitrogen atom of an aromatic ring.

In some embodiments, BA is a natural nucleobase moiety. In some embodiments, BA is an optionally substituted natural nucleobase moiety. In some embodiments, BA is a substituted natural nucleobase moiety. In some embodiments, BA is optionally substituted, or an optionally substituted tautomer of, A, T, C, U, or G. In some embodiments, BA is natural nucleobase A, T, C, U, or G. In some embodiments, BA is an optionally substituted group selected from natural nucleobases A, T, C, U, and G.

In some embodiments, BA is an optionally substituted purine base residue. In some embodiments, BA is a protected purine base residue. In some embodiments, BA is an optionally substituted adenine residue. In some embodiments, BA is a protected adenine residue. In some embodiments, BA is an optionally substituted guanine residue. In some embodiments, BA is a protected guanine residue. In some embodiments, BA is an optionally substituted cytosine residue. In some embodiments, BA is a protected cytosine residue. In some embodiments, BA is an optionally substituted thymine residue. In some embodiments, BA is a protected thymine residue. In some embodiments, BA is an optionally substituted uracil residue. In some embodiments, BA is a protected uracil residue. In some embodiments, BA is an optionally substituted 5-methylcytosine residue. In some embodiments, BA is a protected 5-methylcytosine residue.

In some embodiments, s is 0-20. In some embodiments, s is 1-20. In some embodiments, s is 1-5. In some embodiments, s is 1. In some embodiments, s is 2. In some embodiments, s is 3. In some embodiments, s is 4. In some embodiments, s is 5. In some embodiments, s is 6. In some embodiments, s is 7. In some embodiments, s is 8. In some embodiments, s is 9. In some embodiments, s is 10. In some embodiments, s is 11. In some embodiments, s is 12. In some embodiments, s is 13. In some embodiments, s is 14. In some embodiments, s is 15. In some embodiments, s is 16. In some embodiments, s is 17. In some embodiments, s is 18. In some embodiments, s is 19. In some embodiments, s is 20.

In some embodiments, $L^P$ is an internucleotidic linkage. In some embodiments, $L^P$ is an internucleotidic linkage of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof. In some embodiments, $L^P$ is a natural phosphate linkage. In some embodiments, $L^P$ is a non-negatively charged internucleotidic linkage. In some embodiments, $L^P$ is a neutral internucleotidic linkage. In some embodiments, $L^P$ is a negatively-charged internucleotidic linkage. In some embodiments, $L^P$ is a phosphorothioate internucleotidic linkage. In some embodiments, $L^P$ is a chirally controlled internucleotidic linkage.

In some embodiments, z is 1-1000. In some embodiments, z+1 is an oligonucleotide length as described in the present disclosure. In some embodiments, z is 1, 2, 3, 4, 5, 6, 7, 8, 9, 10, 11, 12, 13, 14, 15 to 15, 16, 17, 18, 19, 20, 21, 22, 23, 24, 25, 26, 27, 28, 29, 30, 35, 40, 50, 60, 70, 80, 90, 100, 150, 200, 300, 400, 500, 600, 700, 800, 900 or 1000. In some embodiments, z is 10-100. In some embodiments, z is 10-50. In some embodiments, z is 15-100. In some embodiments, z is 20-50. In some embodiments, z is no less than 4, 5, 6, 7, 8, 9, 10, 11, 12, 13, 14, 15, 16, 17, 18, or 19. In some embodiments, z is no less than 4, 5, 6, 7, 8, 9, 10, 11, 12, 13, or 14. In some embodiments, z is no more than 50, 60, 70, 80, 90, 100, 150, or 200. In some embodiments, z is 5-50, 10-50, 14-50, 14-45, 14-40, 14-35, 14-30, 14-25, 14-100, 14-150, 14-200, 14-250, 14-300, 15-50, 15-45, 15-40, 15-35, 15-30, 15-25, 15-100, 15-150, 15-200, 15-250, 15-300, 16-50, 16-45, 16-40, 16-35, 16-30, 16-25, 16-100, 16-150, 16-200, 16-250, 16-300, 17-50, 17-45, 17-40, 17-35, 17-30, 17-25, 17-100, 17-150, 17-200, 17-250, 17-300, 18-50, 18-45, 18-40, 18-35, 18-30, 18-25, 18-100, 18-150, 18-200, 18-250, 18-300, 19-50, 19-45, 19-40, 19-35, 19-30, 19-25, 19-100, 19-150, 19-200, 19-250, or 19-300. In some embodiments, z is 10. In some embodiments, z is 11. In some embodiments, z is 12. In some embodiments, z is 13. In some embodiments, z is 14. In some embodiments, z is 15. In some embodiments, z is 16. In some embodiments, z is 17. In some embodiments, z is 18. In some embodiments, z is 19. In some embodiments, z is 20. In some embodiments, z is 21. In some embodiments, z is 22. In some embodiments, z is 23. In some embodiments, z is 24. In some embodiments, z is 25. In some embodiments, z is 26. In some embodiments, z is 27. In some embodiments, z is 28. In some embodiments, z is 29. In some embodiments, z is 30. In some embodiments, z is 31. In some embodiments, z is 32. In some embodiments, z is 33. In some embodiments, z is 34.

In some embodiments, $L^{3E}$ is -L- or -L-L-. In some embodiments, $L^{3E}$ is -L-. In some embodiments, $L^{3E}$ is -L-L-. In some embodiments, $L^{3E}$ is a covalent bond. In some embodiments, $L^{3E}$ is a linker used in oligonucleotide synthesis. In some embodiments, $L^{3E}$ is a linker used in solid phase oligonucleotide synthesis. Various types of linkers are known and can be utilized in accordance with the present disclosure. In some embodiments, a linker is a succinate linker (—O—C(O)—$CH_2$—$CH_2$—C(O)—). In some embodiments, a linker is an oxalyl linker (—O—C(O)—C (O)—). In some embodiments, $L^{3E}$ is a succinyl-piperidine linker (SP) linker. In some embodiments, $L^{3E}$ is a succinyl linker. In some embodiments, $L^{3E}$ is a Q-linker. In some embodiments, $L^{3E}$ is —O—.

In some embodiments, $R^{3E}$ is —R', -L-R', —OR', or a solid support. In some 23E is —R as embodiments, $R^{3E}$ is —R' as described in the present disclosure. In some embodiments, $R^{3E}$ described in the present disclosure. In some embodiments, $R^{3E}$ is hydrogen. In some embodiments, $R^{3E}$ is -L-R'. In some embodiments, $R^{3E}$ is —OR'. In some embodiments, $R^{3E}$ is a support for oligonucleotide synthesis. In some embodiments, $R^{3E}$ is a solid support. In some embodiments, a solid support is a CPG support. In some embodiments, a solid support is a polystyrene support. In some embodiments, $R^{3E}$ is —H. In some embodiments, -$L^3$-$R^{3E}$ is —H. In some embodiments, $R^{3E}$ is —OH. In some embodiments, -$L^3$-$R^{3E}$ is —OH. In some embodiments, $R^{3E}$ is optionally substituted $C_{1-6}$ aliphatic. In some embodiments, $R^{3E}$ is optionally substituted $C_{1-6}$ alkyl. In some embodiments, $R^{3E}$ is —OR'. In some embodiments, $R^{3E}$ is —OH. In some embodiments, $R^{3E}$ is —OR', wherein R' is not hydrogen. In some embodiments, $R^{3E}$ is —OR', wherein R' is optionally substituted $C_{1-6}$ alkyl. In some embodiments, $R^{3E}$ is a 3'-end cap (e.g., those used in RNAi technologies).

In some embodiments, $R^{3E}$ is a solid support. In some embodiments, $R^{3E}$ is a solid support for oligonucleotide synthesis. Various types of solid support are known and can be utilized in accordance with the present disclosure. In some embodiments, a solid support is HCP. In some embodiments, a solid support is CPG.

In some embodiments, R' is —R, —C(O)R, —C(O)OR, or —$S(O)_2$R, wherein R is as described in the present disclosure. In some embodiments, R' is R, wherein R is as described in the present disclosure. In some embodiments, R' is —C(O)R, wherein R is as described in the present disclosure. In some embodiments, R' is —C(O)OR, wherein R is as described in the present disclosure. In some embodiments, R' is —$S(O)_2$R, wherein R is as described in the present disclosure. In some embodiments, R' is hydrogen. In some embodiments, R' is not hydrogen. In some embodiments, R' is R, wherein R is optionally substituted $C_{1-20}$ aliphatic as described in the present disclosure. In some embodiments, R' is R, wherein R is optionally substituted $C_{1-20}$ heteroaliphatic as described in the present disclosure. In some embodiments, R' is R, wherein R is optionally substituted $C_{6-20}$ aryl as described in the present disclosure. In some embodiments, R' is R, wherein R is optionally substituted $C_{6-20}$ arylaliphatic as described in the present disclosure. In some embodiments, R' is R, wherein R is optionally substituted $C_{6-20}$ arylheteroaliphatic as described in the present disclosure. In some embodiments, R' is R, wherein R is optionally substituted 5-20 membered heteroaryl as described in the present disclosure. In some embodiments, R' is R, wherein R is optionally substituted 3-20 membered heterocyclyl as described in the present disclosure. In some embodiments, two or more R' are R, and are optionally and independently taken together to form an optionally substituted ring as described in the present disclosure.

In some embodiments, each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered, monocyclic, bicyclic or polycyclic ring having, in addition to the atom, 0-10 heteroatoms independently selected from oxygen, nitrogen, sulfur, phosphorus and silicon; or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms independently selected from oxygen, nitrogen, sulfur, phosphorus and silicon.

In some embodiments, each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered, monocyclic, bicyclic or polycyclic ring having, in addition to the atom, 0-10 heteroatoms independently selected from oxygen, nitrogen, sulfur, phosphorus and silicon.

two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms independently selected from oxygen, nitrogen, sulfur, phosphorus and silicon.

In some embodiments, each R is independently —H, or an optionally substituted group selected from $C_{1-20}$ aliphatic, $C_{1-20}$ heteroaliphatic having 1-10 heteroatoms independently selected from oxygen, nitrogen, sulfur, phosphorus and silicon, $C_{6-20}$ aryl, $C_{6-20}$ arylaliphatic, $C_{6-20}$ arylheteroaliphatic having 1-10 heteroatoms independently selected from oxygen, nitrogen, sulfur, phosphorus and silicon, 5-20 membered heteroaryl having 1-10 heteroatoms independently selected from oxygen, nitrogen, sulfur, phosphorus and silicon, and 3-20 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-20 membered monocyclic, bicyclic or polycyclic ring having, in addition to the atom, 0-10 heteroatoms independently selected from oxygen, nitrogen, sulfur, phosphorus and silicon.

two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms independently selected from oxygen, nitrogen, sulfur, phosphorus and silicon.

In some embodiments, each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon.

In some embodiments, each R is independently —H, or an optionally substituted group selected from $C_{1-20}$ aliphatic, $C_{1-20}$ heteroaliphatic having 1-10 heteroatoms independently selected from oxygen, nitrogen, sulfur, phosphorus and silicon, $C_{6-20}$ aryl, $C_{6-20}$ arylaliphatic, $C_{6-20}$ arylheteroaliphatic having 1-10 heteroatoms independently selected from oxygen, nitrogen, sulfur, phosphorus and silicon, 5-20 membered heteroaryl having 1-10 heteroatoms independently selected from oxygen, nitrogen, sulfur, phosphorus and silicon, and 3-20 membered heterocyclyl having 1-10 heteroatoms independently selected from oxygen, nitrogen, sulfur, phosphorus and silicon.

In some embodiments, R is hydrogen. In some embodiments, R is not hydrogen. In some embodiments, R is an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, a 5-30 membered heteroaryl ring having 1-10 heteroatoms independently selected from oxygen, nitrogen, sulfur, phosphorus and silicon, and a 3-30 membered heterocyclic ring having 1-10 heteroatoms independently selected from oxygen, nitrogen, sulfur, phosphorus and silicon.

In some embodiments, R is hydrogen or an optionally substituted group selected from $C_{1-20}$ aliphatic, phenyl, a 3-7 membered saturated or partially unsaturated carbocyclic ring, an 8-10 membered bicyclic saturated, partially unsaturated or aryl ring, a 5-6 membered monocyclic heteroaryl ring having 1-4 heteroatoms independently selected from nitrogen, oxygen, and sulfur, a 4-7 membered saturated or partially unsaturated heterocyclic ring having 1-3 heteroatoms independently selected from nitrogen, oxygen, and sulfur, a 7-10 membered bicyclic saturated or partially unsaturated heterocyclic ring having 1-5 heteroatoms independently selected from nitrogen, oxygen, and sulfur, or an 8-10 membered bicyclic heteroaryl ring having 1-5 heteroatoms independently selected from nitrogen, oxygen, and sulfur.

In some embodiments, R is optionally substituted $C_{1-30}$ aliphatic. In some embodiments, R is optionally substituted $C_{1-20}$ aliphatic. In some embodiments, R is optionally substituted $C_{1-15}$ aliphatic. In some embodiments, R is optionally substituted $C_{1-10}$ aliphatic. In some embodiments, R is optionally substituted $C_{1-6}$ aliphatic. In some embodiments, R is optionally substituted $C_{1-6}$ alkyl. In some embodiments, R is optionally substituted hexyl, pentyl, butyl, propyl, ethyl or methyl. In some embodiments, R is optionally substituted hexyl. In some embodiments, R is optionally substituted pentyl. In some embodiments, R is optionally substituted butyl. In some embodiments, R is optionally substituted propyl. In some embodiments, R is optionally substituted ethyl. In some embodiments, R is optionally substituted methyl. In some embodiments, R is hexyl. In some embodiments, R is pentyl. In some embodiments, R is butyl. In some embodiments, R is propyl. In some embodiments, R is ethyl. In some embodiments, R is methyl. In some embodiments, R is isopropyl. In some embodiments, R is n-propyl. In some embodiments, R is tert-butyl. In some embodiments, R is sec-butyl. In some embodiments, R is n-butyl. In some embodiments, R is $—(CH_2)_2CN$.

In some embodiments, R is optionally substituted $C_{3-30}$ cycloaliphatic. In some embodiments, R is optionally substituted $C_{3-20}$ cycloaliphatic. In some embodiments, R is optionally substituted $C_{3-10}$ cycloaliphatic. In some embodiments, R is optionally substituted cyclohexyl. In some embodiments, R is cyclohexyl. In some embodiments, R is optionally substituted cyclopentyl. In some embodiments, R is cyclopentyl. In some embodiments, R is optionally substituted cyclobutyl. In some embodiments, R is cyclobutyl. In some embodiments, R is optionally substituted cyclopropyl. In some embodiments, R is cyclopropyl.

In some embodiments, R is an optionally substituted 3-30 membered saturated or partially unsaturated carbocyclic ring. In some embodiments, R is an optionally substituted 3-7 membered saturated or partially unsaturated carbocyclic ring. In some embodiments, R is an optionally substituted 3-membered saturated or partially unsaturated carbocyclic ring. In some embodiments, R is an optionally substituted 4-membered saturated or partially unsaturated carbocyclic ring. In some embodiments, R is an optionally substituted 5-membered saturated or partially unsaturated carbocyclic ring. In some embodiments, R is an optionally substituted 6-membered saturated or partially unsaturated carbocyclic ring. In some embodiments, R is an optionally substituted 7-membered saturated or partially unsaturated carbocyclic ring. In some embodiments, R is optionally substituted cycloheptyl. In some embodiments, R is cycloheptyl. In some embodiments, R is optionally substituted cyclohexyl. In some embodiments, R is cyclohexyl. In some embodiments, R is optionally substituted cyclopentyl. In some embodiments, R is cyclopentyl. In some embodiments, R is optionally substituted cyclobutyl. In some embodiments, R is cyclobutyl. In some embodiments, R is optionally substituted cyclopropyl. In some embodiments, R is cyclopropyl.

In some embodiments, when R is or comprises a ring structure, e.g., cycloaliphatic, cycloheteroaliphatic, aryl, heteroaryl, etc., the ring structure can be monocyclic, bicyclic or polycyclic. In some embodiments, R is or comprises a monocyclic structure. In some embodiments, R is or comprises a bicyclic structure. In some embodiments, R is or comprises a polycyclic structure.

In some embodiments, R is optionally substituted $C_{1-30}$ heteroaliphatic having 1-10 heteroatoms independently selected from oxygen, nitrogen, sulfur, phosphorus and silicon. In some embodiments, R is optionally substituted $C_{1-20}$ heteroaliphatic having 1-10 heteroatoms. In some embodiments, R is optionally substituted $C_{1-20}$ heteroaliphatic having 1-10 heteroatoms independently selected from oxygen, nitrogen, sulfur, phosphorus or silicon, optionally including one or more oxidized forms of nitrogen, sulfur, phosphorus or selenium. In some embodiments, R is optionally substituted $C_{1-30}$ heteroaliphatic comprising 1-10 groups independently selected from

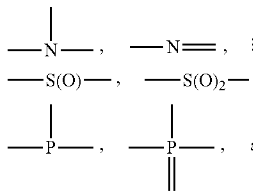

and

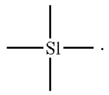

In some embodiments, R is optionally substituted $C_{6-30}$ aryl. In some embodiments, R is optionally substituted phenyl. In some embodiments, R is phenyl. In some embodiments, R is substituted phenyl.

In some embodiments, R is an optionally substituted 8-10 membered bicyclic saturated, partially unsaturated or aryl ring. In some embodiments, R is an optionally substituted 8-10 membered bicyclic saturated ring. In some embodiments, R is an optionally substituted 8-10 membered bicyclic partially unsaturated ring. In some embodiments, R is an optionally substituted 8-10 membered bicyclic aryl ring. In some embodiments, R is optionally substituted naphthyl.

In some embodiments, R is optionally substituted 5-30 membered heteroaryl ring having 1-10 heteroatoms independently selected from oxygen, nitrogen, sulfur, phosphorus and silicon. In some embodiments, R is optionally substituted 5-30 membered heteroaryl ring having 1-10 heteroatoms independently selected from oxygen, nitrogen, and sulfur. In some embodiments, R is optionally substituted 5-30 membered heteroaryl ring having 1-5 heteroatoms independently selected from oxygen, nitrogen, sulfur, phosphorus and silicon. In some embodiments, R is optionally substituted 5-30 membered heteroaryl ring having 1-5 heteroatoms independently selected from oxygen, nitrogen, and sulfur.

In some embodiments, R is an optionally substituted 5-6 membered monocyclic heteroaryl ring having 1-4 heteroatoms independently selected from nitrogen, oxygen, and sulfur. In some embodiments, R is a substituted 5-6 membered monocyclic heteroaryl ring having 1-4 heteroatoms independently selected from nitrogen, oxygen, and sulfur. In some embodiments, R is an unsubstituted 5-6 membered monocyclic heteroaryl ring having 1-4 heteroatoms independently selected from nitrogen, oxygen, and sulfur. In some embodiments, R is an optionally substituted 5-6 membered monocyclic heteroaryl ring having 1-3 heteroatoms independently selected from nitrogen, sulfur, and oxygen. In some embodiments, R is a substituted 5-6 membered monocyclic heteroaryl ring having 1-3 heteroatoms independently selected from nitrogen, oxygen, and sulfur. In some embodiments, R is an unsubstituted 5-6 membered monocyclic heteroaryl ring having 1-3 heteroatoms independently selected from nitrogen, sulfur, and oxygen.

In some embodiments, R is an optionally substituted 5-membered monocyclic heteroaryl ring having 1-4 heteroatoms independently selected from nitrogen, oxygen or sulfur. In some embodiments, R is an optionally substituted 6-membered monocyclic heteroaryl ring having 1-4 heteroatoms independently selected from nitrogen, oxygen, and sulfur.

In some embodiments, R is an optionally substituted 5-membered monocyclic heteroaryl ring having one heteroatom selected from nitrogen, oxygen, and sulfur. In some embodiments, R is selected from optionally substituted pyrrolyl, furanyl, or thienyl.

In some embodiments, R is an optionally substituted 5-membered heteroaryl ring having two heteroatoms independently selected from nitrogen, oxygen, and sulfur. In certain embodiments, R is an optionally substituted 5-membered heteroaryl ring having one nitrogen atom, and an additional heteroatom selected from sulfur or oxygen. Example R groups include but are not limited to optionally substituted pyrazolyl, imidazolyl, thiazolyl, isothiazolyl, oxazolyl or isoxazolyl.

In some embodiments, R is an optionally substituted 5-membered heteroaryl ring having three heteroatoms independently selected from nitrogen, oxygen, and sulfur. Example R groups include but are not limited to optionally substituted triazolyl, oxadiazolyl or thiadiazolyl.

In some embodiments, R is an optionally substituted 5-membered heteroaryl ring having four heteroatoms independently selected from nitrogen, oxygen, and sulfur. Example R groups include but are not limited to optionally substituted tetrazolyl, oxatriazolyl and thiatriazolyl.

In some embodiments, R is an optionally substituted 6-membered heteroaryl ring having 1-4 nitrogen atoms. In some embodiments, R is an optionally substituted 6-membered heteroaryl ring having 1-3 nitrogen atoms. In other embodiments, R is an optionally substituted 6-membered heteroaryl ring having 1-2 nitrogen atoms. In some embodiments, R is an optionally substituted 6-membered heteroaryl ring having four nitrogen atoms. In some embodiments, R is an optionally substituted 6-membered heteroaryl ring having three nitrogen atoms. In some embodiments, R is an optionally substituted 6-membered heteroaryl ring having two nitrogen atoms. In certain embodiments, R is an optionally substituted 6-membered heteroaryl ring having one nitrogen atom. Example R groups include but are not limited to optionally substituted pyridinyl, pyrimidinyl, pyrazinyl, pyridazinyl, triazinyl, or tetrazinyl.

In certain embodiments, R is an optionally substituted 8-10 membered bicyclic heteroaryl ring having 1-4 heteroatoms independently selected from nitrogen, oxygen, and sulfur. In some embodiments, R is an optionally substituted 5,6-fused heteroaryl ring having 1-4 heteroatoms independently selected from nitrogen, oxygen, and sulfur. In other embodiments, R is an optionally substituted 5,6-fused heteroaryl ring having 1-2 heteroatoms independently selected from nitrogen, oxygen, and sulfur. In certain embodiments, R is an optionally substituted 5,6-fused heteroaryl ring having 1 heteroatom independently selected from nitrogen, oxygen, and sulfur. In some embodiments, R is an optionally substituted indolyl. In some embodiments, R is an optionally substituted azabicyclo[3.2.1]octanyl. In certain embodiments, R is an optionally substituted 5,6-fused heteroaryl ring having 2 heteroatoms independently selected from nitrogen, oxygen, and sulfur. In some embodiments, R is an optionally substituted azaindolyl. In some embodiments, R is an optionally substituted benzimidazolyl. In some embodiments, R is an optionally substituted benzothiazolyl. In some embodiments, R is an optionally substituted benzoxazolyl. In some embodiments, R is an optionally substituted indazolyl. In certain embodiments, R is an optionally substituted 5,6-fused heteroaryl ring having 3 heteroatoms independently selected from nitrogen, oxygen, and sulfur.

In some embodiments, R is an optionally substituted 5,6-fused heteroaryl ring having 1-5 heteroatoms independently selected from nitrogen, oxygen, and sulfur. In some embodiments, R is an optionally substituted 5,6-fused heteroaryl ring having 1-4 heteroatoms independently selected from nitrogen, oxygen, and sulfur. In some embodiments, R is an optionally substituted 5,6-fused heteroaryl ring having 1-3 heteroatoms independently selected from nitrogen, oxygen, and sulfur. In some embodiments, R is an optionally substituted 5,6-fused heteroaryl ring having two heteroatoms independently selected from nitrogen, oxygen, and sulfur. In some embodiments, R is an optionally substituted 5,6-fused heteroaryl ring having three heteroatoms independently selected from nitrogen, oxygen, and sulfur. In some embodiments, R is an optionally substituted 5,6-fused heteroaryl ring having four heteroatoms independently selected from nitrogen, oxygen, and sulfur. In some embodiments, R is an optionally substituted 5,6-fused heteroaryl ring having five heteroatoms independently selected from nitrogen, oxygen, and sulfur.

In certain embodiments, R is an optionally substituted 5,6-fused heteroaryl ring having one heteroatom independently selected from nitrogen, oxygen, and sulfur. In some embodiments, R is optionally substituted indolyl. In some embodiments, R is optionally substituted benzofuranyl. In some embodiments, R is optionally substituted benzo[b]thienyl. In certain embodiments, R is an optionally substituted 5,6-fused heteroaryl ring having two heteroatoms independently selected from nitrogen, oxygen, and sulfur. In some embodiments, R is optionally substituted azaindolyl. In some embodiments, R is optionally substituted benzimidazolyl. In some embodiments, R is optionally substituted benzothiazolyl. In some embodiments, R is optionally substituted benzoxazolyl. In some embodiments, R is an optionally substituted indazolyl. In certain embodiments, R is an optionally substituted 5,6-fused heteroaryl ring having three heteroatoms independently selected from nitrogen, oxygen, and sulfur. In some embodiments, R is optionally substituted oxazolopyridiyl, thiazolopyridinyl or imidazopyridinyl. In certain embodiments, R is an optionally substituted 5,6-fused heteroaryl ring having four heteroatoms independently selected from nitrogen, oxygen, and sulfur. In some embodiments, R is optionally substituted purinyl, oxazolopyrimidinyl, thiazolopyrimidinyl, oxazolopyrazinyl, thiazolopyrazinyl, imidazopyrazinyl, oxazolopyridazinyl, thiazolopyridazinyl or imidazopyridazinyl. In certain embodiments, R is an optionally substituted 5,6-fused heteroaryl ring having five heteroatoms independently selected from nitrogen, oxygen, and sulfur.

In some embodiments, R is optionally substituted 1,4-dihydropyrrolo[3,2-b]pyrrolyl, 4H-furo [3,2-b]pyrrolyl, 4H-thieno[3,2-b]pyrrolyl, furo[3,2-b]furanyl, thieno[3,2-b]furanyl, thieno[3,2-b]thienyl, 1H-pyrrolo[1,2-a]imidazolyl, pyrrolo[2,1-b]oxazolyl or pyrrolo[2,1-b]thiazolyl. In some embodiments, R is optionally substituted dihydropyrroloimidazolyl, 1H-furoimidazolyl, 1H-thienoimidazolyl, furooxazolyl, furoisoxazolyl, 4H-pyrrolooxazolyl, 4H-pyrroloisoxazolyl, thienooxazolyl, thienoisoxazolyl, 4H-pyrrolothiazolyl, furothiazolyl, thienothiazolyl, 1H-imidazoimidazolyl, imidazooxazolyl or imidazo[5,1-b]thiazolyl.

In certain embodiments, R is an optionally substituted 6,6-fused heteroaryl ring having 1-4 heteroatoms independently selected from nitrogen, oxygen, and sulfur. In some embodiments, R is an optionally substituted 6,6-fused heteroaryl ring having 1-2 heteroatoms independently selected from nitrogen, oxygen, and sulfur. In other embodiments, R is an optionally substituted 6,6-fused heteroaryl ring having 1 heteroatom independently selected from nitrogen, oxygen, and sulfur. In some embodiments, R is an optionally substituted quinolinyl. In some embodiments, R is an optionally substituted isoquinolinyl. In some embodiments, R is an optionally substituted 6,6-fused heteroaryl ring having 2 heteroatoms independently selected from nitrogen, oxygen, and sulfur. In some embodiments, R is optionally substituted quinazoline or a quinoxaline.

In some embodiments, R is 3-30 membered heterocyclic ring having 1-10 heteroatoms independently selected from oxygen, nitrogen, sulfur, phosphorus and silicon. In some embodiments, R is 3-30 membered heterocyclic ring having 1-10 heteroatoms independently selected from oxygen, nitrogen, and sulfur. In some embodiments, R is 3-30 membered heterocyclic ring having 1-5 heteroatoms independently selected from oxygen, nitrogen, sulfur, phosphorus and silicon. In some embodiments, R is 3-30 membered heterocyclic ring having 1-5 heteroatoms independently selected from oxygen, nitrogen, and sulfur.

In some embodiments, R is an optionally substituted 3-7 membered saturated or partially unsaturated heterocyclic ring having 1-3 heteroatoms independently selected from nitrogen, oxygen, and sulfur. In some embodiments, R is a substituted 3-7 membered saturated or partially unsaturated heterocyclic ring having 1-3 heteroatoms independently selected from nitrogen, oxygen, and sulfur. In some embodiments, R is an unsubstituted 3-7 membered saturated or partially unsaturated heterocyclic ring having 1-3 heteroatoms independently selected from nitrogen, oxygen, and sulfur. In certain embodiments, R is an optionally substituted 5-7 membered partially unsaturated monocyclic ring having 1-3 heteroatoms independently selected from nitrogen, oxygen, and sulfur. In certain embodiments, R is an optionally substituted 5-6 membered partially unsaturated monocyclic ring having 1-3 heteroatoms independently selected from nitrogen, oxygen, and sulfur. In certain embodiments, R is an optionally substituted 5-membered partially unsaturated monocyclic ring having 1-3 heteroatoms independently selected from nitrogen, oxygen, and sulfur. In certain embodiments, R is an optionally substituted 6-membered partially unsaturated monocyclic ring having 1-3 heteroatoms independently selected from nitrogen, oxygen, and sulfur. In certain embodiments, R is an optionally substituted 7-membered partially unsaturated monocyclic ring having 1-3 heteroatoms independently selected from nitrogen, oxygen, and sulfur. In some embodiments, R is optionally substituted 3-membered heterocyclic ring having one heteroatom selected from nitrogen, oxygen or sulfur. In some embodiments, R is optionally substituted 4-membered heterocyclic ring having 1-3 heteroatoms independently selected from nitrogen, oxygen, and sulfur. In some embodiments, R is optionally substituted 5-membered heterocyclic ring having 1-3 heteroatoms independently selected from nitrogen, oxygen, and sulfur. In some embodiments, R is optionally substituted 6-membered heterocyclic ring having 1-3 heteroatoms independently selected from nitrogen, oxygen, and sulfur. In some embodiments, R is optionally substituted 7-membered heterocyclic ring having 1-3 heteroatoms independently selected from nitrogen, oxygen, and sulfur.

In some embodiments, R is an optionally substituted 3-membered saturated or partially unsaturated heterocyclic ring having 1-2 heteroatoms independently selected from nitrogen, oxygen, and sulfur. In some embodiments, R is an optionally substituted 4-membered saturated or partially unsaturated heterocyclic ring having 1-2 heteroatoms independently selected from nitrogen, oxygen, and sulfur. In some embodiments, R is an optionally substituted 5-membered saturated or partially unsaturated heterocyclic ring having 1-2 heteroatoms independently selected from nitrogen, oxygen, and sulfur. In some embodiments, R is an optionally substituted 6-membered saturated or partially unsaturated heterocyclic ring having 1-2 heteroatoms independently selected from nitrogen, oxygen, and sulfur. In some embodiments, R is an optionally substituted 7-membered saturated or partially unsaturated heterocyclic ring having 1-2 heteroatoms independently selected from nitrogen, oxygen, and sulfur.

In some embodiments, R is an optionally substituted 4-membered saturated or partially unsaturated heterocyclic ring having 1-2 heteroatoms independently selected from nitrogen, oxygen, and sulfur. In some embodiments, R is an optionally substituted 4-membered partially unsaturated heterocyclic ring having 2 heteroatoms independently selected from nitrogen, oxygen, and sulfur. In some embodiments, R is an optionally substituted 4-membered partially unsaturated heterocyclic ring having no more than 1 heteroatom. In some embodiments, R is an optionally substituted 4-membered partially unsaturated heterocyclic ring having no more than 1 heteroatom, wherein the heteroatom is nitrogen. In some embodiments, R is an optionally substituted 4-membered partially unsaturated heterocyclic ring having no more than 1 heteroatom, wherein the heteroatom is oxygen. In some embodiments, R is an optionally substituted 4-membered partially unsaturated heterocyclic ring having no more than 1 heteroatom, wherein the heteroatom is sulfur. In some embodiments, R is an optionally substituted 4-membered partially unsaturated heterocyclic ring having 2 oxygen atoms. In some embodiments, R is an optionally substituted 4-membered partially unsaturated heterocyclic ring having 2 nitrogen atoms. In some embodiments, R is an optionally substituted 4-membered saturated or partially unsaturated heterocyclic ring having 1-2 heteroatoms independently selected from nitrogen, oxygen, and sulfur. In some embodiments, R is an optionally substituted 4-membered partially unsaturated heterocyclic ring having 2 heteroatoms independently selected from nitrogen, oxygen, and sulfur. In some embodiments, R is an optionally substituted 4-membered partially unsaturated heterocyclic ring having no more than 1 heteroatom. In some embodiments, R is an optionally substituted 4-membered partially unsaturated heterocyclic ring having no more than 1 heteroatom, wherein the heteroatom is nitrogen. In some embodiments, R is an optionally substituted 4-membered partially unsaturated heterocyclic ring having no more than 1 heteroatom, wherein the heteroatom is oxygen. In some embodiments, R is an optionally substituted 4-membered partially unsaturated heterocyclic ring having no more than 1 heteroatom, wherein the heteroatom is sulfur. In some embodiments, R is an optionally substituted 4-membered partially unsaturated heterocyclic ring having 2 oxygen atoms. In some embodiments, R is an optionally substituted 4-membered partially unsaturated heterocyclic ring having 2 nitrogen atoms.

In some embodiments, R is an optionally substituted 5-membered saturated or partially unsaturated heterocyclic ring having 1-2 heteroatoms independently selected from nitrogen, oxygen, and sulfur. In some embodiments, R is an optionally substituted 5-membered partially unsaturated heterocyclic ring having 2 heteroatoms independently selected from nitrogen, oxygen, and sulfur. In some embodiments, R is an optionally substituted 5-membered partially unsaturated heterocyclic ring having no more than 1 heteroatom. In some embodiments, R is an optionally substituted 5-membered partially unsaturated heterocyclic ring having no more than 1 heteroatom, wherein the heteroatom is nitrogen. In some embodiments, R is an optionally substituted 5-membered partially unsaturated heterocyclic ring having no more than 1 heteroatom, wherein the heteroatom is oxygen. In some embodiments, R is an optionally substituted 5-membered partially unsaturated heterocyclic ring having no more than 1 heteroatom, wherein the heteroatom is sulfur. In some embodiments, R is an optionally substituted 5-membered partially unsaturated heterocyclic ring having 2 oxygen atoms. In some embodiments, R is an optionally substituted 5-membered partially unsaturated heterocyclic ring having 2 nitrogen atoms.

In some embodiments, R is an optionally substituted 6-membered saturated or partially unsaturated heterocyclic ring having 1-2 heteroatoms independently selected from nitrogen, oxygen, and sulfur. In some embodiments, R is an optionally substituted 6-membered partially unsaturated heterocyclic ring having 2 heteroatoms independently selected from nitrogen, oxygen, and sulfur. In some embodiments, R is an optionally substituted 6-membered partially unsaturated heterocyclic ring having no more than 1 heteroatom. In some embodiments, R is an optionally substituted 6-membered partially unsaturated heterocyclic ring having no more than 1 heteroatom, wherein the heteroatom is nitrogen. In some embodiments, R is an optionally substituted 6-membered partially unsaturated heterocyclic ring having no more than 1 heteroatom, wherein the heteroatom is oxygen. In some embodiments, R is an optionally substituted 6-membered partially unsaturated heterocyclic ring having no more than 1 heteroatom, wherein the heteroatom is sulfur. In some embodiments, R is an optionally substituted 6-membered partially unsaturated heterocyclic ring having 2 oxygen atoms. In some embodiments, R is an optionally substituted 6-membered partially unsaturated heterocyclic ring having 2 nitrogen atoms.

In certain embodiments, R is a 3-7 membered saturated or partially unsaturated heterocyclic ring having 1-2 heteroatoms independently selected from nitrogen, oxygen, and sulfur. In certain embodiments, R is optionally substituted oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl.

In certain embodiments, R is an optionally substituted 5-6 membered partially unsaturated monocyclic ring having 1-2 heteroatoms independently selected from nitrogen, oxygen, and sulfur. In certain embodiments, R is an optionally substituted tetrahydropyridinyl, dihydrothiazolyl, dihydrooxazolyl, or oxazolinyl group.

In some embodiments, R is an optionally substituted 7-10 membered bicyclic saturated or partially unsaturated heterocyclic ring having 1-5 heteroatoms independently selected from nitrogen, oxygen, and sulfur. In some embodiments, R is optionally substituted indolinyl. In some embodiments, R is optionally substituted isoindolinyl. In some embodiments, R is optionally substituted 1, 2, 3, 4-tetrahydroquinolinyl. In some embodiments, R is optionally substituted 1, 2, 3, 4-tetrahydroisoquinolinyl. In some embodiments, R is an optionally substituted azabicyclo[3.2.1]octanyl.

In some embodiments, R is an optionally substituted 8-10 membered bicyclic heteroaryl ring having 1-5 heteroatoms independently selected from nitrogen, oxygen, and sulfur.

In some embodiments, R is an optionally substituted 5,6-fused heteroaryl ring having 1-5 heteroatoms independently selected from nitrogen, oxygen, and sulfur. In some embodiments, R is an optionally substituted 5,6-fused heteroaryl ring having 1-4 heteroatoms independently selected from nitrogen, oxygen, and sulfur. In some embodiments, R is an optionally substituted 5,6-fused heteroaryl ring having 1-3 heteroatoms independently selected from nitrogen, oxygen, and sulfur. In some embodiments, R is an optionally substituted 5,6-fused heteroaryl ring having two heteroatoms independently selected from nitrogen, oxygen, and sulfur. In some embodiments, R is optionally substituted 1,4-dihydropyrrolo[3,2-b]pyrrolyl, 4H-furo[3,2-b]pyrrolyl, 4H-thieno[3,2-b]pyrrolyl, furo[3,2-b]furanyl, thieno[3,2-b]furanyl, thieno[3,2-b]thienyl, 1H-pyrrolo[1,2-a]imidazolyl, pyrrolo[2,1-b]oxazolyl or pyrrolo[2,1-b]thiazolyl. In some embodiments, R is an optionally substituted 5,6-fused heteroaryl ring having three heteroatoms independently selected from nitrogen, oxygen, and sulfur. In some embodiments, R is optionally substituted dihydropyrroloimidazolyl, 1H-furoimidazolyl, 1H-thienoimidazolyl, furooxazolyl, furoisoxazolyl, 4H-pyrrolooxazolyl, 4H-pyrroloisoxazolyl, thienooxazolyl, thienoisoxazolyl, 4H-pyrrolothiazolyl, furothiazolyl, thienothiazolyl, 1H-imidazoimidazolyl, imidazooxazolyl or imidazo[5,1-b]thiazolyl. In some embodiments, R is an optionally substituted 5,6-fused heteroaryl ring having four heteroatoms independently selected from nitrogen, oxygen, and sulfur. In some embodiments, R is an optionally substituted 5,6-fused heteroaryl ring having five heteroatoms independently selected from nitrogen, oxygen, and sulfur.

In some embodiments, R is an optionally substituted 5,6-fused heteroaryl ring having 1-5 heteroatoms independently selected from nitrogen, oxygen, and sulfur. In other embodiments, R is an optionally substituted 5,6-fused heteroaryl ring having 1-2 heteroatoms independently selected from nitrogen, oxygen, and sulfur. In certain embodiments, R is an optionally substituted 5,6-fused heteroaryl ring having one heteroatom independently selected from nitrogen, oxygen, and sulfur. In some embodiments, R is optionally substituted indolyl. In some embodiments, R is optionally substituted benzofuranyl. In some embodiments, R is optionally substituted benzo[b]thienyl. In certain embodiments, R is an optionally substituted 5,6-fused heteroaryl ring having two heteroatoms independently selected from nitrogen, oxygen, and sulfur. In some embodiments, R is optionally substituted azaindolyl. In some embodiments, R is optionally substituted benzimidazolyl. In some embodiments, R is optionally substituted benzothiazolyl. In some embodiments, R is optionally substituted benzoxazolyl. In some embodiments, R is an optionally substituted indazolyl. In certain embodiments, R is an optionally substituted 5,6-fused heteroaryl ring having three heteroatoms independently selected from nitrogen, oxygen, and sulfur. In some embodiments, R is optionally substituted oxazolopyridiyl, thiazolopyridinyl or imidazopyridinyl. In certain embodiments, R is an optionally substituted 5,6-fused heteroaryl ring having four heteroatoms independently selected from nitrogen, oxygen, and sulfur. In some embodiments, R is optionally substituted purinyl, oxazolopyrimidinyl, thiazolopyrimidinyl, oxazolopyrazinyl, thiazolopyrazinyl, imidazopyrazinyl, oxazolopyridazinyl, thiazolopyridazinyl or imidazopyridazinyl. In certain embodiments, R is an optionally substituted 5,6-fused heteroaryl ring having five heteroatoms independently selected from nitrogen, oxygen, and sulfur.

In certain embodiments, R is an optionally substituted 6,6-fused heteroaryl ring having 1-5 heteroatoms independently selected from nitrogen, oxygen, and sulfur. In some embodiments, R is an optionally substituted 6,6-fused heteroaryl ring having 1-2 heteroatoms independently selected from nitrogen, oxygen, and sulfur. In other embodiments, R is an optionally substituted 6,6-fused heteroaryl ring having one heteroatom selected from nitrogen, oxygen, and sulfur. In some embodiments, R is optionally substituted quinolinyl. In some embodiments, R is optionally substituted isoquinolinyl. In some embodiments, R is an optionally substituted 6,6-fused heteroaryl ring having two heteroatoms independently selected from nitrogen, oxygen, and sulfur. In some embodiments, R is optionally substituted quinazolinyl, phthalazinyl, quinoxalinyl or naphthyridinyl. In some embodiments, R is an optionally substituted 6,6-fused heteroaryl ring having three heteroatoms independently selected from nitrogen, oxygen, and sulfur. In some embodiments, R is optionally substituted pyridopyrimidinyl, pyridopyridazinyl, pyridopyrazinyl, or benzotriazinyl. In some embodiments, R is an optionally substituted 6,6-fused heteroaryl ring having four heteroatoms independently selected from nitrogen, oxygen, and sulfur. In some embodiments, R is optionally substituted pyridotriazinyl, pteridinyl, pyrazinopyrazinyl, pyrazinopyridazinyl, pyridazinopyridazinyl, pyrimidopyridazinyl or pyrimidopyrimidinyl. In some embodiments, R is an optionally substituted 6,6-fused heteroaryl ring having five heteroatoms independently selected from nitrogen, oxygen, and sulfur.

In some embodiments, R is optionally substituted $C_{6-30}$ arylaliphatic. In some embodiments, R is optionally substituted $C_{6-20}$ arylaliphatic. In some embodiments, R is optionally substituted $C_{6-10}$ arylaliphatic. In some embodiments, an aryl moiety of the arylaliphatic has 6, 10, or 14 aryl carbon atoms. In some embodiments, an aryl moiety of the arylaliphatic has 6 aryl carbon atoms. In some embodiments, an aryl moiety of the arylaliphatic has 10 aryl carbon atoms. In some embodiments, an aryl moiety of the arylaliphatic has 14 aryl carbon atoms. In some embodiments, an aryl moiety is optionally substituted phenyl.

In some embodiments, R is optionally substituted $C_{6-30}$ arylheteroaliphatic having 1-10 heteroatoms independently selected from oxygen, nitrogen, sulfur, phosphorus and silicon. In some embodiments, R is optionally substituted $C_{6-30}$ arylheteroaliphatic having 1-10 heteroatoms independently selected from oxygen, nitrogen, and sulfur. In some embodiments, R is optionally substituted $C_{6-20}$ arylheteroaliphatic having 1-10 heteroatoms independently selected from oxygen, nitrogen, sulfur, phosphorus and silicon. In some embodiments, R is optionally substituted $C_{6-20}$ arylheteroaliphatic having 1-10 heteroatoms independently selected from oxygen, nitrogen, and sulfur. In some embodiments, R is optionally substituted $C_{6-10}$ arylheteroaliphatic having 1-5 heteroatoms independently selected from oxygen, nitrogen, sulfur, phosphorus and silicon. In some embodiments, R is optionally substituted $C_{6-10}$ arylheteroaliphatic having 1-5 heteroatoms independently selected from oxygen, nitrogen, and sulfur.

In some embodiments, two R groups are optionally and independently taken together to form a covalent bond. In some embodiments, —C═O is formed. In some embodiments, —C═C— is formed. In some embodiments, —C≡C— is formed.

In some embodiments, two or more R groups on the same atom are optionally and independently taken together with the atom to form an optionally substituted, 3-30 membered, monocyclic, bicyclic or polycyclic ring having, in addition to the atom, 0-10 heteroatoms independently selected from oxygen, nitrogen, sulfur, phosphorus and silicon. In some embodiments, two or more R groups on the same atom are optionally and independently taken together with the atom to form an optionally substituted, 3-20 membered monocyclic, bicyclic or polycyclic ring having, in addition to the atom, 0-10 heteroatoms independently selected from oxygen, nitrogen, sulfur, phosphorus and silicon. In some embodiments, two or more R groups on the same atom are optionally and independently taken together with the atom to form an optionally substituted, 3-10 membered monocyclic, bicyclic or polycyclic ring having, in addition to the atom, 0-5 heteroatoms independently selected from oxygen, nitrogen, sulfur, phosphorus and silicon. In some embodiments, two or more R groups on the same atom are optionally and independently taken together with the atom to form an optionally substituted, 3-6 membered monocyclic, bicyclic or polycyclic ring having, in addition to the atom, 0-3 heteroatoms independently selected from oxygen, nitrogen, sulfur, phosphorus and silicon. In some embodiments, two or more R groups on the same atom are optionally and independently taken together with the atom to form an optionally substituted, 3-5 membered monocyclic, bicyclic or polycyclic ring having, in addition to the atom, 0-3 heteroatoms independently selected from oxygen, nitrogen, sulfur, phosphorus and silicon.

In some embodiments, two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms independently selected from oxygen, nitrogen, sulfur, phosphorus and silicon. In some embodiments, two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms independently selected from oxygen, nitrogen, sulfur, phosphorus and silicon. In some embodiments, two or more R groups on two or more atoms are optionally and independently taken together with their intervening atoms to form an optionally substituted, 3-10 membered monocyclic, bicyclic or polycyclic ring having, in addition to the intervening atoms, 0-10 heteroatoms independently selected from oxygen, nitrogen, sulfur, phosphorus and silicon. In some embodiments, two or more R groups on two or more atoms are optionally and independently taken together with their intervening atoms to form an optionally substituted, 3-10 membered monocyclic, bicyclic or polycyclic ring having, in addition to the intervening atoms, 0-5 heteroatoms independently selected from oxygen, nitrogen, sulfur, phosphorus and silicon. In some embodiments, two or more R groups on two or more atoms are optionally and independently taken together with their intervening atoms to form an optionally substituted, 3-6 membered monocyclic, bicyclic or polycyclic ring having, in addition to the intervening atoms, 0-3 heteroatoms independently selected from oxygen, nitrogen, sulfur, phosphorus and silicon. In some embodiments, two or more R groups on two or more atoms are optionally and independently taken together with their intervening atoms to form an optionally substituted, 3-5 membered monocyclic, bicyclic or polycyclic ring having, in addition to the intervening atoms, 0-3 heteroatoms independently selected from oxygen, nitrogen, sulfur, phosphorus and silicon.

In some embodiments, heteroatoms in R groups, or in the structures formed by two or more R groups taken together, are selected from oxygen, nitrogen, and sulfur. In some embodiments, a formed ring is 3, 4, 5, 6, 7, 8, 9, 10, 11, 12, 13, 14, 15, 16, 17, 18, 19, or 20-membered. In some embodiments, a formed ring is saturated. In some embodiments, a formed ring is partially saturated. In some embodiments, a formed ring is aromatic. In some embodiments, a formed ring comprises a saturated, partially saturated, or aromatic ring moiety. In some embodiments, a formed ring comprises 5, 6, 7, 8, 9, 10, 11, 12, 13, 14, 15, 16, 17, 18, 19, or 20 aromatic ring atoms. In some embodiments, a formed contains no more than 5, 6, 7, 8, 9, 10, 11, 12, 13, 14, 15, 16, 17, 18, 19, or 20 aromatic ring atoms. In some embodiments, aromatic ring atoms are selected from carbon, nitrogen, oxygen and sulfur.

In some embodiments, a ring formed by two or more R groups (or two or more groups selected from R and variables that can be R) taken together is a $C_{3-30}$ cycloaliphatic, $C_{6-30}$ aryl, 5-30 membered heteroaryl having 1-10 heteroatoms independently selected from oxygen, nitrogen, sulfur, phosphorus and silicon, or 3-30 membered heterocyclyl having 1-10 heteroatoms independently selected from oxygen, nitrogen, sulfur, phosphorus and silicon, ring as described for R, but bivalent or multivalent.

As appreciated by those skilled in the art, embodiments of R described in the present disclosure can also independently be embodiments for variables that can be R.

In some embodiments, a is 1-100. In some embodiments, a is 1-50. In some embodiments, a is 1-40. In some embodiments, a is 1-30. In some embodiments, a is 1-20. In some embodiments, a is 1-15. In some embodiments, a is 1-10. In some embodiments, a is 1-9. In some embodiments, a is 1-8. In some embodiments, a is 1-7. In some embodiments, a is 1-6. In some embodiments, a is 1-5. In some embodiments, a is 1-4. In some embodiments, a is 1-3. In some embodiments, a is 1-2. In some embodiments, a is 1. In some embodiments, a is 2. In some embodiments, a is 3. In some embodiments, a is 4. In some embodiments, a is 5. In some embodiments, a is 6. In some embodiments, a is 7. In some embodiments, a is 8. In some embodiments, a is 9. In some embodiments, a is 10. In some embodiments, a is more than 10.

In some embodiments, b is 1-100. In some embodiments, b is 1-50. In some embodiments, b is 1-40. In some embodiments, b is 1-30. In some embodiments, b is 1-20. In some embodiments, b is 1-15. In some embodiments, b is 1-10. In some embodiments, b is 1-9. In some embodiments, b is 1-8. In some embodiments, b is 1-7. In some embodiments, b is 1-6. In some embodiments, b is 1-5. In some embodiments, b is 1-4. In some embodiments, b is 1-3. In some embodiments, b is 1-2. In some embodiments, b is 1. In some embodiments, b is 2. In some embodiments, b is 3. In some embodiments, b is 4. In some embodiments, b is 5. In some embodiments, b is 6. In some embodiments, b is 7. In some embodiments, b is 8. In some embodiments, b is 9. In some embodiments, b is 10. In some embodiments, b is 1. In some embodiments, b is 2, 3, 4, 5, 6, 7, 8, 9, 10, 15, 20, or more.

In some embodiments, LED is L. In some embodiments, $L^{LD}$ is bivalent $L^M$

In some embodiments, $L^M$ is $-L^{M1}-L^{M2}-L^{M3}-$ as described in the present disclosure. In some embodiments, $L^M$ is $L^{M1}$ as described in the present disclosure. In some embodiments, $L^M$ is $L^{M2}$ as described in the present disclosure. In some embodiments, $L^M$ is $L^{M3}$ as described in the present disclosure. In some embodiments, $L^M$ is L as described in the present disclosure.

In some embodiments, $L^{M1}$ is L. In some embodiments, $L^{M2}$ is L. In some embodiments, $L^{M3}$ is L. In some embodiments, $L^{M1}$ is a covalent bond. In some embodiments, $L^{M2}$ is a covalent bond. In some embodiments, $L^{M3}$ is a covalent bond. In some embodiments, $L^{M1}$ is $L^{M2}$ as described in the present disclosure. In some embodiments, $L^{M1}$ is $L^{M3}$ as described in the present disclosure. In some embodiments, $L^{M2}$ is $L^{M1}$ as described in the present disclosure. In some embodiments, $L^{M2}$ is $L^{M3}$ as described in the present disclosure. In some embodiments, $L^{M3}$ is $L^{M1}$ as described in the present disclosure. In some embodiments, $L^{M3}$ is $L^{M2}$ as described in the present disclosure. In some embodiments, $L^M$ is $L^{M1}$ as described in the present disclosure. In some embodiments, $L^M$ is $L^{M2}$ as described in the present disclosure. In some embodiments, $L^M$ is $L^{M3}$ as described in the present disclosure. In some embodiments, $L^M$ is $L^{M1}-L^{M2}$, wherein each of $L^{M1}$ and $L^{M2}$ is independently as described in the present disclosure. In some embodiments, $L^M$ is $L^{M1}-L^{M3}$, wherein each of $L^{M1}$ and $L^{M3}$ is independently as described in the present disclosure. In some embodiments, $L^M$ is $L^{M2}-L^{M3}$, wherein each of $L^{M2}$ and $L^{M3}$ is independently as described in the present disclosure. In some embodiments, $L^M$ is $L^{M1}-L^{M2}-L^{M3}$, wherein each of $L^{M1}$, $L^{M2}$ and $L^{M3}$ is independently as described in the present disclosure.

In some embodiments, $L^{M1}$ comprises one or more —N(R')— and one or more —C(O)—. In some embodiments, a linker or $L^{M1}$ is or comprises

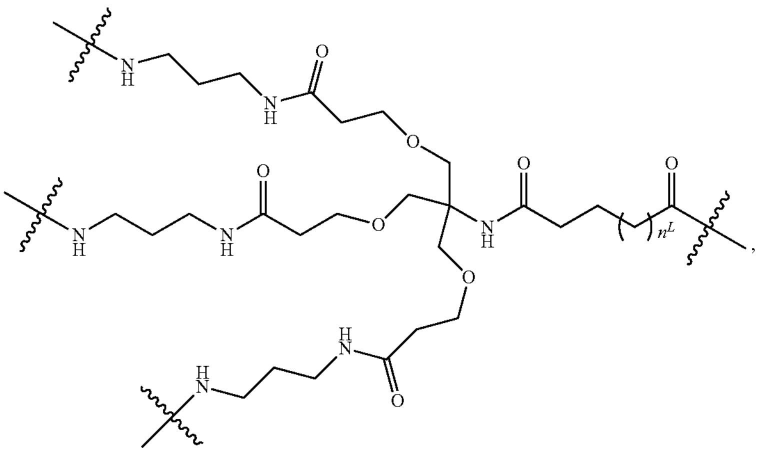

wherein $n^L$ is 1-8. In some embodiments, a linker or $-L^{M1}-L^{M2}-L^{M3}-$ is

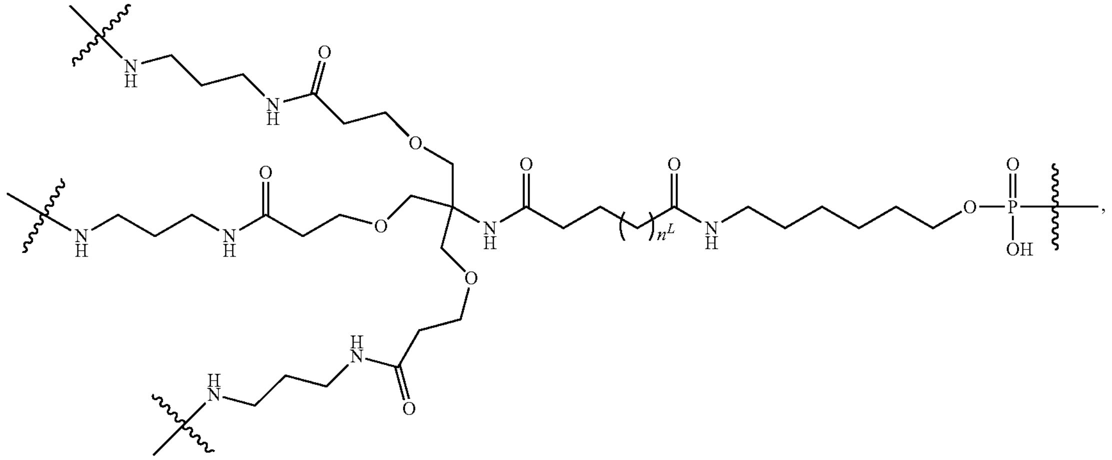

or a salt form thereof, wherein $n^L$ is 1-8. In some embodiments, a linker or $-L^{M1}-L^{M2}-L^{M3}-$ is

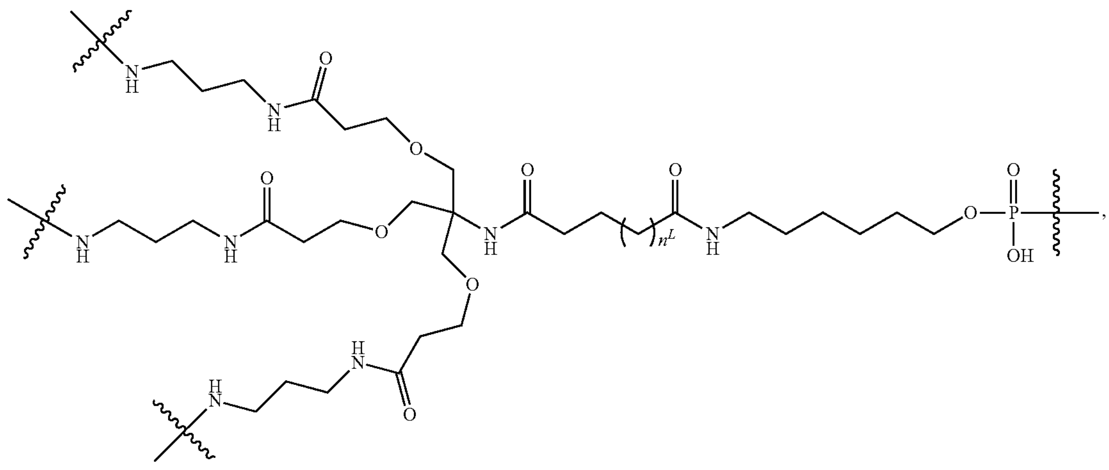
or a salt form thereof, wherein:
$n^L$ is 1-8.
each amino group independently connects to a moiety; and
the P atom connects to the 5'-OH of the oligonucleotide.
In some embodiments, the moiety and the linker, or $(R^D)$b-$L^{M1}$-$L^{M2}$-$L^{M3}$-, is or comprises
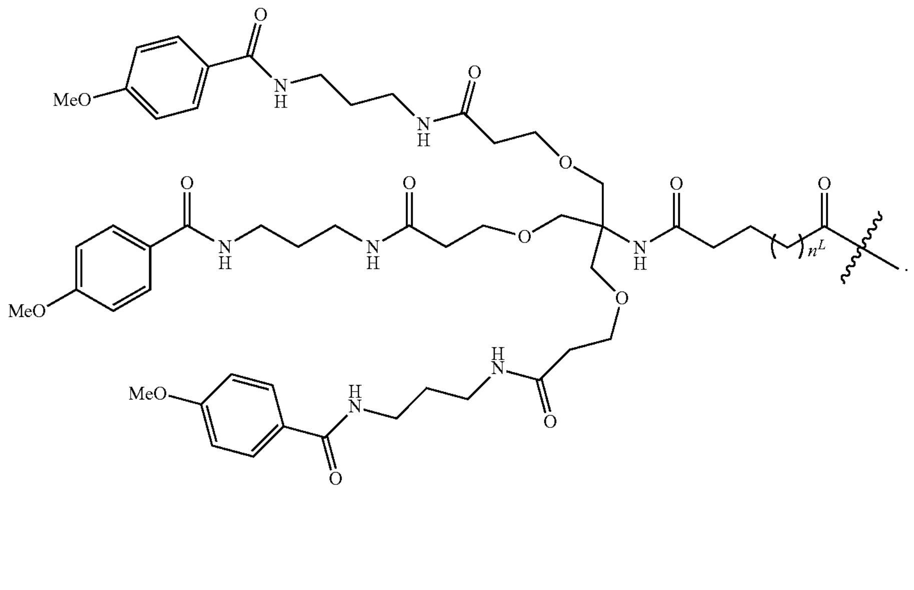
In some embodiments, the moiety and the linker, or $(R^D)$b-$L^{M1}$-$L^{M2}$-$L^{M3}$-, is or comprises

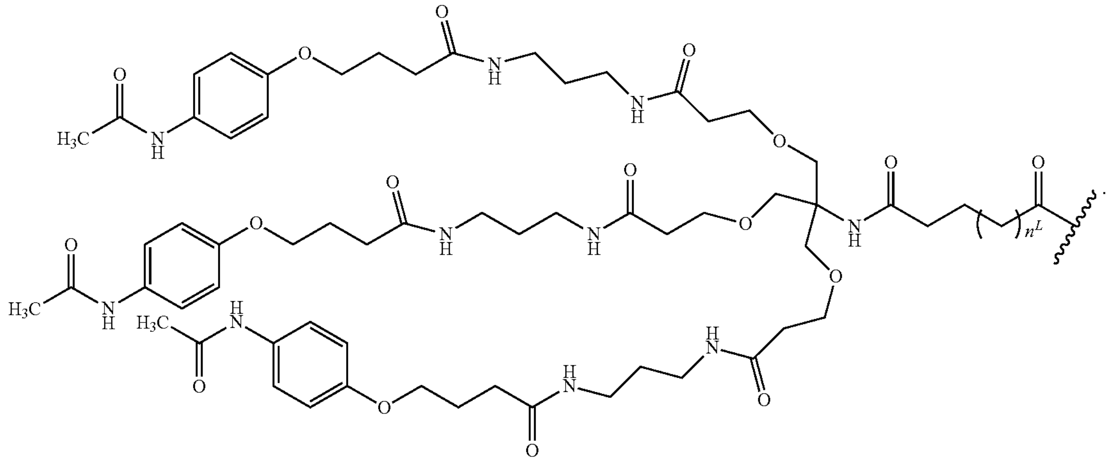
In some embodiments, the moiety and the linker, or $(R^D)$b-$L^{M1}$-$L^{M2}$-$L^{M3}$-, is or comprises
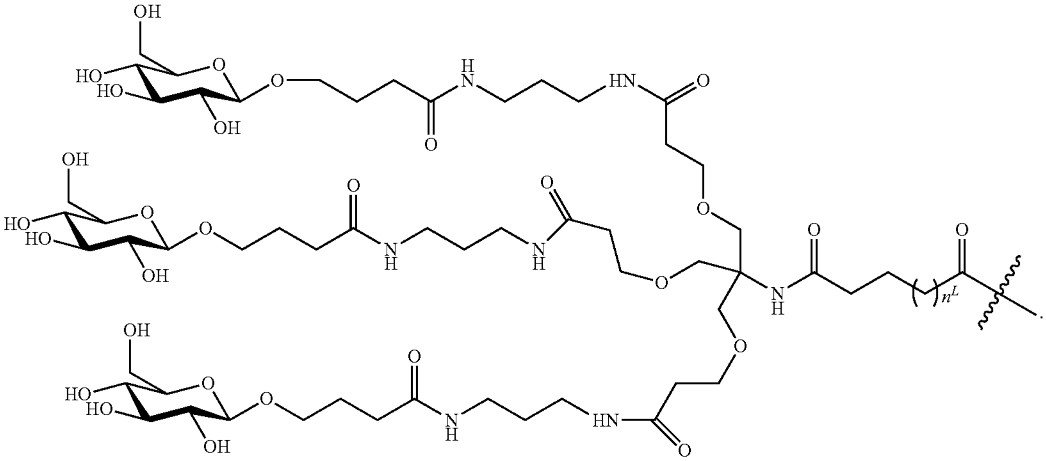
In some embodiments, the moiety and the linker, or $(R^D)$b-$L^{M1}$-$L^{M2}$-$L^{M3}$-, is or comprises
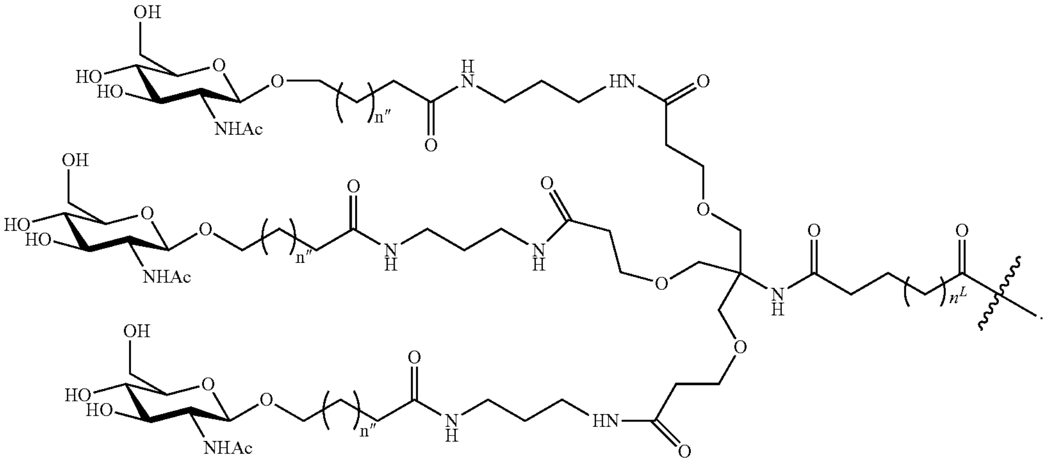

In some embodiments, the moiety and the linker, or $(R^D)b-L^{M1}-L^{M2}-L^{M3}-$, is or comprises
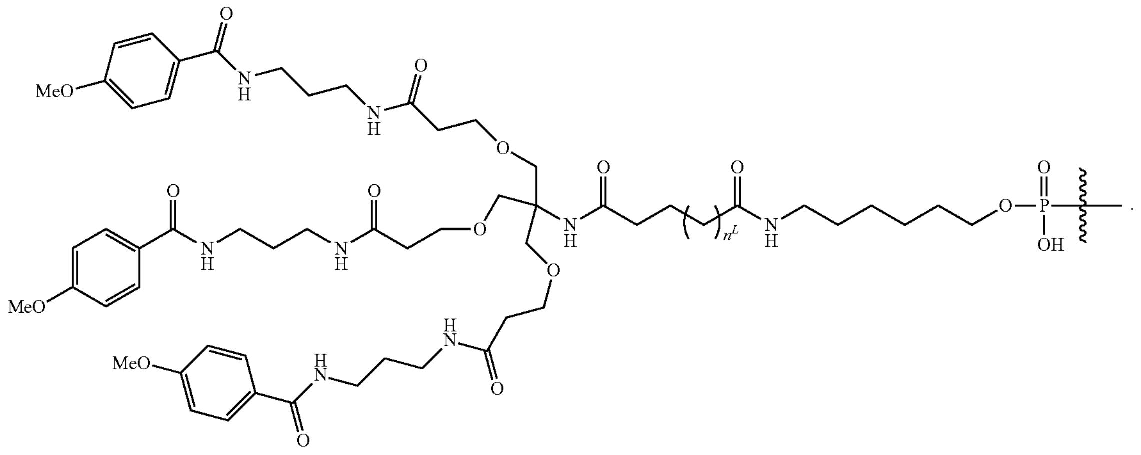
In some embodiments, the moiety and the linker, or $(R^D)b-L^{M1}-L^{M2}-L^{M3}-$, is or comprises
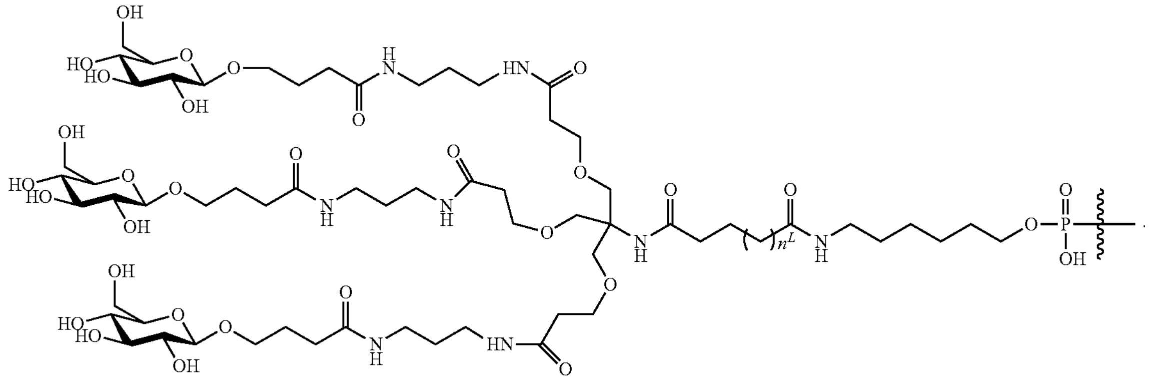
In some embodiments the moiety and the linker or $(R^D)b-L^{M1}-L^{M2}-L^{M3}-$ is or comprises
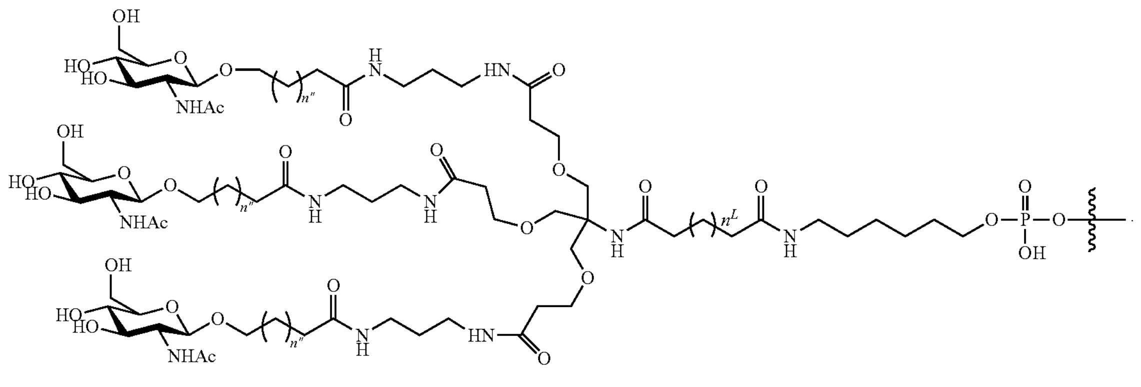

In some embodiments, the linker, or $L^{M1}$, is or comprises

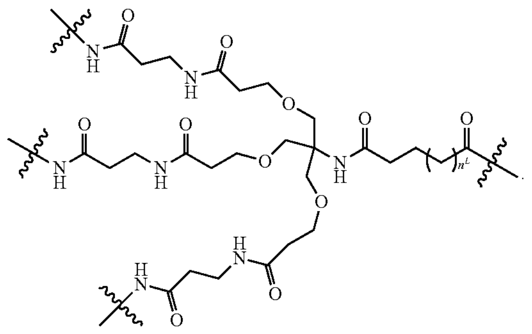

In some embodiments, the moiety and linker, or $(R^D)b-L^{M1}-L^{M2}-L^{M3}-$, is or comprises:

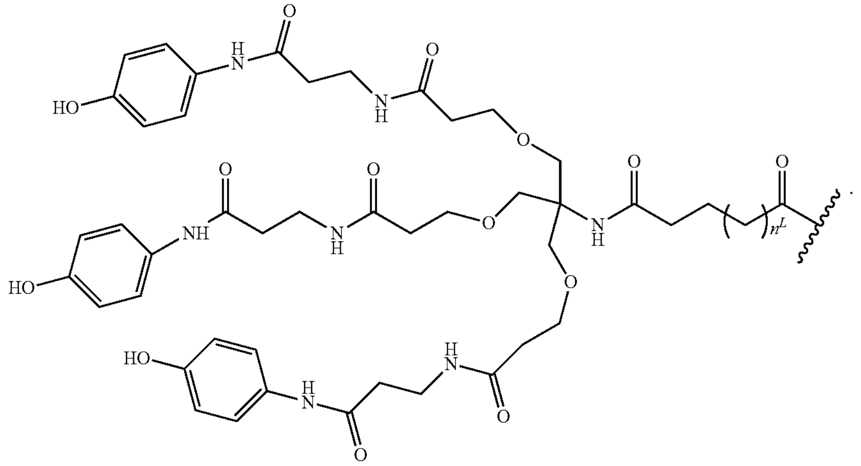

In some embodiments, the moiety and linker, or $(R^D)b-L^{M1}-L^{M2}-L^{M3}-$, is or comprises:

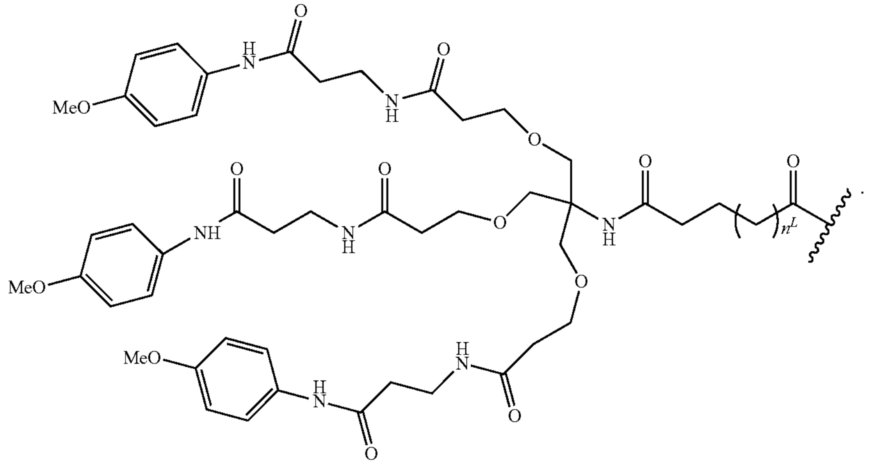

In some embodiments, $n^L$ is 1-8. In some embodiments, $n^L$ is 1, 2, 3, 4, 5, 6, 7, or 8. In some embodiments, $n^L$ is 1. In some embodiments, $n^L$ is 2. In some embodiments, $n^L$ is 3. In some embodiments, $n^L$ is 4. In some embodiments, $n^L$ is 5. In some embodiments, $n^L$ is 6. In some embodiments, $n^L$ is 7. In some embodiments, $n^L$ is 8.

In some embodiments, at least one $L^M$ is directly bound to a sugar unit of a provided oligonucleotide. In some embodiments, a $L^M$ directly binds to a sugar unit incorporates a lipid moiety into an oligonucleotide. In some embodiments, a $L^M$ directly binds to a sugar unit incorporates a carbohydrate moiety into an oligonucleotide. In some embodiments, a $L^M$ directly binds to a sugar unit incorporates a $R^{LD}$ group into an oligonucleotide. In some embodiments, a $L^M$ directly binds to a sugar unit incorporates a $R^{CD}$ group into an oligonucleotide. In some embodiments, $L^M$ is directed bound through 5'-OH of an oligonucleotide chain. In some embodiments, $L^M$ is directed bound through 3'-OH of an oligonucleotide chain.

In some embodiments, at least one $L^M$ is directly bound to an internucleotidic linkage unit of a provided oligonucleotide. In some embodiments, a $L^M$ directly binds to an internucleotidic linkage unit incorporates a lipid moiety into an oligonucleotide. In some embodiments, a $L^M$ directly binds to an internucleotidic linkage unit incorporates a carbohydrate moiety into an oligonucleotide. In some embodiments, a $L^M$ directly binds to an internucleotidic linkage unit incorporates a $R^{LD}$ group into an oligonucleotide. In some embodiments, a $L^M$ directly binds to an internucleotidic linkage unit incorporates a $R^{CD}$ group into an oligonucleotide.

In some embodiments, at least one $L^M$ is directly bound to a nucleobase unit of a provided oligonucleotide. In some embodiments, a $L^M$ directly binds to a nucleobase unit incorporates a lipid moiety into an oligonucleotide. In some embodiments, a $L^M$ directly binds to a nucleobase unit incorporates a carbohydrate moiety into an oligonucleotide. In some embodiments, a $L^M$ directly binds to a nucleobase unit incorporates a $R^{LD}$ group into an oligonucleotide. In some embodiments, a $L^M$ directly binds to a nucleobase unit incorporates a $R^{CD}$ group into an oligonucleotide.

In some embodiments, $L^M$ is bivalent. In some embodiments, $L^M$ is multivalent. In some embodiments, $L^M$ is

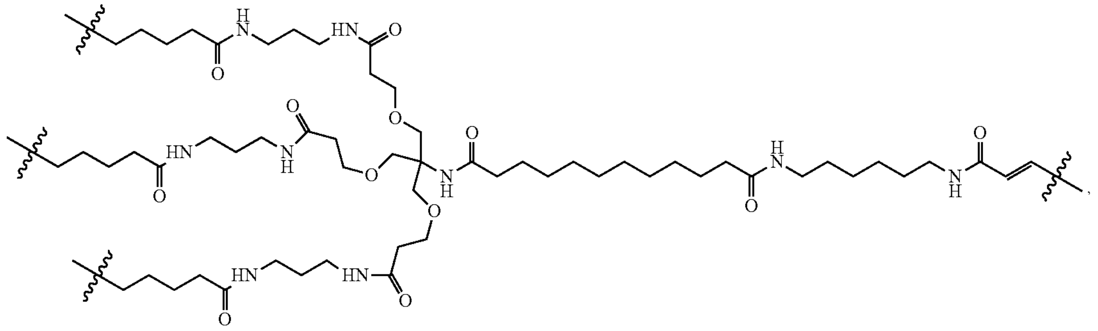

wherein $L^M$ is directly bond to a nucleobase, for example, as in:

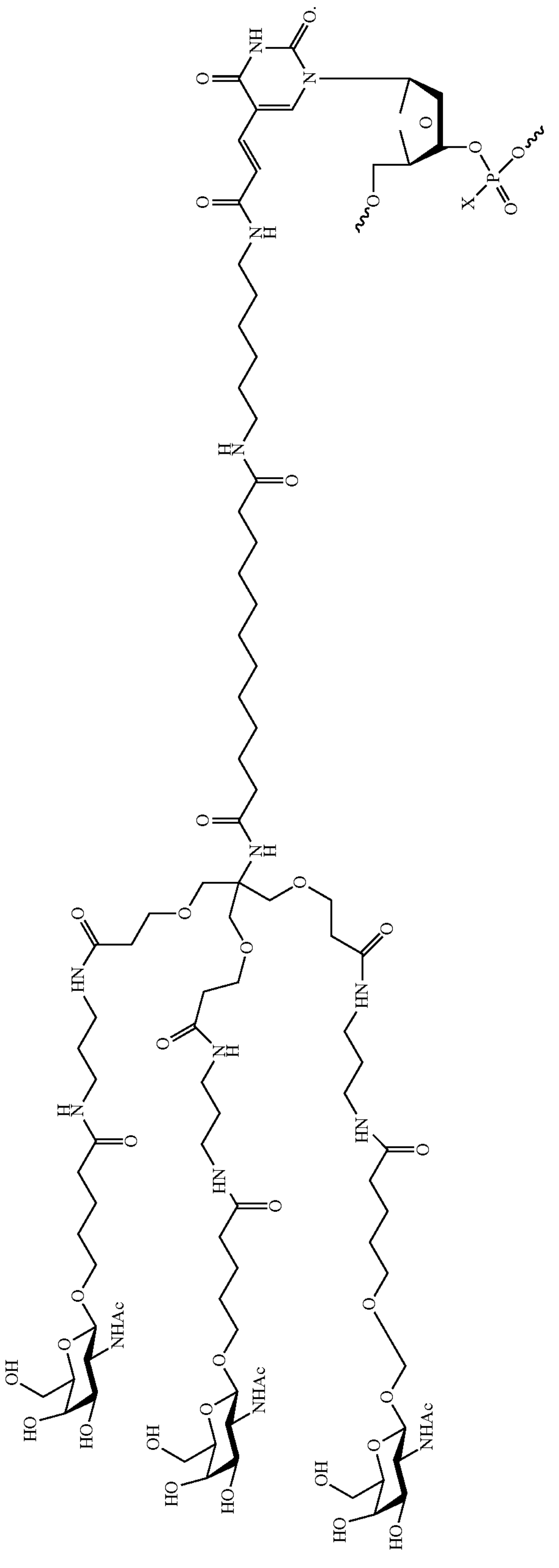
X = $S^-$ or $O^-$

In some embodiments, $L^M$ is
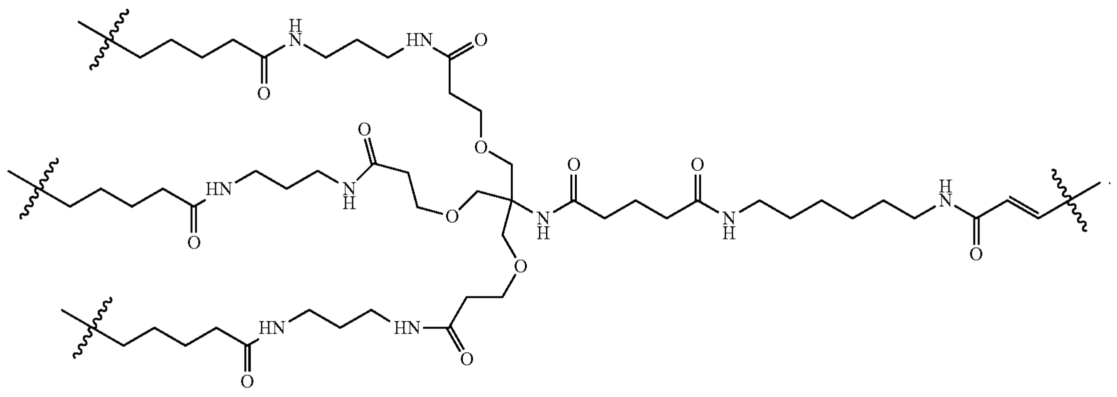 [SMILES: */C=C/C(=O)NCCCCCCNC(=O)CCCC(=O)NC(COCCC(=O)NCCCNC(=O)CCCC*)(COCCC(=O)NCCCNC(=O)CCCC*)COCCC(=O)NCCCNC(=O)CCCC*]
In some embodiments, $L^M$ is
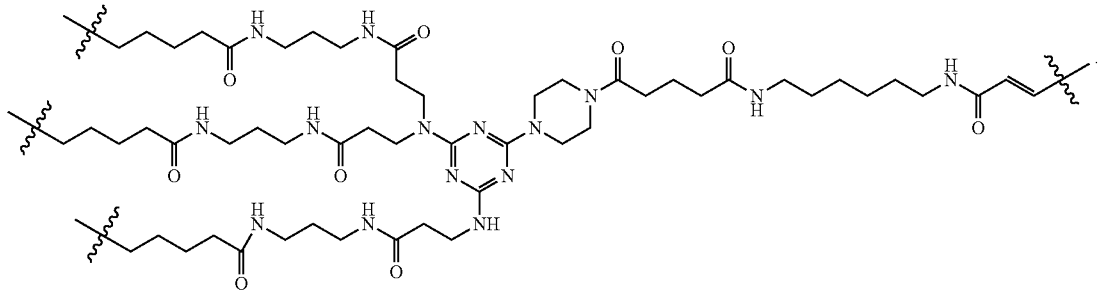 [SMILES: */C=C/C(=O)NCCCCCCNC(=O)CCCC(=O)N1CCN(c2nc(NCCC(=O)NCCCNC(=O)CCCC*)nc(N(CCC(=O)NCCCNC(=O)CCCC*)CCC(=O)NCCCNC(=O)CCCC*)n2)CC1]
In some embodiments, $L^M$ is
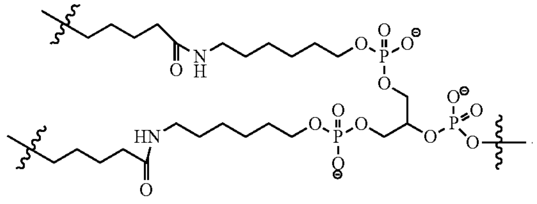 [SMILES: *CCCCC(=O)NCCCCCCOP(=O)([O-])OCC(COP(=O)([O-])OCCCCCCNC(=O)CCCC*)OP(=O)([O-])O*]
In some embodiments, $L^M$ is
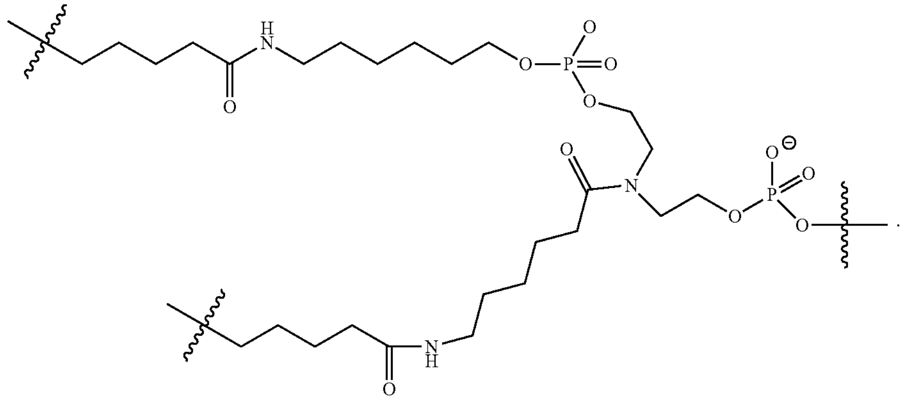 [SMILES: *CCCCC(=O)NCCCCCCOP(=O)(O)OCCN(CCOP(=O)([O-])O*)C(=O)CCCCCNC(=O)CCCC*]

In some embodiments, a linker moiety, e.g., $L^M$, $L^{M1}$, $L^{M2}$, $L^{M3}$, L, $L^s$, etc., is or comprises

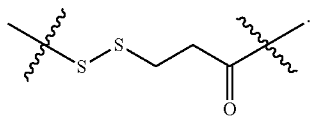 [SMILES: *SSCCC(*)=O]

In some embodiments, a linker moiety, e.g., $L^M$, $L^{M1}$, $L^{M2}$, $L^{M3}$, L, $L^s$, etc., is or comprises

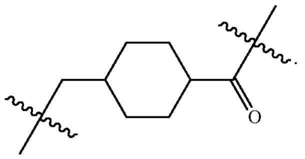 [SMILES: *CC1CCC(C(*)=O)CC1]

In some embodiments, $R^D$ is a lipid moiety. In some embodiments, $R^D$ is a targeting moiety. In some embodiments, $R^D$ is a carbohydrate moiety. In some embodiments, $R^D$ is a sulfonamide moiety. In some embodiments, $R^D$ is an antibody or a fragment thereof. In some embodiments, $R^D$ is $R^{LD}$ as described in the present disclosure. In some embodiments, $R^D$ is $R^{CD}$ as described in the present disclosure. In some embodiments, $R^D$ is $R^{TD}$ as described in the present disclosure.

In some embodiments, a lipid moiety has the structure of $R^{LD}$. In some embodiments, $R^{LD}$ is optionally substituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, $R^{LD}$ is optionally substituted $C_{10-80}$ aliphatic. In some embodiments, $R^{LD}$ is optionally substituted $C_{20-80}$ aliphatic. In some embodiments, $R^{LD}$ is optionally substituted $C_{10-70}$ aliphatic. In some embodiments, $R^{LD}$ is optionally substituted $C_{20-70}$ aliphatic. In some embodiments, $R^{LD}$ is optionally substituted $C_{10-60}$ aliphatic. In some embodiments, $R^{LD}$ is optionally substituted $C_{20-60}$ aliphatic. In some embodiments, $R^{LD}$ is optionally substituted $C_{10-50}$ aliphatic. In some embodiments, $R^{LD}$ is optionally substituted $C_{20-50}$ aliphatic. In some embodiments, $R^{LD}$ is optionally substituted $C_{10-40}$ aliphatic. In some embodiments, $R^{LD}$ is optionally substituted $C_{20-40}$ aliphatic. In some embodiments, $R^{LD}$ is optionally substituted $C_{10-30}$ aliphatic. In some embodiments, $R^{LD}$ is optionally substituted $C_{20-30}$ aliphatic. In some embodiments, $R^{LD}$ is unsubstituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, $R^{LD}$ is unsubstituted $C_{10-80}$ aliphatic. In some embodiments, $R^{LD}$ is unsubstituted $C_{20-80}$ aliphatic. In some embodiments, $R^{LD}$ is unsubstituted $C_{10-70}$ aliphatic. In some embodiments, $R^{LD}$ is unsubstituted $C_{20-70}$ aliphatic. In some embodiments, $R^{LD}$ is unsubstituted $C_{10-60}$ aliphatic. In some embodiments, $R^{LD}$ is unsubstituted $C_{20-60}$ aliphatic. In some embodiments, $R^{LD}$ is unsubstituted $C_{10-50}$ aliphatic. In some embodiments, $R^{LD}$ is unsubstituted $C_{20-50}$ aliphatic. In some embodiments, $R^{LD}$ is unsubstituted $C_{10-40}$ aliphatic. In some embodiments, $R^{LD}$ is unsubstituted $C_{20-40}$ aliphatic. In some embodiments, $R^{LD}$ is unsubstituted $C_{10-30}$ aliphatic. In some embodiments, $R^{LD}$ is unsubstituted $C_{20-30}$ aliphatic.

In some embodiments, $R^{LD}$ is not hydrogen. In some embodiments, $R^{LD}$ is a lipid moiety. In some embodiments, $R^{LD}$ is a targeting moiety. In some embodiments, $R^{LD}$ is a targeting moiety comprising a carbohydrate moiety. In some embodiments, $R^{LD}$ is a GalNAc moiety.

In some embodiments, $R^{TD}$ is $R^{LD}$, wherein $R^{LD}$ is independently as described in the present disclosure. In some embodiments, $R^{TD}$ is $R^{CD}$, wherein $R^{CD}$ is independently as described in the present disclosure. In some embodiments, $R^{TD}$ comprises a sulfonamide moiety. In some embodiments, a $R^{TD}$ comprises a carbohydrate moiety. In some embodiments, a $R^{TD}$ comprises a GalNAc moiety.

In some embodiments, $R^{CD}$ is an optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$. In some embodiments, $R^{CD}$ is an optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are independently replaced with a monosaccharide, disaccharide or polysaccharide moiety. In some embodiments, $R^{CD}$ is an optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')

O—, —OP(R')O—, or —OP(OR')[B(R')$_3$]O—; and one or more carbon atoms are independently replaced with a GalNac moiety.

In some embodiments, each $R^D$ is independently a chemical moiety as described in the present disclosure. In some embodiments, $R^D$ is an additional chemical moiety. In some embodiments, $R^D$ is targeting moiety. In some embodiments, $R^D$ is or comprises a carbohydrate moiety. In some embodiments, $R^D$ is or comprises a lipid moiety. In some embodiments, $R^D$ is or comprises a ligand moiety for, e.g., cell receptors such as a sigma receptor, an asialoglycoprotein receptor, etc. In some embodiments, a ligand moiety is or comprises an anisamide moiety, which may be a ligand moiety for a sigma receptor. In some embodiments, a ligand moiety is or comprises a lipid. In some embodiments, a ligand moiety is or comprises a GalNAc moiety, which may be a ligand moiety for an asialoglycoprotein receptor. In some embodiments, $R^D$ is selected from optionally substituted phenyl,

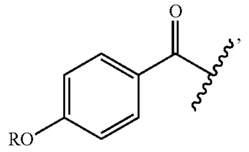

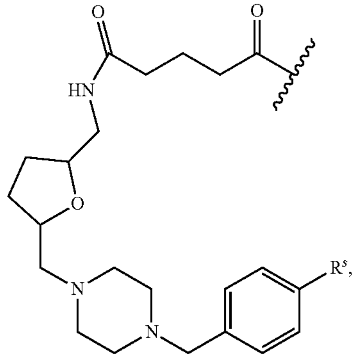

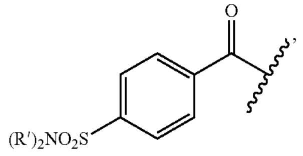

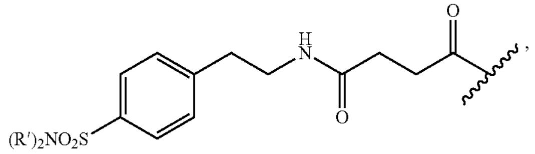

and

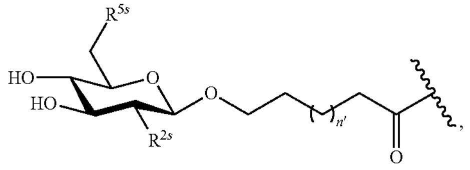

wherein $n^L$ is 0 or 1, and each other variable is independently as described in the present disclosure. In some embodiments, $R^s$ is F. In some embodiments, $R^s$ is OMe. In some embodiments, $R^s$ is OH. In some embodiments, $R^s$ is NHAc. In some embodiments, $R^s$ is $NHCOCF_3$. In some embodiments, R' is H. In some embodiments, R is H. In some embodiments, $R^{2s}$ is NHAc, and $R^{5s}$ is OH. In some embodiments, $R^{2s}$ is p-anisoyl, and $R^{5s}$ is OH. In some embodiments, $R^{2s}$ is NHAc and $R^{5s}$ is p-anisoyl. In some embodiments, $R^{2s}$ is OH, and $R^{5s}$ is p-anisoyl. In some embodiments, $R^D$ is selected from

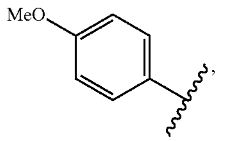

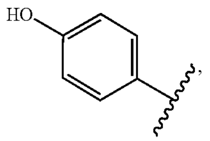

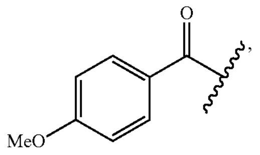

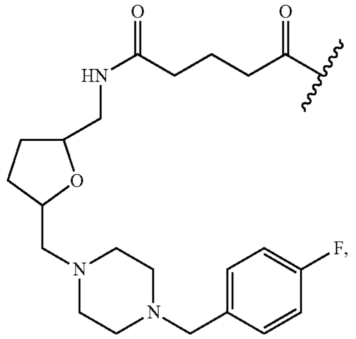

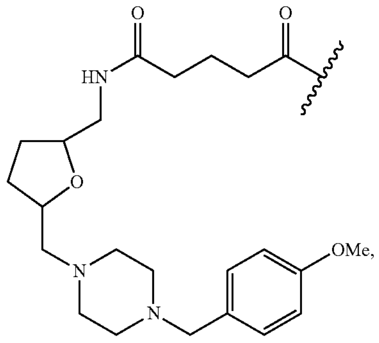

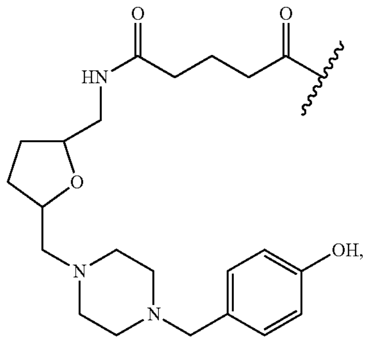

-continued
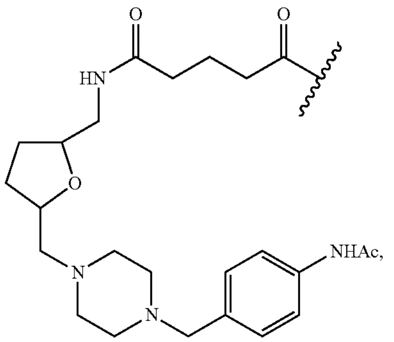
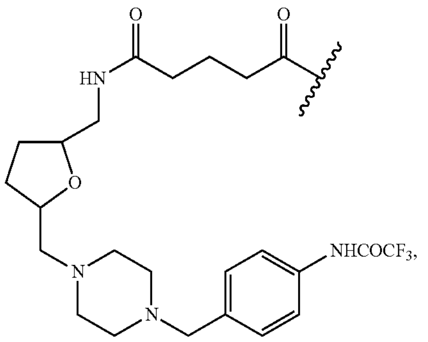
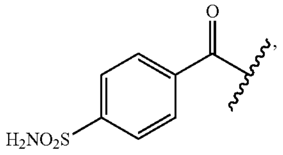
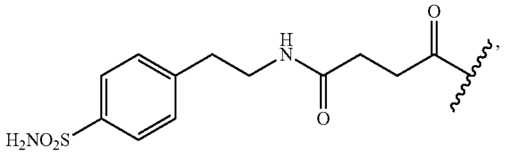
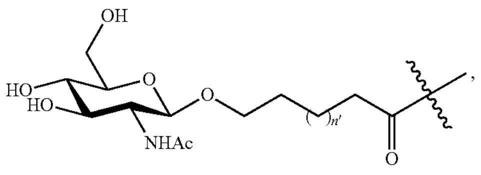
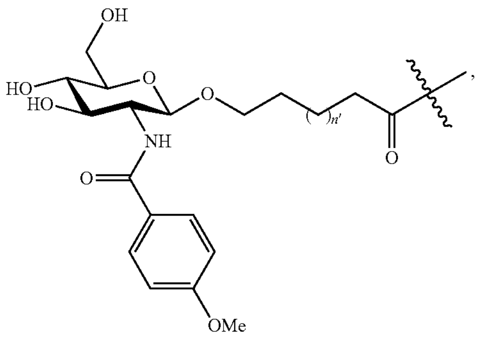
-continued
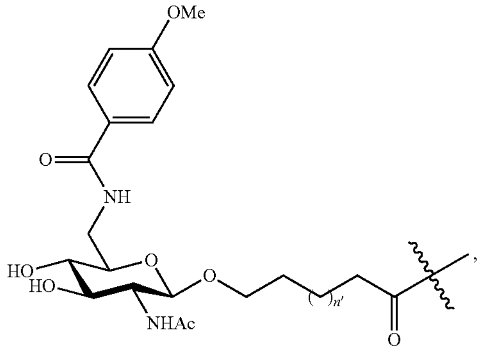
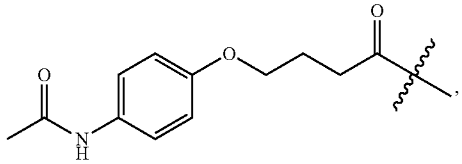
and
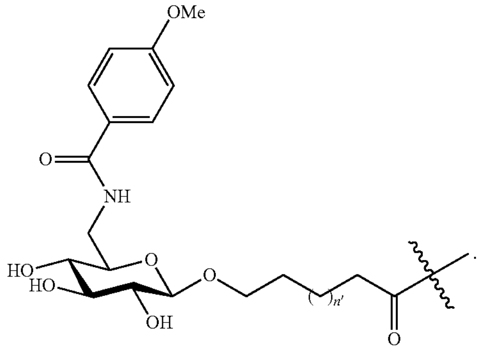
Further embodiments of $R^D$ includes additional chemical moiety embodiments, e.g., those described in the examples.
In some embodiments, $R^D$, $R^{LD}$ or $R^{TD}$ is or comprises
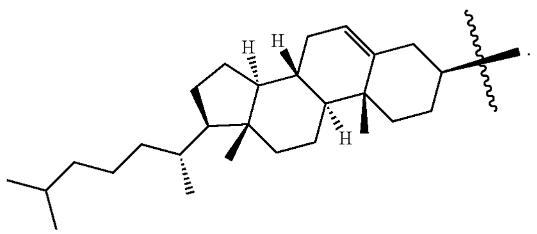 [SMILES: CC(C)CCC[C@@H](C)[C@H]1CC[C@H]2[C@@H]3CC=C4C[C@@H](C)CC[C@]4(C)[C@H]3CC[C@]12C]
In some embodiments, $R^D$, $R^{LD}$ or $R^{TD}$ is or comprises
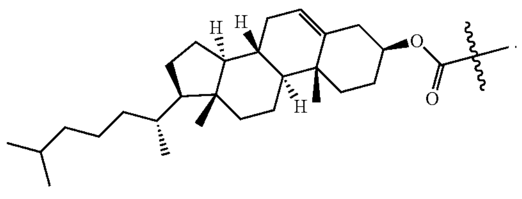 [SMILES: *C(=O)O[C@H]1CC[C@@]2(C)C(=CC[C@H]3[C@@H]4CC[C@H]([C@H](C)CCCC(C)C)[C@@]4(C)CC[C@@H]32)C1]

In some embodiments, $R^D$, $R^{LD}$ or $R^{TD}$ is or comprises
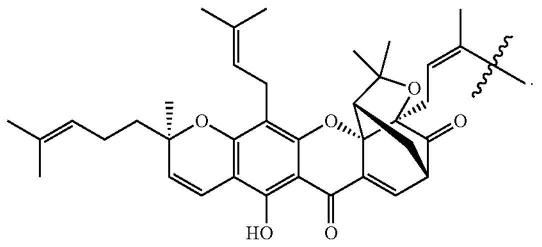 [SMILES: */C(C)=C\C[C@@]12OC(C)(C)[C@@H]3C[C@@H](C=C4C(=O)c5c(O)c6c(c(CC=C(C)C)c5O[C@]431)O[C@](C)(CCC=C(C)C)C=C6)C2=O]
In some embodiments, $R^D$, $R^{LD}$ or $R^{TD}$ is or comprises
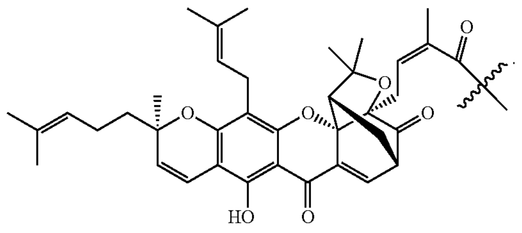 [SMILES: *C(=O)/C(C)=C\C[C@@]12OC(C)(C)[C@@H]3C[C@@H](C=C4C(=O)c5c(O)c6c(c(CC=C(C)C)c5O[C@]431)O[C@](C)(CCC=C(C)C)C=C6)C2=O]
In some embodiments, $R^D$, $R^{LD}$, $R^{CD}$ or $R^{TD}$ is or comprises
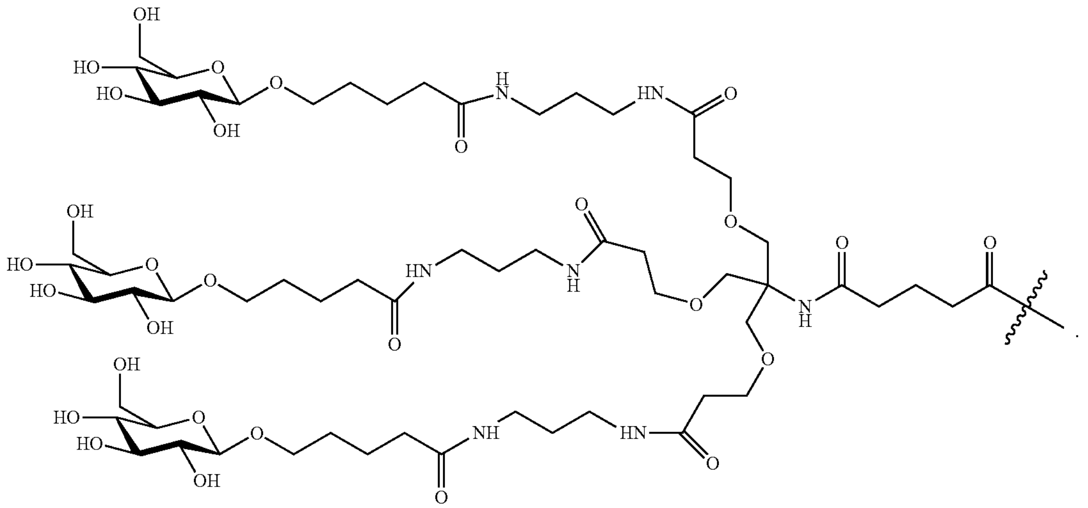
In some embodiments, $R^D$, $R^{LD}$, or $R^{TD}$ is or comprises
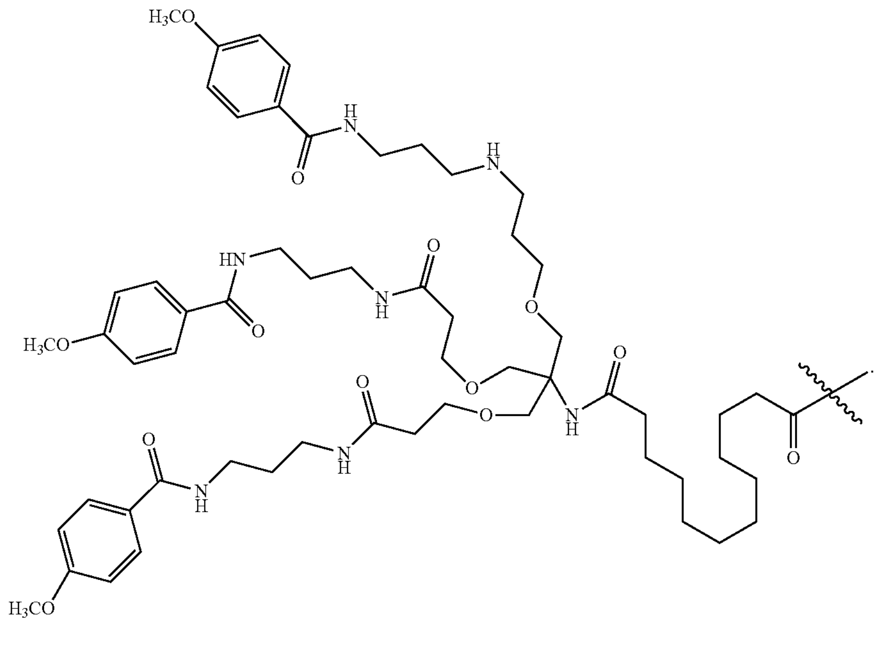 [SMILES: *C(=O)CCCCCCCCCCC(=O)NC(COCCCNCCCNC(=O)c1ccc(OC)cc1)(COCCC(=O)NCCCNC(=O)c1ccc(OC)cc1)COCCC(=O)NCCCNC(=O)c1ccc(OC)cc1]

In some embodiments, $R^D$, $R^{LD}$, $R^{CD}$ or $R^{TD}$ is or comprises —$N(R^1)_2$, wherein each $R^1$ is independently as described in the present disclosure. In some embodiments, $R^D$, $R^{LD}$, $R^{CD}$ or $R^{TD}$ is or comprises —$N(R^1)_3$, wherein each $R^1$ is independently as described in the present disclosure. In some embodiments, $R^D$, $R^{LD}$, $R^{CD}$ or $R^{TD}$ is or comprises one or more guanidine moieties. In some embodiments, $R^D$, $R^{LD}$, $R^{CD}$ or $R^{TD}$ is or comprises —N═C(N($R^1$)$_2$), wherein each $R^1$ is independently as described in the present disclosure. In some embodiments, $R^D$ or $R^{TD}$ is or comprises

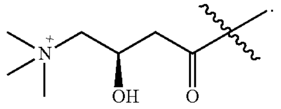

In some embodiments, $R^D$, $R^{LD}$ or $R^{TD}$ is or comprises

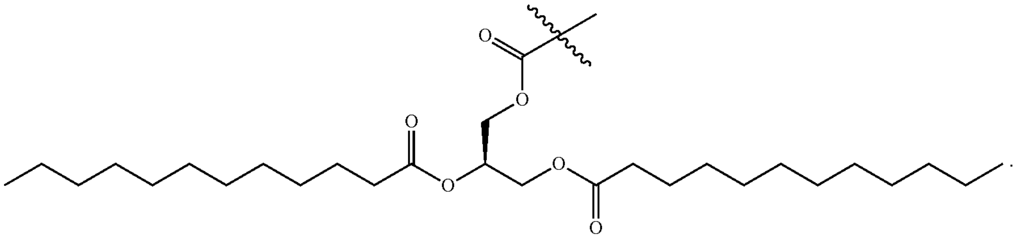 [SMILES: *C(=O)OC[C@@H](COC(=O)CCCCCCCCCCC)OC(=O)CCCCCCCCCCC]

In some embodiments, $R^D$ or $R^{TD}$ is or comprises

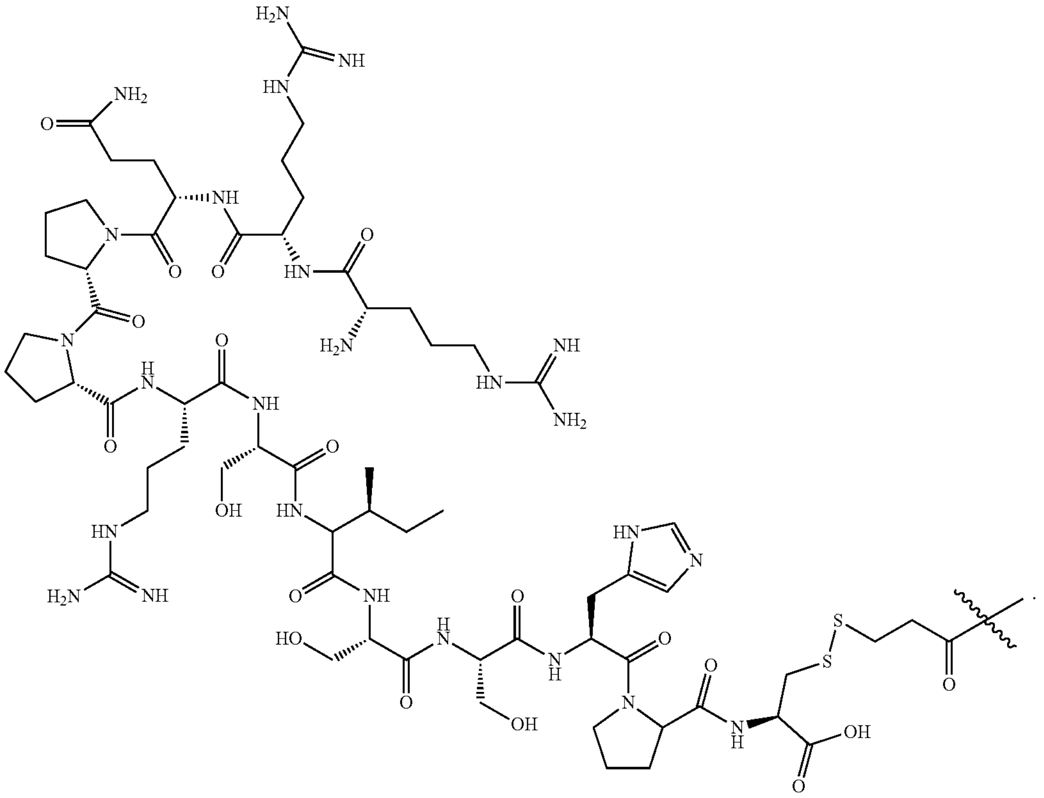 [SMILES: *C(=O)CCSSC[C@H](NC(=O)C1CCCN1C(=O)[C@H](Cc1cnc[nH]1)NC(=O)[C@H](CO)NC(=O)[C@H](CO)NC(=O)C(NC(=O)[C@H](CO)NC(=O)[C@H](CCCNC(=N)N)NC(=O)[C@@H]1CCCN1C(=O)[C@@H]1CCCN1C(=O)[C@H](CCC(N)=O)NC(=O)[C@H](CCCNC(=N)N)NC(=O)[C@@H](N)CCCNC(=N)N)[C@@H](C)CC)C(=O)O]

In some embodiments, $R^D$ or $R^{TD}$ is or comprises
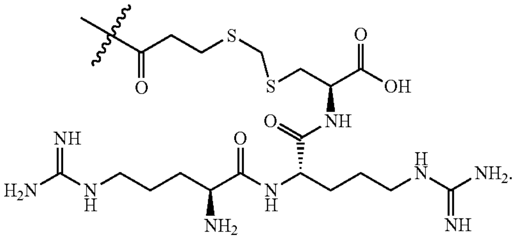 [SMILES: *C(=O)CCSCSC[C@H](NC(=O)[C@H](CCCNC(=N)N)NC(=O)[C@@H](N)CCCNC(=N)N)C(=O)O]
In some embodiments, $R^D$, $R^{CD}$, or $R^{TD}$ is or comprises
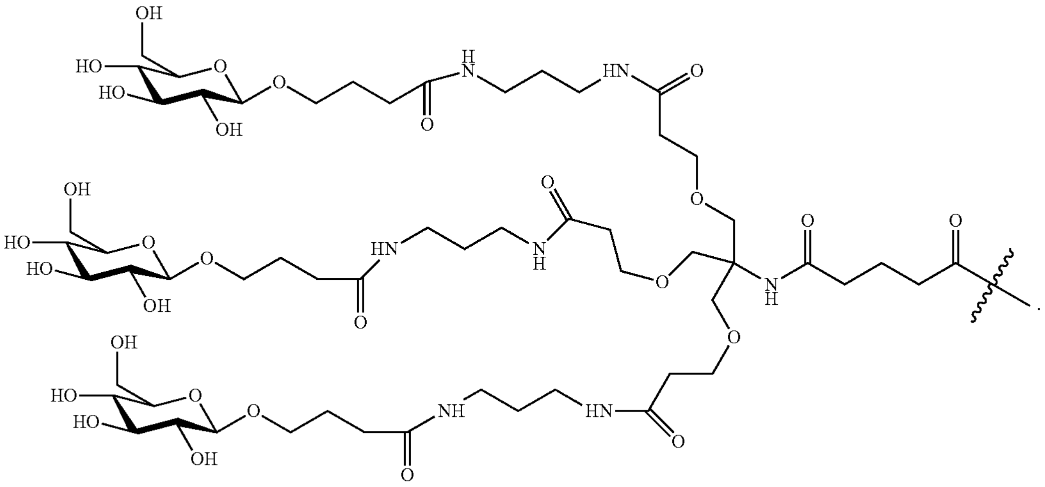
In some embodiments, $R^D$, $R^{LD}$, or $R^{TD}$ is or comprises
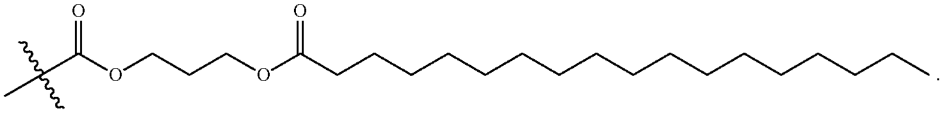 [SMILES: *C(=O)OCCCOC(=O)CCCCCCCCCCCCCCCCC]

In some embodiments, $R^D$, $R^{CD}$, or $R^{TD}$ is or comprises
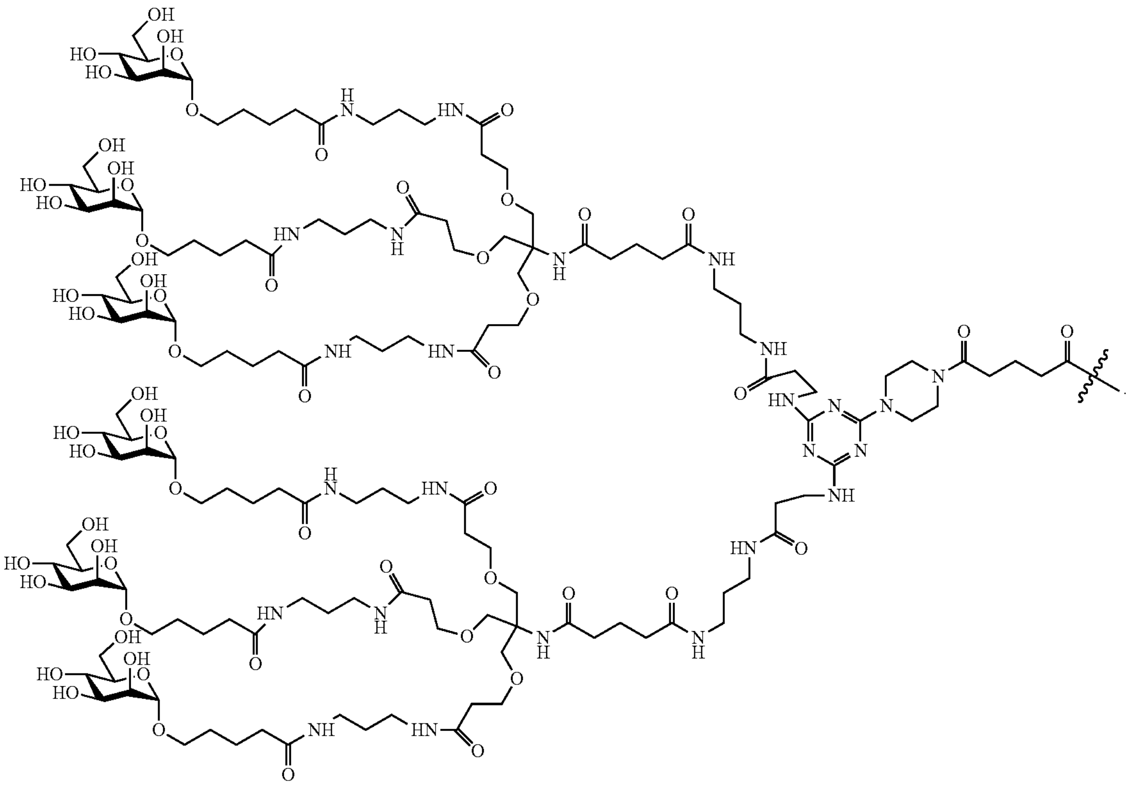
In some embodiments, $R^D$, $R^{LD}$, or $R^{TD}$ is or comprises
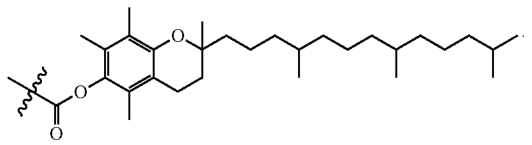 [SMILES: *C(=O)Oc1c(C)c(C)c2c(c1C)CCC(C)(CCCC(C)CCCC(C)CCCC(C)C)O2]
In some embodiments, $R^D$ or $R^{TD}$ is or comprises
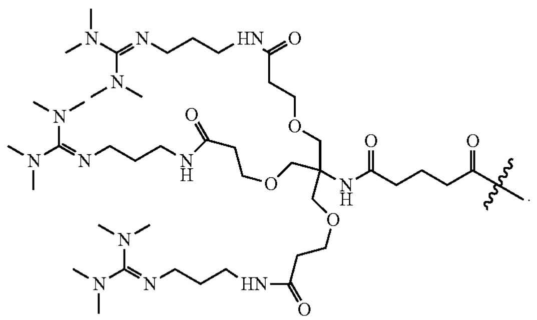 [SMILES: *C(=O)CCCC(=O)NC(COCCC(=O)NCCCN=C(N(C)C)N(C)C)(COCCC(=O)NCCCN=C(N(C)C)N(C)C)COCCC(=O)NCCCN=C(N(C)C)N(C)C]
In some embodiments, $R^D$ or $R^{TD}$ is or comprises
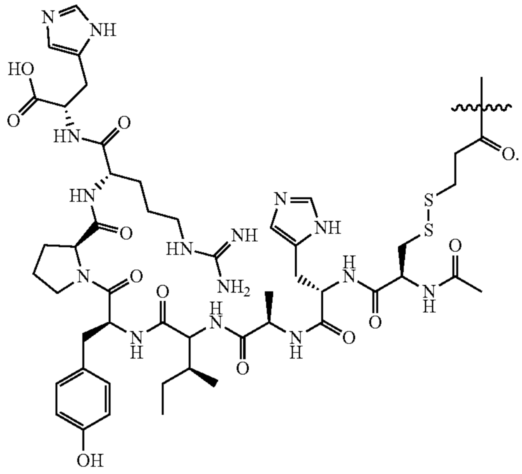 [SMILES: *C(=O)CCSSC[C@@H](NC(C)=O)C(=O)N[C@@H](Cc1cnc[nH]1)C(=O)N[C@H](C)C(=O)NC(C(=O)N[C@@H](Cc1ccc(O)cc1)C(=O)N1CCC[C@H]1C(=O)N[C@@H](CCCNC(=N)N)C(=O)N[C@@H](Cc1cnc[nH]1)C(=O)O)[C@@H](C)CC]

In some embodiments, $R^D$ or $R^{TD}$ is or comprises
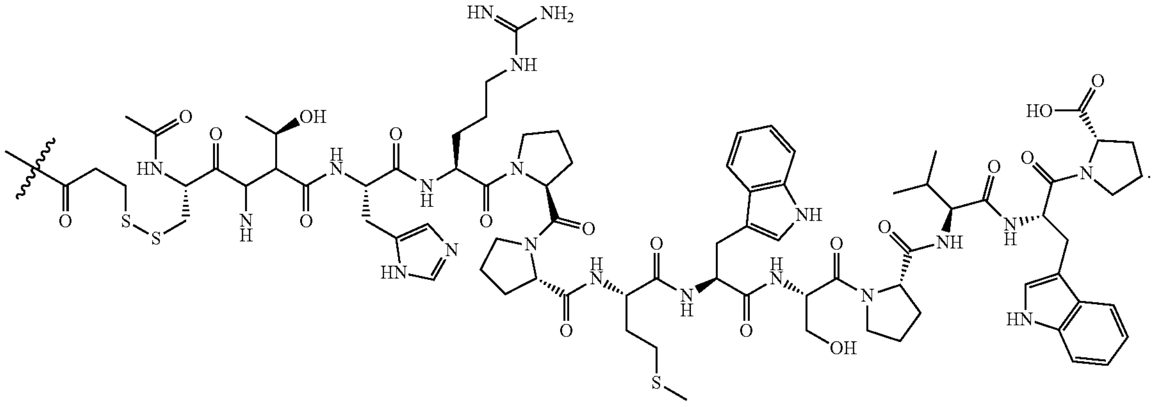 [SMILES: *C(=O)CCSSC[C@H](NC(C)=O)C(=O)C(N)C(C(=O)N[C@@H](Cc1cnc[nH]1)C(=O)N[C@@H](CCCNC(=N)N)C(=O)N1CCC[C@H]1C(=O)N1CCC[C@H]1C(=O)N[C@@H](CCSC)C(=O)N[C@@H](Cc1c[nH]c2ccccc12)C(=O)N[C@@H](CO)C(=O)N1CCC[C@H]1C(=O)N[C@H](C(=O)N[C@@H](Cc1c[nH]c2ccccc12)C(=O)N1CCC[C@H]1C(=O)O)C(C)C)[C@@H](C)O]
In some embodiments, $R^D$ or $R^{TD}$ is or comprises
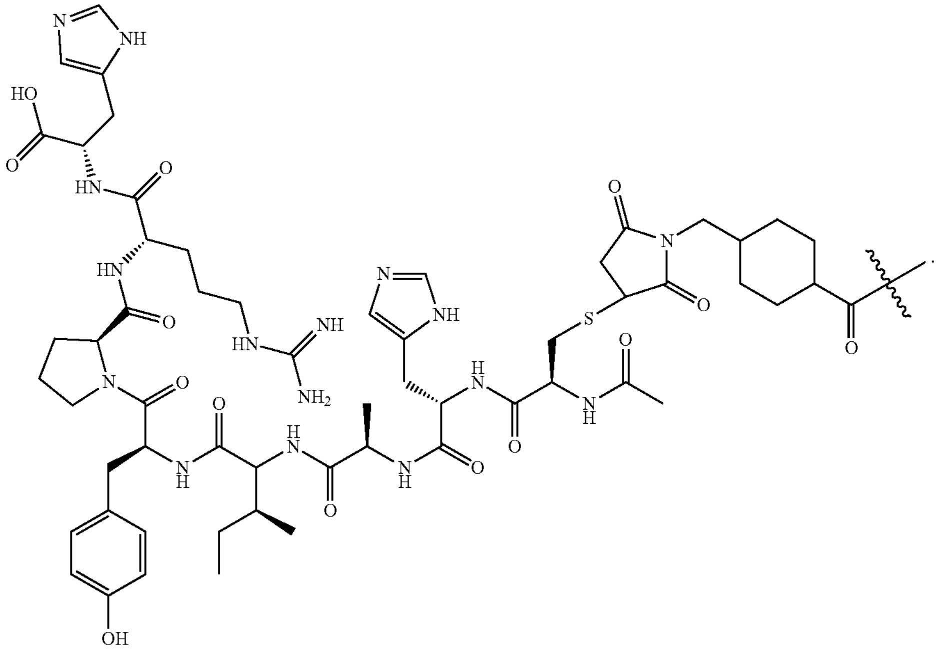 [SMILES: *C(=O)C1CCC(CN2C(=O)CC(SC[C@@H](NC(C)=O)C(=O)N[C@@H](Cc3cnc[nH]3)C(=O)N[C@H](C)C(=O)NC(C(=O)N[C@@H](Cc3ccc(O)cc3)C(=O)N3CCC[C@H]3C(=O)N[C@@H](CCCNC(=N)N)C(=O)N[C@@H](Cc3cnc[nH]3)C(=O)O)[C@@H](C)CC)C2=O)CC1]
In some embodiments, $R^D$ or $R^{TD}$ is or comprises
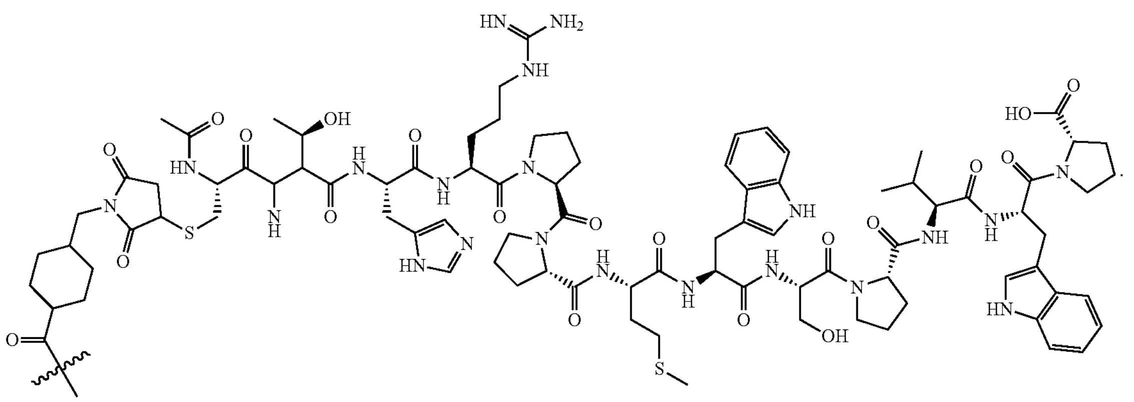 [SMILES: *C(=O)C1CCC(CN2C(=O)CC(SC[C@H](NC(C)=O)C(=O)C(N)C(C(=O)N[C@@H](Cc3cnc[nH]3)C(=O)N[C@@H](CCCNC(=N)N)C(=O)N3CCC[C@H]3C(=O)N3CCC[C@H]3C(=O)N[C@@H](CCSC)C(=O)N[C@@H](Cc3c[nH]c4ccccc34)C(=O)N[C@@H](CO)C(=O)N3CCC[C@H]3C(=O)N[C@H](C(=O)N[C@@H](Cc3c[nH]c4ccccc34)C(=O)N3CCC[C@H]3C(=O)O)C(C)C)[C@@H](C)O)C2=O)CC1]

In some embodiments, $R^D$ or $R^{TD}$ is or comprises
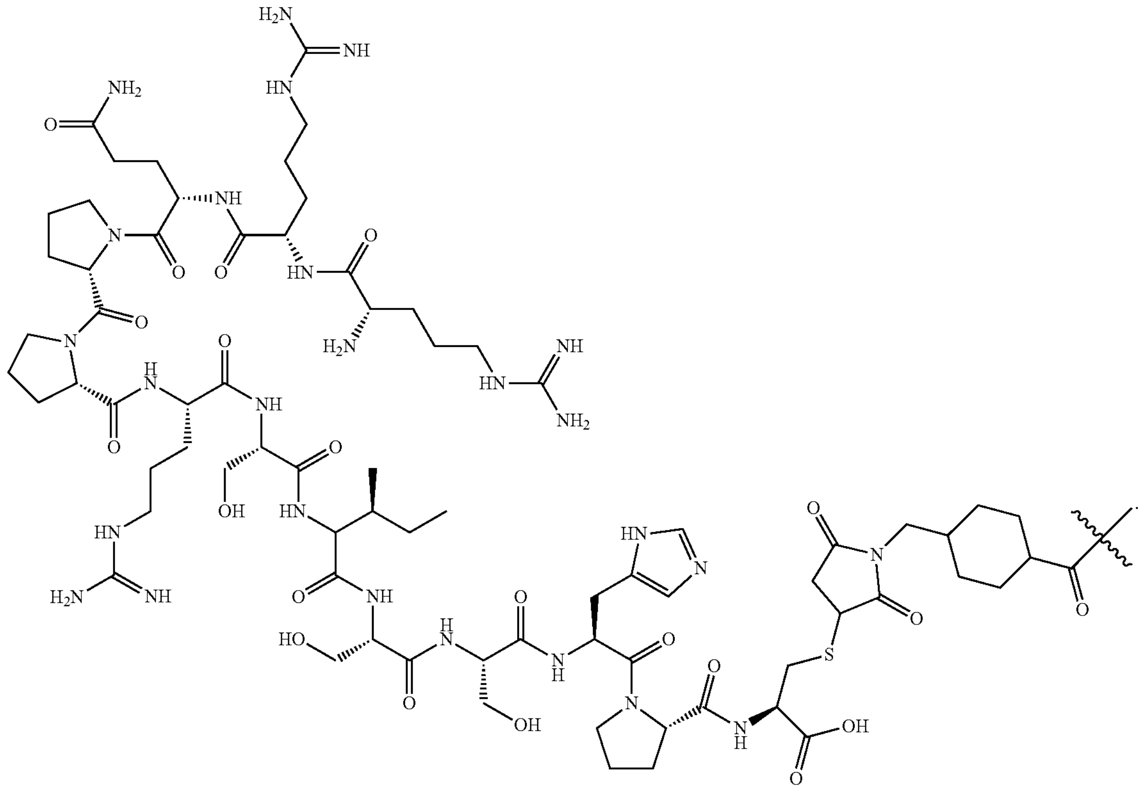 [SMILES: *C(=O)C1CCC(CN2C(=O)CC(SC[C@H](NC(=O)[C@@H]3CCCN3C(=O)[C@H](Cc3cnc[nH]3)NC(=O)[C@H](CO)NC(=O)[C@H](CO)NC(=O)C(NC(=O)[C@H](CO)NC(=O)[C@H](CCCNC(=N)N)NC(=O)[C@@H]3CCCN3C(=O)[C@@H]3CCCN3C(=O)[C@H](CCC(N)=O)NC(=O)[C@H](CCCNC(=N)N)NC(=O)[C@@H](N)CCCNC(=N)N)[C@@H](C)CC)C(=O)O)C2=O)CC1]
In some embodiments, $R^D$, $R^{CD}$, or $R^{TD}$ is or comprises
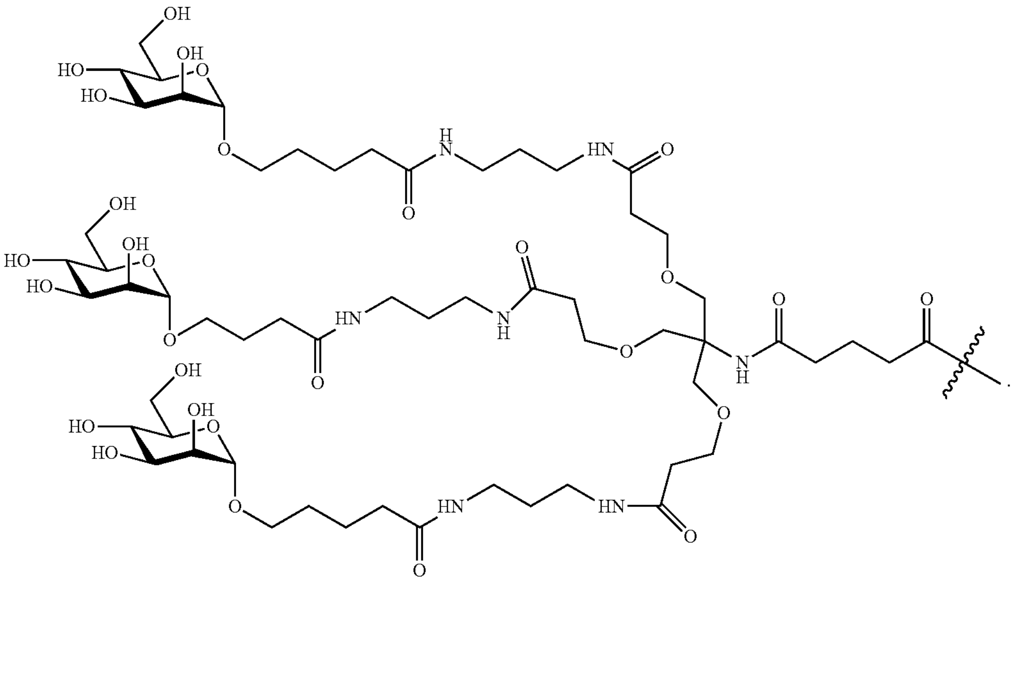

In some embodiments, $R^D$, $R^{CD}$, or $R^{TD}$ is or comprises
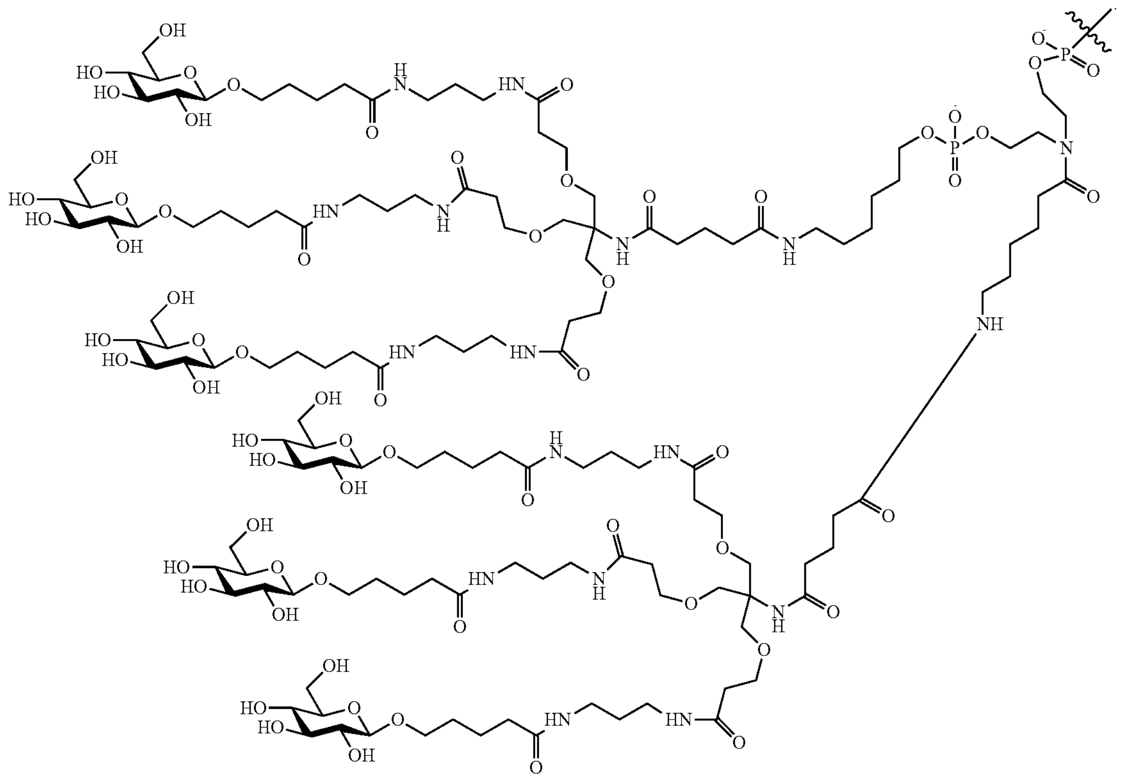
In some embodiments, $R^D$, $R^{CD}$, or $R^{TD}$ is or comprises
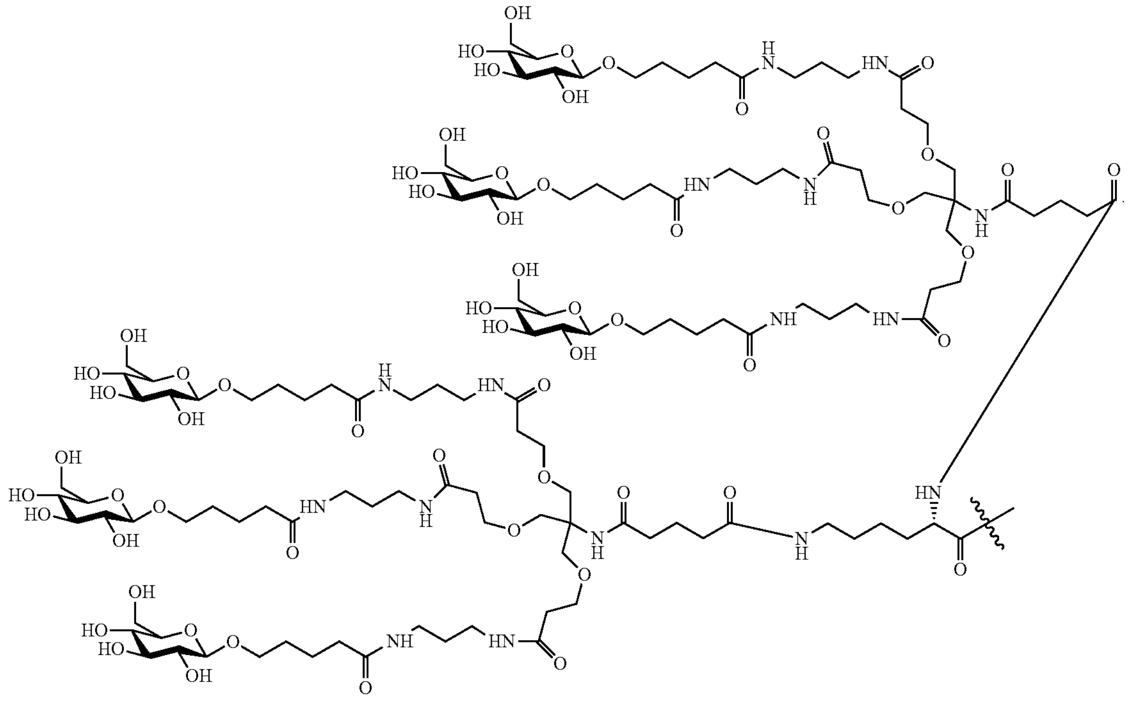

In some embodiments, $R^D$, $R^{LD}$, $R^{CD}$ or $R^{TD}$ comprises

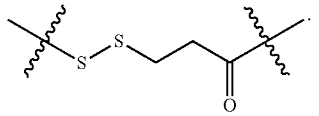 [SMILES: *SSCCC(*)=O]

In some embodiments, $R^D$, $R^{LD}$, $R^{CD}$ or $R^{TD}$ comprises

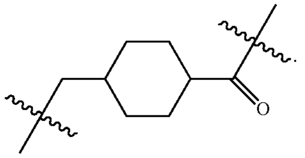 [SMILES: *CC1CCC(C(*)=O)CC1]

In some embodiments, n' is 1. In some embodiments, n' is 0.

In some embodiments, n" is 1. In some embodiments, n" is 2.

In some embodiments, a moiety of the present disclosure, e.g., a heteroaliphatic, heteroaryl, heterocyclyl, a ring, etc., may contain one or more heteroatoms. In some embodiments, a heteroatom is any atom that is not carbon and is not hydrogen. In some embodiments, each heteroatom is independently selected from boron, nitrogen, oxygen, sulfur, silicon and phosphorus. In some embodiments, each heteroatom is independently selected from nitrogen, oxygen, sulfur, silicon and phosphorus. In some embodiments, each heteroatom is independently selected from boron, nitrogen, oxygen, sulfur and phosphorus. In some embodiments, each heteroatom is independently selected from boron, nitrogen, oxygen, sulfur and silicon. In some embodiments, each heteroatom is independently selected from nitrogen, oxygen, and sulfur. In some embodiments, at least one heteroatom is nitrogen. In some embodiments, at least one heteroatom is oxygen. In some embodiments, at least one heteroatom is sulfur.

In some embodiments, y, t, n and m, e.g., in a stereochemistry pattern, each are independently 1-20 as described in the present disclosure. In some embodiments, y is 1. In some embodiments, y is at least 2, 3, 4, 5, 6, 7, 8, 9, 10, 11, 12, 13, 14, or 15. In some embodiments, y is 2, 3, 4, 5, 6, 7, 8, 9, 10, 11, 12, 13, 14, or 15. In some embodiments, y is 1, 2, 3, 4, 5, 6, 7, 8, 9, or 10. In some embodiments, y is 1. In some embodiments, y is 2. In some embodiments, y is 3. In some embodiments, y is 4. In some embodiments, y is 5. In some embodiments, y is 6. In some embodiments, y is 7. In some embodiments, y is 8. In some embodiments, y is 9. In some embodiments, y is 10.

In some embodiments, n is 1. In some embodiments, n is at least 2, 3, 4, 5, 6, 7, 8, 9, 10, 11, 12, 13, 14, or 15. In some embodiments, n is 2, 3, 4, 5, 6, 7, 8, 9, 10, 11, 12, 13, 14, or 15. In some embodiments, n is 1-10. In some embodiments, n is 1, 2, 3, 4, 5, 6, 7 or 8. In some embodiments, n is 1. In some embodiments, n is 2, 3, 4, 5, 6, 7 or 8. In some embodiments, n is 3, 4, 5, 6, 7 or 8. In some embodiments, n is 4, 5, 6, 7 or 8. In some embodiments, n is 5, 6, 7 or 8. In some embodiments, n is 6, 7 or 8. In some embodiments, n is 7 or 8. In some embodiments, n is 1. In some embodiments, n is 2. In some embodiments, n is 3. In some embodiments, n is 4. In some embodiments, n is 5. In some embodiments, n is 6. In some embodiments, n is 7. In some embodiments, n is 8. In some embodiments, n is 9. In some embodiments, n is 10.

In some embodiments, m is 0-50. In some embodiments, m is 1-50. In some embodiments, m is 1. In some embodiments, m is 2-50. In some embodiments, m is at least 2, 3, 4, 5, 6, 7, 8, 9, 10, 11, 12, 13, 14, or 15. In some embodiments, m is 2, 3, 4, 5, 6, 7 or 8. In some embodiments, m is 3, 4, 5, 6, 7 or 8. In some embodiments, m is 4, 5, 6, 7 or 8. In some embodiments, m is 5, 6, 7 or 8. In some embodiments, m is 6, 7 or 8. In some embodiments, m is 7 or 8. In some embodiments, m is 0. In some embodiments, m is 1. In some embodiments, m is 2. In some embodiments, m is 3. In some embodiments, m is 4. In some embodiments, m is 5. In some embodiments, m is 6. In some embodiments, m is 7. In some embodiments, m is 8. In some embodiments, m is 9. In some embodiments, m is 10. In some embodiments, m is 11. In some embodiments, m is 12. In some embodiments, m is 13. In some embodiments, m is 14. In some embodiments, m is 15. In some embodiments, m is 16. In some embodiments, m is 17. In some embodiments, m is 18. In some embodiments, m is 19. In some embodiments, m is 20. In some embodiments, m is 21. In some embodiments, m is 22. In some embodiments, m is 23. In some embodiments, m is 24. In some embodiments, m is 25. In some embodiments, m is at least 2. In some embodiments, m is at least 3. In some embodiments, m is at least 4. In some embodiments, m is at least 5. In some embodiments, m is at least 6. In some embodiments, m is at least 7. In some embodiments, m is at least 8. In some embodiments, m is at least 9. In some embodiments, m is at least 10. In some embodiments, m is at least 11. In some embodiments, m is at least 12. In some embodiments, m is at least 13. In some embodiments, m is at least 14. In some embodiments, m is at least 15. In some embodiments, m is at least 16. In some embodiments, m is at least 17. In some embodiments, m is at least 18. In some embodiments, m is at least 19. In some embodiments, m is at least 20. In some embodiments, m is at least 21. In some embodiments, m is at least 22. In some embodiments, m is at least 23. In some embodiments, m is at least 24. In some embodiments, m is at least 25. In some embodiments, m is at least greater than 25.

In some embodiments, t is 1-20. In some embodiments, t is 1. In some embodiments, t is at least 2, 3, 4, 5, 6, 7, 8, 9, 10, 11, 12, 13, 14, or 15. In some embodiments, t is 2, 3, 4, 5, 6, 7, 8, 9, 10, 11, 12, 13, 14, or 15. In some embodiments, t is 1-5. In some embodiments, t is 2. In some embodiments, t is 3. In some embodiments, t is 4. In some embodiments, t is 5. In some embodiments, t is 6. In some embodiments, t is 7. In some embodiments, t is 8. In some embodiments, t is 9. In some embodiments, t is 10. In some embodiments, t is 11. In some embodiments, t is 12. In some embodiments, t is 13. In some embodiments, t is 14. In some embodiments, t is 15. In some embodiments, t is 16. In some embodiments, t is 17. In some embodiments, t is 18. In some embodiments, t is 19. In some embodiments, t is 20.

In some embodiments, each of t and m is independently at least 2, 3, 4, 5, 6, 7, 8, 9, 10, 11, 12, 13, 14, or 15. In some embodiments, each of t and m is independently at least 3. In some embodiments, each of t and m is independently at least 4. In some embodiments, each of t and m is independently at least 5. In some embodiments, each of t and m is independently at least 6. In some embodiments, each of t and m is independently at least 7. In some embodiments, each of t and m is independently at least 8. In some embodiments, each of t and m is independently at least 9. In some embodiments, each of t and m is independently at least 10.

As used in the present disclosure, in some embodiments, "one or more" is 1-200, 1-150, 1-100, 1-90, 1-80, 1-70, 1-60, 1-50, 1-40, 1-30, or 1, 2, 3, 4, 5, 6, 7, 8, 9, 10, 11, 12, 13, 14, 15, 16, 17, 18, 19, 20, 21, 22, 23, 24, or 25. In some embodiments, "one or more" is one. In some embodiments, "one or more" is two. In some embodiments, "one or more" is three. In some embodiments, "one or more" is four. In some embodiments, "one or more" is five. In some embodiments, "one or more" is six. In some embodiments, "one or more" is seven. In some embodiments, "one or more" is eight. In some embodiments, "one or more" is nine. In some embodiments, "one or more" is ten. In some embodiments, "one or more" is at least one. In some embodiments, "one or more" is at least two. In some embodiments, "one or more" is at least three. In some embodiments, "one or more" is at least four. In some embodiments, "one or more" is at least five. In some embodiments, "one or more" is at least six. In some embodiments, "one or more" is at least seven. In some embodiments, "one or more" is at least eight. In some embodiments, "one or more" is at least nine. In some embodiments, "one or more" is at least ten. As used in the present disclosure, in some embodiments, "at least one" is 1-200, 1-150, 1-100, 1-90, 1-80, 1-70, 1-60, 1-50, 1-40, 1-30, or 1, 2, 3, 4, 5, 6, 7, 8, 9, 10, 11, 12, 13, 14, 15, 16, 17, 18, 19, 20, 21, 22, 23, 24, or 25. In some embodiments, "at least one" is one. In some embodiments, "at least one" is two. In some embodiments, "at least one" is three. In some embodiments, "at least one" is four. In some embodiments, "at least one" is five. In some embodiments, "at least one" is six. In some embodiments, "at least one" is seven. In some embodiments, "at least one" is eight. In some embodiments, "at least one" is nine. In some embodiments, "at least one" is ten.

In some embodiments, the present disclosure provides the following embodiments:

1. An oligonucleotide composition, comprising a plurality of oligonucleotides of a particular oligonucleotide type defined by:

1) base sequence;
2) pattern of backbone linkages;
3) pattern of backbone chiral centers; and
4) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages; and oligonucleotides of the plurality comprise at least 1, 2, 3, 4, 5, 6, 7, 8, 9, 10, 11, 12, 13, 14, 15, 16, 17, 18, 19, or 20 non-negatively charged internucleotidic linkages.

2. The oligonucleotide composition of embodiment 1, wherein the oligonucleotide composition being characterized in that, when it is contacted with a transcript in a transcript splicing system, splicing of the transcript is altered relative to that observed under a reference condition selected from the group consisting of absence of the composition, presence of a reference composition, and combinations thereof.

3. An oligonucleotide composition, comprising a plurality of oligonucleotides of a particular oligonucleotide type defined by:

1) base sequence;
2) pattern of backbone linkages;
3) pattern of backbone chiral centers; and
4) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages; and the oligonucleotide composition being characterized in that, when it is contacted with a transcript in a transcript splicing system, splicing of the transcript is altered relative to that observed under a reference condition selected from the group consisting of absence of the composition, presence of a reference composition, and combinations thereof.

4. The composition of any one of the preceding embodiments, wherein each chiral internucleotidic linkage of the oligonucleotides of the plurality is independently a chirally controlled internucleotidic linkage.

5. The composition of any one of the preceding embodiments, wherein each chiral modified internucleotidic linkage independently has a stereopurity of at least 90%, 91%, 92%, 93%, 94%, 95%, 96%, 97%, 98%, or 99% at its chiral linkage phosphorus.

6. A composition comprising a plurality of oligonucleotides of a particular oligonucleotide type defined by:

1) base sequence;
2) pattern of backbone linkages;
3) pattern of backbone chiral centers; and
4) pattern of backbone phosphorus modifications, which composition is chirally controlled and it is enriched, relative to a substantially racemic preparation of oligonucleotides having the same base sequence, pattern of backbone linkages and pattern of backbone phosphorus modifications, for oligonucleotides of the particular oligonucleotide type, wherein:

the oligonucleotide composition is characterized in that, when it is contacted with a transcript in a transcript splicing system, splicing of the transcript is altered in that level of inclusion of a nucleic acid sequence is increased relative to that observed under a reference condition selected from the group consisting of absence of the composition, presence of a reference composition, and combinations thereof.

7. The composition of any one of the preceding embodiments, wherein the pattern of backbone chiral centers comprises at least one Sp.

8. The composition of any one of the preceding embodiments, wherein the pattern of backbone chiral centers comprises at least one Rp.

9. A composition comprising a plurality of oligonucleotides of a particular oligonucleotide type defined by:

1) base sequence;
2) pattern of backbone linkages; and
3) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 non-negatively charged internucleotidic linkages;

the oligonucleotide composition is characterized in that, when it is contacted with a transcript in a transcript splicing system, splicing of the transcript is altered in that level of inclusion of a nucleic acid sequence is increased relative to that observed under a reference condition selected from the group consisting of absence of the composition, presence of a reference composition, and combinations thereof.

10. The composition of any one of the preceding embodiments, wherein each non-negatively charged internucleotidic linkage is independently an internucleotidic linkage at least 50% of which exists in its non-negatively charged form at pH 7.4.

11. The composition of any one of the preceding embodiments, wherein each non-negatively charged internucleotidic linkage is independently a neutral internucleotidic linkage, wherein at least 50% of the internucleotidic linkage exists in its neutral form at pH 7.4.

12. The composition of any one of the preceding embodiments, wherein the neutral form of each non-negatively charged internucleotidic linkage independently has a pKa no less than 8, 9, 10, 11, 12, 13, or 14.

13. The composition of any one of the preceding embodiments, wherein the neutral form of each non-negatively charged internucleotidic linkage, when the units which it connects are replaced with —$CH_3$, independently has a pKa no less than 8, 9, 10, 11, 12, 13, or 14.

14. The composition of any one of the preceding embodiments, wherein the reference condition is absence of the composition.

15. The composition of any one of the preceding embodiments, wherein the reference condition is presence of a reference composition.

16. The composition of any one of the preceding embodiments, wherein the reference composition is an otherwise identical composition wherein the oligonucleotides of the plurality comprise no chirally controlled internucleotidic linkages.

17. The composition of any one of the preceding embodiments, wherein the reference composition is an otherwise identical composition wherein the oligonucleotides of the plurality comprise no non-negatively charged internucleotidic linkages.

18. The composition of any one of the preceding embodiments, wherein the pattern of backbone linkages comprises one or more backbone linkages selected from phosphodiester, phosphorothioate and phosphodithioate linkages.

19. The composition of any one of the preceding embodiments, wherein the oligonucleotides of the plurality each comprise one or more sugar modifications.

20. The composition of any one of the preceding embodiments, wherein the sugar modifications comprise one or more modifications selected from: 2'-O-methyl, 2'-MOE, 2'-F, morpholino and bicyclic sugar moieties.

21. The composition of any one of the preceding embodiments, wherein one or more sugar modifications are 2'-F modifications.

22. The composition of any one of the preceding embodiments, wherein the oligonucleotides of the plurality each comprise a 5'-end region comprising 1, 2, 3, 4, 5, 6, 7, 8, 9, 10 or more nucleoside units comprising a 2'-F modified sugar moiety.

23. The composition of any one of the preceding embodiments, wherein the oligonucleotides of the plurality each comprise a 3'-end region comprising 1, 2, 3, 4, 5, 6, 7, 8, 9, 10 or more nucleoside units comprising a 2'-F modified sugar moiety.

24. The composition of any one of the preceding embodiments, wherein the oligonucleotides of the plurality each comprise a middle region between the 5'-end region and the 3'-region comprising 1, 2, 3, 4, 5, 6, 7, 8, 9, 10 or more nucleotidic units comprising a phosphodiester linkage.

25. A composition comprising a plurality of oligonucleotides of a particular oligonucleotide type defined by:

1) base sequence;
2) pattern of backbone linkages; and
3) pattern of backbone phosphorus modifications, wherein:

oligonucleotides of the plurality comprise:

1) a 5'-end region comprising 1, 2, 3, 4, 5, 6, 7, 8, 9, 10 or more nucleoside units comprising a 2'-F modified sugar moiety;
2) a 3'-end region comprising 1, 2, 3, 4, 5, 6, 7, 8, 9, 10 or more nucleoside units comprising a 2'-F modified sugar moiety; and
3) a middle region between the 5'-end region and the 3'-region comprising 1, 2, 3, 4, 5, 6, 7, 8, 9, 10 or more nucleotidic units comprising a phosphodiester linkage.

26. The composition of embodiment 25, wherein the oligonucleotide composition is characterized in that, when it is contacted with a transcript in a transcript splicing system, splicing of the transcript is altered in that level of inclusion of a nucleic acid sequence is increased relative to that observed under a reference condition selected from the group consisting of absence of the composition, presence of a reference composition, and combinations thereof.

27. The composition of any one of the preceding embodiments, wherein the 5'-end region comprises 1 or more nucleoside units not comprising a 2'-F modified sugar moiety.

28. The composition of any one of the preceding embodiments, wherein the 3'-end region comprises 1 or more nucleoside units not comprising a 2'-F modified sugar moiety.

29. The composition of any one of the preceding embodiments, wherein the middle region comprises 1 or more nucleotidic units comprising no phosphodiester linkage.

30. The composition of any one of the preceding embodiments, wherein the first of the 1, 2, 3, 4, 5, 6, 7, 8, 9, 10 or more nucleoside units comprising a 2'-F modified sugar moiety and a modified internucleotidic linkage of the 5'-end is the first, second, third, fourth or fifth nucleoside unit of the oligonucleotide from the 5'-end, and the last of the 1, 2, 3, 4, 5, 6, 7, 8, 9, 10 or more nucleoside units comprising a 2'-F modified sugar moiety and a modified internucleotidic linkage of the 3'-end is the last, second last, third last, fourth last, or fifth last nucleoside unit of the oligonucleotide.

31. The composition of any one of the preceding embodiments, wherein the 5'-end region comprising 2, 3, 4, 5, 6, 7, 8, 9, 10 or more consecutive nucleoside units comprising a 2'-F modified sugar moiety.

32. The composition of any one of the preceding embodiments, wherein the 5'-end region comprising 5, 6, 7, 8, 9, 10 or more consecutive nucleoside units comprising a 2'-F modified sugar moiety.

33. The composition of any one of the preceding embodiments, wherein the 3'-end region comprising 2, 3, 4, 5, 6, 7, 8, 9, 10 or more consecutive nucleoside units comprising a 2'-F modified sugar moiety.

34. The composition of any one of the preceding embodiments, wherein the 3'-end region comprising 5, 6, 7, 8, 9, 10 or more consecutive nucleoside units comprising a 2'-F modified sugar moiety.

35. The composition of any one of the preceding embodiments, wherein each internucleotidic linkage between two nucleoside units comprising a 2'-F modified sugar moiety in the 5'-end region is independently a modified internucleotidic linkage.

36. The composition of any one of the preceding embodiments, wherein each internucleotidic linkage between two nucleoside units comprising a 2'-F modified sugar moiety in the 3'-end region is independently a modified internucleotidic linkage.

37. The composition of embodiment 35 or 36, wherein each modified internucleotidic linkage is independently a chiral internucleotidic linkage.
38. The composition of embodiment 35 or 36, wherein each modified internucleotidic linkage is independently a chirally controlled internucleotidic linkage.
39. The composition of embodiment 35 or 36, wherein each modified internucleotidic linkage is a phosphorothioate internucleotidic linkage.
40. The composition of embodiment 35 or 36, wherein each modified internucleotidic linkage is a chirally controlled phosphorothioate internucleotidic linkage.
41. The composition of embodiment 35 or 36, wherein each modified internucleotidic linkage is a Sp chirally controlled phosphorothioate internucleotidic linkage.
42. The composition of any one of the preceding embodiments, wherein the middle region comprises 1, 2, 3, 4, 5, 6, 7, 8, 9, 10 or more natural phosphate linkages.
43. The composition of any one of the preceding embodiments, wherein the middle region comprises 1, 2, 3, 4, 5, 6, 7, 8, 9, 10 or more natural phosphate linkages each independently between a nucleoside unit comprising a 2'-$OR^1$ modified sugar moiety and a nucleoside unit comprising a 2'-F modified sugar moiety, or between two nucleoside units each independently comprising a 2'-$OR^1$ modified sugar moiety, wherein $R^1$ is optionally substituted $C_{1-6}$ alkyl.
44. The composition of any one of the preceding embodiments, wherein the middle region comprises 1, 2, 3, 4, 5, 6, 7, 8, 9, 10 or more non-negatively charged internucleotidic linkages.
45. The composition of any one of the preceding embodiments, wherein the middle region comprises 1, 2, 3, 4, 5, 6, 7, 8, 9, 10 or more non-negatively charged internucleotidic linkages each independently between a nucleoside unit comprising a 2'-$OR^1$ modified sugar moiety and a nucleoside unit comprising a 2'-F modified sugar moiety, or between two nucleoside units each independently comprising a 2'-$OR^1$ modified sugar moiety, wherein $R^1$ is optionally substituted $C_{1-6}$ alkyl.
46. The composition of embodiment 43 or 45, wherein 2'-$OR^1$ is 2'-$OCH_3$.
47. The composition of embodiment 43 or 45, wherein 2'-$OR^1$ is 2'-$OCH_2CH_2OCH_3$.
48. The composition of any one of the preceding embodiments, wherein the 5'-end region comprises at least 2, 3, 4, 5, 6, 7, 8, 9, or 10 chiral modified internucleotidic linkages.
49. The composition of any one of the preceding embodiments, wherein the 5'-end region comprises at least 2, 3, 4, 5, 6, 7, 8, 9, or 10 consecutive chiral modified internucleotidic linkages.
50. The composition of any one of the preceding embodiments, wherein each internucleotidic linkage in the 5'-end region is a chiral modified internucleotidic linkage.
51. The composition of any one of the preceding embodiments, wherein the 3'-end region comprises at least 2, 3, 4, 5, 6, 7, 8, 9, or 10 chiral modified internucleotidic linkages.
52. The composition of any one of the preceding embodiments, wherein the 3'-end region comprises at least 2, 3, 4, 5, 6, 7, 8, 9, or 10 consecutive chiral modified internucleotidic linkages.
53. The composition of any one of the preceding embodiments, wherein each internucleotidic linkage in the 3'-end region is a chiral modified internucleotidic linkage.
54. The composition of any one of the preceding embodiments, wherein the middle region comprises at least 2, 3, 4, 5, 6, 7, 8, 9, or 10 chiral modified internucleotidic linkages.

55. The composition of any one of the preceding embodiments, wherein the middle region comprises at least 2, 3, 4, 5, 6, 7, 8, 9, or 10 consecutive chiral modified internucleotidic linkages.
56. The composition of any one of embodiments 48-55, wherein each chiral modified internucleotidic linkage is independently a chirally controlled internucleotidic linkage.
57. The composition of any one of embodiments 48-55, wherein each chiral modified internucleotidic linkage is independently a chirally controlled internucleotidic linkage wherein its chirally controlled linkage phosphorus has a Sp configuration.
58. The composition of any one of embodiments 48-57, wherein each chiral modified internucleotidic linkage is independently a chirally controlled phosphorothioate internucleotidic linkage.
59. The composition of any one of the preceding embodiments, wherein the middle region comprises at least 2, 3, 4, 5, 6, 7, 8, 9, or 10 non-negatively charged internucleotidic linkages.
60. The composition of any one of the preceding embodiments, wherein the middle region comprises at least 2, 3, 4, 5, 6, 7, 8, 9, or 10 neutral internucleotidic linkages.
61. The composition of any one of the preceding embodiments, wherein a neutral internucleotidic linkage is a chiral internucleotidic linkage.
62. The composition of any one of the preceding embodiments, wherein a neutral internucleotidic linkage is a chirally controlled internucleotidic linkage independently of Rp or Sp at its linkage phosphorus.
63. The composition of any one of the preceding embodiments, wherein the base sequence comprises a sequence having no more than 5 mismatches from a 20 base long portion of the dystrophin gene or its complement.
64. The composition of any one of the preceding embodiments, wherein the length of the base sequence of the oligonucleotides of the plurality is no more than 50 bases.
65. The composition of any one of the preceding embodiments, wherein the pattern of backbone chiral centers comprises at least 3, 4, 5, 6, 7, 8, 9, 10, 11, 12, 13, 14, 15, 16, 17, 18, 19, 20, 21, 22, 23, 24, or 25 chirally controlled centers independently of Rp or Sp.
66. The composition of any one of the preceding embodiments, wherein the pattern of backbone chiral centers comprises at least 5 chirally controlled centers independently of Rp or Sp.
67. The composition of any one of the preceding embodiments, wherein the pattern of backbone chiral centers comprises at least 6 chirally controlled centers independently of Rp or Sp.
68. The composition of any one of the preceding embodiments, wherein the pattern of backbone chiral centers comprises at least 10 chirally controlled centers independently of Rp or Sp.
69. The composition of any one of the preceding embodiments, wherein the oligonucleotides of the particular oligonucleotide type are capable of mediating skipping of one or more exons of the dystrophin gene.
70. The composition of any one of the preceding embodiments, wherein the oligonucleotides of the plurality are capable of mediating the skipping of exon 45, 51 or 53 of the dystrophin gene.
71. The composition of embodiment 70, wherein the oligonucleotides of the plurality are capable of mediating the skipping of exon 45 of the dystrophin gene.

72. The composition of embodiment 70, wherein the oligonucleotides of the plurality are capable of mediating the skipping of exon 51 of the dystrophin gene.

73. The composition of embodiment 70, wherein the oligonucleotides of the plurality are capable of mediating the skipping of exon 53 of the dystrophin gene.

74. The composition of any one of preceding embodiments, wherein the composition provides exon skipping of two or more exons.

75. The composition of embodiment 71, wherein the base sequence comprises a sequence having no more than 5 mismatches from a sequence of Table A1.

76. The composition of embodiment 71, wherein the base sequence comprises or is a sequence of Table A1.

77. The composition of embodiment 71, wherein the base sequence is a sequence of Table A1.

78. The composition of any one of the preceding embodiments, wherein the oligonucleotides of the plurality are oligonucleotides of an oligonucleotide selected from Table A1.

79. The composition of any one of the preceding embodiments, wherein the oligonucleotides comprise 1, 2, 3, 4, 5, 6, 7, 8, 9, 10 or more non-negatively charged internucleotidic linkages.

80. The composition of any one of the preceding embodiments, wherein the oligonucleotides comprise 1, 2, 3, 4, 5, 6, 7, 8, 9, 10 or more chirally controlled non-negatively charged internucleotidic linkages.

81. The composition of any one of the preceding embodiments, wherein the oligonucleotides comprise 2, 3, 4, 5, 6, 7, 8, 9, 10 or more consecutive non-negatively charged internucleotidic linkages.

82. The composition of any one of the preceding embodiments, wherein the oligonucleotides comprise 2, 3, 4, 5, 6, 7, 8, 9, 10 or more consecutive chirally controlled non-negatively charged internucleotidic linkages.

83. The composition of any one of the preceding embodiments, wherein the oligonucleotides comprise a wing-core-wing, core-wing, or wing-core structure.

84. The composition of any one of the preceding embodiments, wherein a wing comprises 1, 2, 3, 4, 5, 6, 7, 8, 9, 10 or more non-negatively charged internucleotidic linkages.

85. The composition of any one of the preceding embodiments, wherein the oligonucleotides comprise a wing-core-wing, core-wing, or wing-core structure, and wherein a wing comprises 1, 2, 3, 4, 5, 6, 7, 8, 9, 10 or more chirally controlled non-negatively charged internucleotidic linkages.

86. The composition of any one of the preceding embodiments, wherein the oligonucleotides comprise a wing-core-wing, core-wing, or wing-core structure, and wherein a wing comprises 2, 3, 4, 5, 6, 7, 8, 9, 10 or more consecutive non-negatively charged internucleotidic linkages.

87. The composition of any one of the preceding embodiments, wherein the oligonucleotides comprise a wing-core-wing, core-wing, or wing-core structure, and wherein a wing comprises 2, 3, 4, 5, 6, 7, 8, 9, 10 or more consecutive chirally controlled non-negatively charged internucleotidic linkages.

88. The composition of any one of the preceding embodiments, wherein the oligonucleotides comprise or consist of a wing-core-wing structure, and wherein only one wing comprise one or more non-negatively charged internucleotidic linkages.

89. The composition of any one of the preceding embodiments, wherein the oligonucleotides comprise a wing-core-wing, core-wing, or wing-core structure, and wherein a core comprises 1, 2, 3, 4, 5, 6, 7, 8, 9, 10 or more non-negatively charged internucleotidic linkages.

90. The composition of any one of the preceding embodiments, wherein the oligonucleotides comprise a wing-core-wing, core-wing, or wing-core structure, and wherein a core comprises 1, 2, 3, 4, 5, 6, 7, 8, 9, 10 or more chirally controlled non-negatively charged internucleotidic linkages.

91. The composition of any one of the preceding embodiments, wherein the oligonucleotides comprise a wing-core-wing, core-wing, or wing-core structure, and wherein a core comprises 2, 3, 4, 5, 6, 7, 8, 9, 10 or more consecutive non-negatively charged internucleotidic linkages.

92. The composition of any one of the preceding embodiments, wherein the oligonucleotides comprise a wing-core-wing, core-wing, or wing-core structure, and wherein a core comprises 2, 3, 4, 5, 6, 7, 8, 9, 10 or more consecutive chirally controlled non-negatively charged internucleotidic linkages.

93. The composition of any one of the preceding embodiments, wherein 40%, 45%, 50%, 55%, 60%, 65%, 70%, 75%, 80%, 85%, 90%, 95%, or 100% of internucleotidic linkages of a wing is independently a non-negatively charged internucleotidic linkage, a natural phosphate internucleotidic linkage or a Rp chiral internucleotidic linkage.

94. The composition of any one of the preceding embodiments, wherein 40%, 45%, 50%, 55%, 60%, 65%, 70%, 75%, 80%, 85%, 90%, 95%, or 100% of internucleotidic linkages of a wing is independently a non-negatively charged internucleotidic linkage or a natural phosphate internucleotidic linkage.

95. The composition of any one of the preceding embodiments, wherein 40%, 45%, 50%, 55%, 60%, 65%, 70%, 75%, 80%, 85%, 90%, 95%, or 100% of internucleotidic linkages of a wing is independently a non-negatively charged internucleotidic linkage.

96. The composition of any one of embodiments 93-95, wherein the percentage is 50% or more.

97. The composition of any one of embodiments 93-95, wherein the percentage is 60% or more.

98. The composition of any one of embodiments 93-95, wherein the percentage is 75% or more.

99. The composition of any one of embodiments 93-95, wherein the percentage is 80% or more.

100. The composition of any one of embodiments 93-95, wherein the percentage is 90% or more.

101. The composition of any one of the preceding embodiments, wherein the oligonucleotides each comprise a non-negatively charged internucleotidic linkage and a natural phosphate internucleotidic linkage.

102. The composition of any one of the preceding embodiments, wherein the oligonucleotides each comprise a non-negatively charged internucleotidic linkage, a natural phosphate internucleotidic linkage and a Rp chiral internucleotidic linkage.

103. The composition of any one of the preceding embodiments, wherein a wing comprises a non-negatively charged internucleotidic linkage and a natural phosphate internucleotidic linkage.

104. The composition of any one of the preceding embodiments, wherein a wing comprises a non-negatively charged internucleotidic linkage, a natural phosphate internucleotidic linkage and a Rp chiral internucleotidic linkage.

105. The composition of any one of the preceding embodiments, wherein a core comprises 1, 2, 3, 4, 5, 6, 7, 8, 9, 10 or more non-negatively charged internucleotidic linkages.

106. The composition of any one of the preceding embodiments, wherein all non-negatively charged internucleotidic linkages of the same oligonucleotide have the same constitution.

107. The composition of any one of the preceding embodiments, wherein each of the non-negatively charged internucleotidic linkages independently has the structure of formula II, II-a-1, II-a-2, II-b-1, II-b-2, II-c-1, II-c-2, II-d-1, II-d-2, or a salt form thereof.

108. The composition of any one of the preceding embodiments, wherein each of the non-negatively charged internucleotidic linkages independently has the structure of formula II, II-a-1, II-a-2, II-b-1, II-b-2, II-c-1, II-c-2, II-d-1, II-d-2, or a salt form thereof.

109. The composition of any one of the preceding embodiments, wherein the pattern of backbone linkages comprises at least one non-negatively charged internucleotidic linkage which is a neutral internucleotidic linkage.

110. The composition of any one of the preceding embodiments, wherein the oligonucleotides of the particular type are structurally identical.

111. The composition of any one of the preceding claims, wherein each of the oligonucleotides comprises a chemical moiety conjugated to the oligonucleotide chain of the oligonucleotide optionally through a linker moiety, wherein the chemical moiety comprises a carbohydrate moiety, a peptide moiety, a receptor ligand moiety, or a moiety having the structure of $—N(R^1)_2$, $—N(R^1)_3$, or $—N═C(N(R^1)_2)_2$.

112. The composition of any one of the preceding claims, wherein each of the oligonucleotides comprises a chemical moiety conjugated to the oligonucleotide chain of the oligonucleotide optionally through a linker moiety, wherein the chemical moiety comprises a guanidine moiety.

113. The composition of any one of the preceding claims, wherein each of the oligonucleotides comprises a chemical moiety conjugated to the oligonucleotide chain of the oligonucleotide optionally through a linker moiety, wherein the chemical moiety comprises $—N═C(N(CH_3)_2)_2$.

114. The composition of any one of the preceding embodiments, wherein at least 5%, 10%, 20%, 30%, 40%, 50%, 60%, 70%, 80%, or 90% of the oligonucleotides in the composition that have the same constitution as oligonucleotides of the particular oligonucleotide type are oligonucleotides of the particular oligonucleotide type.

115. The composition of any one of the preceding embodiments, wherein at least 5%, 10%, 20%, 30%, 40%, 50%, 60%, 70%, 80%, or 90% of the oligonucleotides in the composition that have the base sequence, pattern of backbone linkages, and pattern of backbone phosphorus modifications of the particular oligonucleotide type are oligonucleotides of the particular oligonucleotide type.

116. The composition of any one of the preceding embodiments, wherein at least 5%, 10%, 20%, 30%, 40%, 50%, 60%, 70%, 80%, or 90% of the oligonucleotides in the composition that have the base sequence of the particular oligonucleotide type are oligonucleotides of the particular oligonucleotide type.

117. The composition of any one of embodiments 114-116, wherein the percentage is at least 10%.

118. The composition of any one of embodiments 114-116, wherein the percentage is at least 50%.

119. The composition of any one of embodiments 114-116, wherein the percentage is at least 80%.

120 The composition of any one of embodiments 114-116, wherein the percentage is at least 90%.

121. The composition of any one of the preceding embodiments, wherein a non-negatively charged internucleotidic linkage is a phosphoramidate linkage.

122. The composition of any one of the preceding embodiments, wherein a non-negatively charged internucleotidic linkage comprises a guanidine moiety.

123. The composition of any one of the preceding embodiments, wherein a non-negatively charged internucleotidic linkage has the structure of formula I:

I

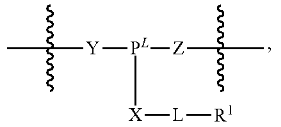

or a salt form thereof, wherein:

$P^L$ is P(═W), P, or $P→B(R')_3$;

W is O, N(-L-$R^5$), S or Se;

each of $R^1$ and $R^5$ is independently —H, -L-R', halogen, —CN, $—NO_2$, -L-$Si(R')_3$, —OR', —SR', or $—N(R')_2$;

each of X, Y and Z is independently —O—, —S—, —N(-L-$R^5$)—, or L;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, $—C(R')_2—$, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, $—S(O)_2—$, $—S(O)_2N(R')—$, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, $—P(OR')[B(R')_3]—$, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or $—OP(OR')[B(R')_3]O—$, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each R' is independently —R, —C(O)R, —C(O)OR, or $—S(O)_2R$;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

124. The composition of any one of the preceding embodiments, wherein each non-negatively charged internucleotidic linkage independently has the structure of formula I or a salt form thereof.

125. The composition of any one of the preceding embodiments, wherein a non-negatively charged internucleotidic linkage has the structure of formula I-n-1 or a salt form thereof:

I-n-1

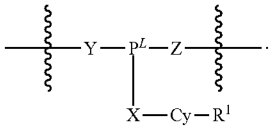

126. The composition of any one of the preceding embodiments, wherein each non-negatively charged internucleotidic linkage independently has the structure of formula I-n-1 or a salt form thereof.

127. The composition of any one of the preceding embodiments, wherein a non-negatively charged internucleotidic linkage has the structure of formula I-n-2 or a salt form thereof:

I-n-2

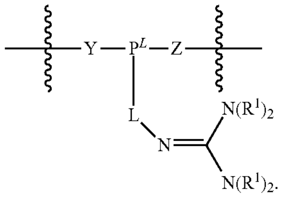

128. The composition of any one of the preceding embodiments, wherein a non-negatively charged internucleotidic linkage has the structure of formula I-n-3 or a salt form thereof:

I-n-3

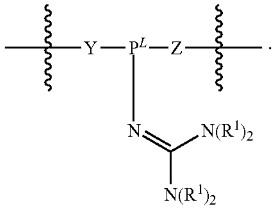

129. The composition of any one of the preceding embodiments, wherein each non-negatively charged internucleotidic linkage independently has the structure of formula I-n-3 or a salt form thereof.

130. The composition of any one of the preceding embodiments, wherein a non-negatively charged internucleotidic linkage has the structure of formula I-n-3 or a salt form thereof, wherein one R' from one —$N(R')_2$ and one R' from the other —$N(R')_2$ are taken together with their intervening atoms to form an optionally substituted, 3-30 membered, monocyclic, bicyclic or polycyclic ring having, in addition to the intervening atoms, 0-10 heteroatoms.

131. The composition of any one of the preceding embodiments, wherein each non-negatively charged internucleotidic linkage independently has the structure of formula I-n-3 or a salt form thereof, wherein one R' from one —$N(R')_2$ and one R' from the other —$N(R')_2$ are taken together with their intervening atoms to form an optionally substituted, 3-30 membered, monocyclic, bicyclic or polycyclic ring having, in addition to the intervening atoms, 0-10 heteroatoms.

132. The composition of any one of the preceding embodiments, wherein a non-negatively charged internucleotidic linkage has the structure of formula I-n-3 or a salt form thereof, wherein one R' from one —$N(R')_2$ and one R' from the other —$N(R')_2$ are taken together with their intervening atoms to form an optionally substituted 5-membered monocyclic ring having no more than two nitrogen atoms.

133. The composition of any one of the preceding embodiments, wherein each non-negatively charged internucleotidic linkage independently has the structure of formula I-n-3 or a salt form thereof, wherein one R' from one —$N(R')_2$ and one R' from the other —$N(R')_2$ are taken together with their intervening atoms to form an optionally substituted 5-membered monocyclic ring having no more than two nitrogen atoms.

134. The composition of any one of embodiments 128-131, wherein the ring formed is a saturated ring.

135. The composition of any one of embodiments 128-131, wherein the ring formed is a partially unsaturated ring.

136. The composition of any one of the preceding embodiments, wherein a non-negatively charged internucleotidic linkage has the structure of formula II:

II

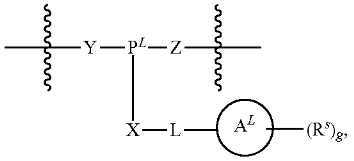

or a salt form thereof, wherein:

$P^L$ is P(=W), P, or P→$B(R')_3$;

W is O, N(-L-$R^5$), S or Se;

each of X, Y and Z is independently-O—, —S—, —N(-L-$R^5$)—, or L;

$R^s$ is —H, -L-R', halogen, —CN, —$NO_2$, -L-$Si(R')_3$, —OR', —SR', or —$N(R')_2$;

Ring $A^L$ is an optionally substituted 3-20 membered monocyclic, bicyclic or polycyclic ring having 0-10 heteroatoms;

each $R^s$ is independently —H, halogen, —CN, —$N_3$, —NO, —$NO_2$, -L-R', -L-$Si(R)_3$, -L-OR', -L-SR', -L-$N(R')_2$, —O-L-R', —O-L-$Si(R)_3$, —O-L-OR', —O-L-SR', or —O-L-$N(R')_2$;

g is 0-20;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or, two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

137. The composition of any one of the preceding embodiments, wherein each non-negatively charged internucleotidic linkage independently has the structure of formula II, or a salt form thereof.

138. The composition any one of the preceding embodiments, wherein a non-negatively charged internucleotidic linkage has the structure of formula II-a-1:

II-a-1

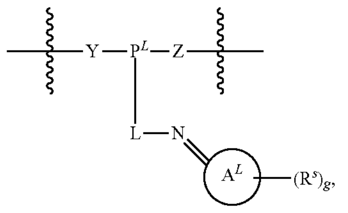

or a salt form thereof.

139. The composition of any one of the preceding embodiments, wherein each non-negatively charged internucleotidic linkage independently has the structure of formula II-a-1, or a salt form thereof.

140. The composition any one of the preceding embodiments, wherein a non-negatively charged internucleotidic linkage has the structure of formula II-a-2:

II-a-2

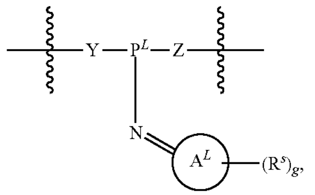

or a salt form thereof.

141. The composition of any one of the preceding embodiments, wherein each non-negatively charged internucleotidic linkage independently has the structure of formula II-a-2, or a salt form thereof.

142. The composition any one of the preceding embodiments, wherein a non-negatively charged internucleotidic linkage has the structure of formula II-b-1:

II-b-1

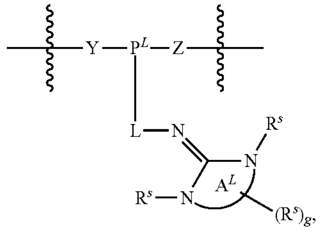

or a salt form thereof.

143. The composition of any one of the preceding embodiments, wherein each non-negatively charged internucleotidic linkage independently has the structure of formula II-b-1, or a salt form thereof.

144. The composition any one of the preceding embodiments, wherein a non-negatively charged internucleotidic linkage has the structure of formula II-b-2:

II-b-2

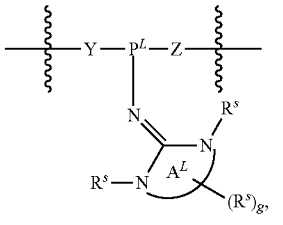

or a salt form thereof.

145. The composition of any one of the preceding embodiments, wherein each non-negatively charged internucleotidic linkage independently has the structure of formula II-b-2, or a salt form thereof.

146. The composition any one of the preceding embodiments, wherein a non-negatively charged internucleotidic linkage has the structure of formula II-c-1:

II-c-1

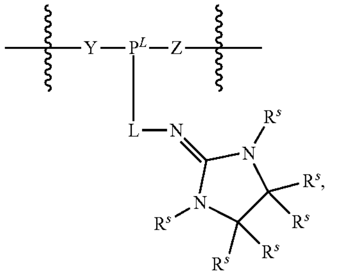

or a salt form thereof.

147. The composition of any one of the preceding embodiments, wherein each non-negatively charged internucleotidic linkage independently has the structure of formula II-c-1, or a salt form thereof.

148. The composition any one of the preceding embodiments, wherein a non-negatively charged internucleotidic linkage has the structure of formula II-c-2:

II-c-2

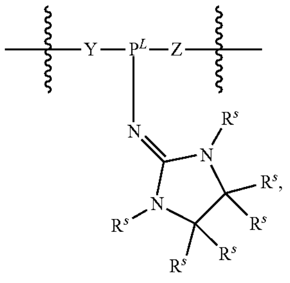

or a salt form thereof.

149. The composition of any one of the preceding embodiments, wherein each non-negatively charged internucleotidic linkage independently has the structure of formula II-c-2, or a salt form thereof.

150. The composition any one of the preceding embodiments, wherein a non-negatively charged internucleotidic linkage has the structure of formula II-d-1:

II-d-1

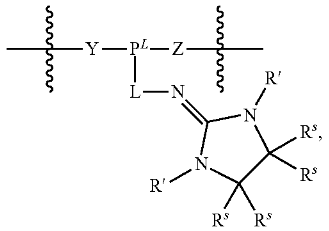

or a salt form thereof.

151. The composition of any one of the preceding embodiments, wherein each non-negatively charged internucleotidic linkage independently has the structure of formula II-d-1, or a salt form thereof.

152. The composition any one of the preceding embodiments, wherein a non-negatively charged internucleotidic linkage has the structure of formula II-d-2:

II-d-2

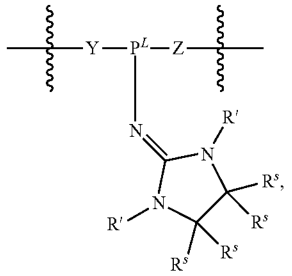

or a salt form thereof.

153. The composition of any one of the preceding embodiments, wherein each non-negatively charged internucleotidic linkage independently has the structure of formula II-d-2, or a salt form thereof.

154. The composition of any one of embodiments 136-153, wherein each non-negatively charged internucleotidic linkage has the same structure.

155. The composition of any one of the preceding embodiments, wherein, if applicable, each internucleotidic linkage in the oligonucleotides of the plurality that is not a non-negatively charged internucleotidic linkage independently has the structure of formula I.

156. The composition of any one of the preceding embodiments, wherein each internucleotidic linkage in the oligonucleotides of the plurality independently has the structure of formula I.

157. The composition of any one of the preceding embodiments, wherein one or more $P^L$ is P(=W).

158. The composition of any one of the preceding embodiments, wherein each $P^L$ is independently P(=W).

159. The composition of any one of the preceding embodiments, wherein one or more W is O.

160. The composition of any one of the preceding embodiments, wherein each W is O.

161. The composition of any one of the preceding embodiments, wherein one or more Y is O.

162. The composition of any one of the preceding embodiments, wherein each Y is O.

163. The composition of any one of the preceding embodiments, wherein one or more Z is O.

164. The composition of any one of the preceding embodiments, wherein each Z is O.

165. The composition of any one of the preceding embodiments, wherein one or more X is O.

166. The composition of any one of the preceding embodiments, wherein one or more X is S.

167. The composition of any one of the preceding embodiments, wherein a non-negatively charged

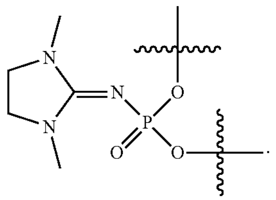

internucleotidic linkage has the structure of

168. The composition of any one of the preceding embodiments, wherein a non-negatively charged internucleotidic linkage has the structure of

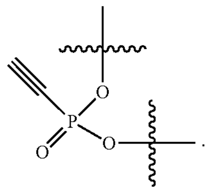

169. The composition of any one of the preceding embodiments, wherein a non-negatively charged internucleotidic linkage has the structure of

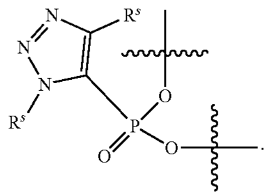

170. The composition of any one of the preceding embodiments, wherein for each internucleotidic linkage of formula I or a salt fore thereof that is not a non-negatively charged internucleotidic linkage, X is independently O or S, and -$L^s$-$R^5$ is —H (natural phosphate linkage or phosphorothioate linkage, respectively).

171. The composition of any one of the preceding embodiments, wherein each phosphorothioate linkage, if any, in the oligonucleotides of the plurality is independently a chirally controlled internucleotidic linkage.

172. The composition of any one of the preceding embodiments, wherein at least one non-negatively charged internucleotidic linkage is a chirally controlled oligonucleotide composition.

173. The composition of any one of the preceding embodiments, wherein at least one non-negatively charged internucleotidic linkage is a chirally controlled oligonucleotide composition.

174. The composition of any one of the preceding embodiments, wherein the oligonucleotides of the plurality comprise a targeting moiety wherein the targeting moiety is independently connected to an oligonucleotide backbone through a linker.

175. The composition of embodiment 174, wherein the targeting moiety is a carbohydrate moiety.

176. The composition of embodiment 174 or 175, wherein the targeting moiety comprises or is a GalNAc moiety.

177. The composition of any one of the preceding embodiments, wherein the oligonucleotides of the plurality comprise a lipid moiety wherein the lipid moiety is independently connected to an oligonucleotide backbone through a linker.

178. The composition of any one of the preceding embodiments, wherein the oligonucleotide of the plurality comprise a pattern of backbone chiral centers of (Np/Op)t[(Rp)n(Sp)m]y, (Np/Op)t[(Op)n(Sp)m]y, (Np/Op)t[(Op/Rp)n(Sp)m]y, (Sp)t[(Rp)n(Sp)m]y, (Sp)t[(Op)n(Sp)m]y, (Sp)t[(Op/Rp)n(Sp)m]y, [(Rp)n(Sp)m]y, [(Op)n(Sp)m]y, [(Op/Rp)n(Sp)m]y, (Rp)t(Np)n(Rp)m, (Rp)t(Sp)n(Rp)m, (Rp)t[(Np/Op)n]y(Rp)m, (Rp)t[(Sp/Np)n]y(Rp)m, (Rp)t[(Sp/Op)n]y(Rp)m, (Np/Op)t(Np)n(Np/Op)m, (Np/Op)t(Sp)n(Np/Op)m, (Np/Op)t[(Np/Op)n]y(Np/Op)m, (Np/Op)t[(Sp/Op)n]y(Np/Op)m, (Np/Op)t[(Sp/Op)n]y(Np/Op)m, (Rp/Op)t(Np)n(Rp/Op)m, (Rp/Op)t(Sp)n(Rp/Op)m, (Rp/Op)t[(Np/Op)n]y(Rp/Op)m, (Rp/Op)t[(Sp/Op)n]y(Rp/Op)m, or (Rp/Op)t[(Sp/Op)n]y(Rp/Op)m.

179. The composition of any one of the preceding embodiments, wherein the oligonucleotide of the plurality comprise a pattern of backbone chiral centers of (Sp)t[(Rp)n(Sp)m]y.

180. The composition of any one of the preceding embodiments, wherein y is 1.

181. The composition of any one of the preceding embodiments, wherein n is 1.

182. The composition of any one of the preceding embodiments, wherein t is 1, 2, 3, 4, 5, 6, 7, 8, 9 or 10.

183. The composition of any one of the preceding embodiments, wherein t is 4, 5, 6, 7, 8, 9 or 10.

184. The composition of any one of the preceding embodiments, wherein m is 2, 3, 4, 5, 6, 7, 8, 9 or 10.

185. The composition of any one of the preceding embodiments, wherein m is 4, 5, 6, 7, 8, 9 or 10.

186. The composition of any one of the preceding embodiments, wherein oligonucleotides of the plurality has the structure of formula O-I or a salt thereof.

187. The composition of any one of the preceding embodiments, wherein $L^P$ in formula O-I independently has the structure of formula I, I-a, I-b, I-c, I-n-1, I-n-2, I-n-3, I-n-4, II, II-a-1, II-a-2, II-b-1, II-b-2, II-c-1, II-c-2, II-d-1, II-d-2, or a salt form thereof.

188. The composition of any one of the preceding embodiments, wherein a

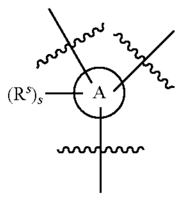

is

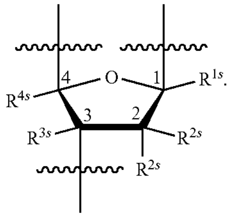

189. The composition of any one of the preceding embodiments, wherein a

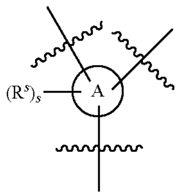

is

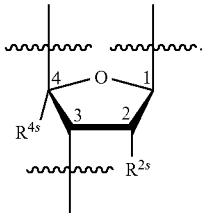

190. The composition of any one of the preceding embodiments, wherein a

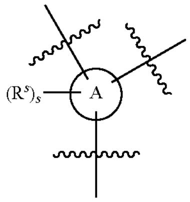

is

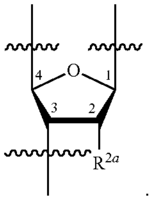

191. The composition of any one of the preceding embodiments, wherein a

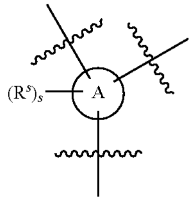

is optionally substituted

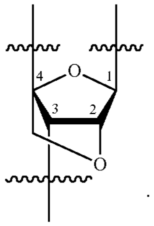 [SMILES: *C1[C@@H]2OC[C@]1(*)O[C@H]2*]

192. The composition of any one of the preceding embodiments, wherein $L^s$ in formula O-I between $L^P$ and Ring A is $—C(R^{5s})_2—$.

193. The composition of any one of the preceding embodiments, wherein $L^s$ in formula O-I between $L^P$ and Ring A is $—CH(R^{5s})—$.

194. The composition of any one of the preceding embodiments, wherein $-L^{3E}-R^{3E}$ in formula O-I IS —OH.

195. The composition of any one of the preceding embodiments, wherein oligonucleotides of the plurality has the structure of $A^c-[-L^{LD}-(R^{LD})_a]_b$, $A^c-[-L^M (R^D)_a]_b$, $[(A^c)_a-L^M]_b-R^D$, $(A^c)_a-L^M-(A^c)_b$, or $(A^c)_a-L^M-(R^D)_b$, or a salt thereof.

196. The composition of embodiment 195, wherein $H-A^c$, $[H]_a-A^c$ or $[H]_b-A^c$ is an oligonucleotide of any one of embodiments 186-194.

197. The composition of any one of the preceding embodiments, wherein oligonucleotides of the plurality exist as salts, wherein one or more non-neutral internucleotidic linkages at the condition of the composition independently exist as a salt form.

198. The composition of any one of the preceding embodiments, wherein oligonucleotides of the plurality exist as salts, wherein one or more negatively-charged internucleotidic linkages at the condition of the composition independently exist as a salt form.

199. The composition of any one of the preceding embodiments, wherein oligonucleotides of the plurality exist as salts, wherein one or more negatively-charged internucleotidic linkages at the condition of the composition independently exist as a metal salt.

200. The composition of any one of the preceding embodiments, wherein oligonucleotides of the plurality exist as salts, wherein each negatively-charged internucleotidic linkage at the condition of the composition independently exists as a metal salt.

201. The composition of any one of the preceding embodiments, wherein oligonucleotides of the plurality exist as salts, wherein each negatively-charged internucleotidic linkage at the condition of the composition independently exists as sodium salt.

202. The composition of any one of the preceding embodiments, wherein oligonucleotides of the plurality exist as salts, wherein each negatively-charged internucleotidic linkage is independently a natural phosphate linkage (the neutral form of which is —O—P(O)(OH)—O) or phosphorothioate internucleotidic linkage (the neutral form of which is —O—P(O)(SH)—O).

203. The composition of any one of the preceding embodiments, wherein each heteroatom in heteroaliphatic, heteroalkyl, heterocyclyl, or heteroaryl is independently boron, nitrogen, oxygen, silicon, sulfur, or phosphorus.

204. The composition of any one of the preceding embodiments, wherein each heteroatom in heteroaliphatic, heteroalkyl, heterocyclyl, or heteroaryl is independently nitrogen, oxygen, silicon, sulfur, or phosphorus.

205. The composition of any one of the preceding embodiments, wherein each heteroatom in heteroaliphatic, heteroalkyl, heterocyclyl, or heteroaryl is independently nitrogen, oxygen, or sulfur.

206. A pharmaceutical composition comprising an oligonucleotide composition of any one of the preceding embodiments and a pharmaceutically acceptable carrier.

207. A method for altering splicing of a target transcript, comprising administering an oligonucleotide composition of any one of the preceding embodiments.

208. The method of embodiment 207, wherein the splicing of the target transcript is altered relative to absence of the composition.

209. The method of any one of the preceding embodiments, wherein the alteration is that one or more exon is skipped at an increased level relative to absence of the composition.

210. The method of any one of the preceding embodiments, wherein the target transcript is pre-mRNA of dystrophin.

211. The method of any one of the preceding embodiments, wherein exon 51 of dystrophin is skipped at an increased level relative to absence of the composition.

212. The method of any one of embodiments 207-210, wherein exon 53 of dystrophin is skipped at an increased level relative to absence of the composition.

213. The method of any one of embodiments 207-210, wherein exon 45 of dystrophin is skipped at an increased level relative to absence of the composition.

214. The method of any one of the preceding embodiments, wherein two or more exons of dystrophin is skipped at an increased level relative to absence of the composition 215. The method of any one of the preceding embodiments, wherein a protein encoded by the mRNA with the exon skipped provides one or more functions better than a protein encoded by the corresponding mRNA without the exon skipping.

216. A method for treating muscular dystrophy, Duchenne (Duchenne's) muscular dystrophy (DMD), or Becker (Becker's) muscular dystrophy (BMD), comprising administering to a subject susceptible thereto or suffering therefrom a composition of any one of the preceding embodiments.

217. A method for treating muscular dystrophy, Duchenne (Duchenne's) muscular dystrophy (DMD), or Becker (Becker's) muscular dystrophy (BMD), comprising (a) administering to a subject susceptible thereto or suffering therefrom a composition of any one of the preceding embodiments, and (b) administering to the subject additional treatment.

218. The method of embodiment 217, wherein the additional treatment is capable of preventing, treating, ameliorating or slowing the progress of muscular dystrophy, Duchenne (Duchenne's) muscular dystrophy (DMD), or Becker (Becker's) muscular dystrophy (BMD).

219. The method of any one of the preceding embodiments, wherein the additional treatment comprises administering a composition of any one of the preceding embodiments, wherein oligonucleotides of the composition have a different base sequence.

220. The method of any one of the preceding embodiments, wherein the additional treatment comprises administering a composition of any one of the preceding embodiments, wherein oligonucleotides of the composition have a different base sequence and target a different exon.

221. The composition of any of the preceding embodiments, wherein the transcript splicing system comprises a myoblast or myotubule.

222. The composition of any of the preceding embodiments, wherein the transcript splicing system comprises a myoblast cell.

223. The composition of any of the preceding embodiments, wherein the transcript splicing system comprises a myoblast cell, which is contacted with the composition after 0, 4 or 7 days of pre-differentiation.

224. A composition comprising a combination comprising: (a) a first composition of any of the preceding embodiments; (b) a second composition of any of the preceding embodiments; and, optionally (c) a third composition of any of the preceding embodiments, wherein the first, second and third compositions are different.

EXEMPLIFICATION

The foregoing has been a description of certain non-limiting embodiments of the disclosure. Accordingly, it is to be understood that embodiments of the disclosure herein described are merely illustrative of applications of principles of the disclosure. Reference herein to details of illustrated embodiments is not intended to limit the scope of any claims.

Various methods for preparing, and for assessing properties and/or activities of, oligonucleotides and oligonucleotide compositions are widely known in the art and may be utilized in accordance with the present disclosure, including but not limited to those described in U.S. Pat. Nos. 9,394,333, 9,744,183, 9,605,019, 9,598,458, US 2015/0211006, US 2017/0037399, WO 2017/015555, WO 2017/192664, WO 2017/015575, WO 2017/062862, WO 2017/160741, WO 2017/192679, WO 2017/210647, WO 2018/223056, WO 2018/237194, and WO 2019/055951, the methods and reagents of each of which are incorporated herein by reference. In some embodiments, the present disclosure provides technologies for preparing oligonucleotides and compositions thereof, particularly chirally controlled oligonucleotides which comprise neutral backbones (e.g., n001, n002, n003, n004, n005, n006, n007, n008, n009, n010, etc.) and chirally controlled oligonucleotide compositions thereof, and technologies for assessing and using various oligonucleotides and compositions thereof. Among other things, Applicant describes herein example technologies for preparing, assessing and using provided oligonucleotides and oligonucleotide compositions.

Functions and advantage of certain embodiments of the present disclosure may be more fully understood from the examples described below. The following examples are intended to illustrate certain benefits of such embodiments.

Example 1. Example Synthesis of Oligonucleotide Compositions

Technologies for preparing oligonucleotide and compositions thereof are widely known in the art. In some embodiments, oligonucleotides and oligonucleotide compositions of the present disclosure were prepared using technologies, e.g., reagents (e.g., solid supports, coupling reagents, cleavage reagents, phosphoramidites, etc.), chiral auxiliaries, solvents (e.g., for reactions, washing, etc.), cycles, reaction conditions (e.g., time, temperature, etc.), etc., described in one or more of U.S. Pat. Nos. 9,394,333, 9,744,183, 9,605,019, 9,598,458, US 2015/0211006, US 2017/0037399, WO 2017/015555, WO 2017/192664, WO 2017/015575, WO 2017/062862, WO 2017/160741, WO 2017/192679, WO 2017/210647, WO 2018/223056, WO 2018/237194, and WO 2019/055951.

Example 2. Example Synthesis of Oligonucleotides Comprising an Internucleotidic Linkage Comprising a Triazole Moiety or an Alkyne Moiety Various types of internucleotidic linkages can be prepared in accordance with the present disclosure. Described in this example is preparation of oligonucleotides comprising internucleotidic linkages comprising triazole moieties. As those skilled in the art appreciates, technology described herein can be readily utilized to conjugate various desirable moieties, e.g., those derived from GalNAc, lipids, peptides, ligands, etc. Among other things, such conjugation can be useful for delivery of oligonucleotides to various target systems (e.g., CNS, muscles, eye, etc.).

Example oligonucleotide comprising internucleotidic linkages comprising triazole moieties.

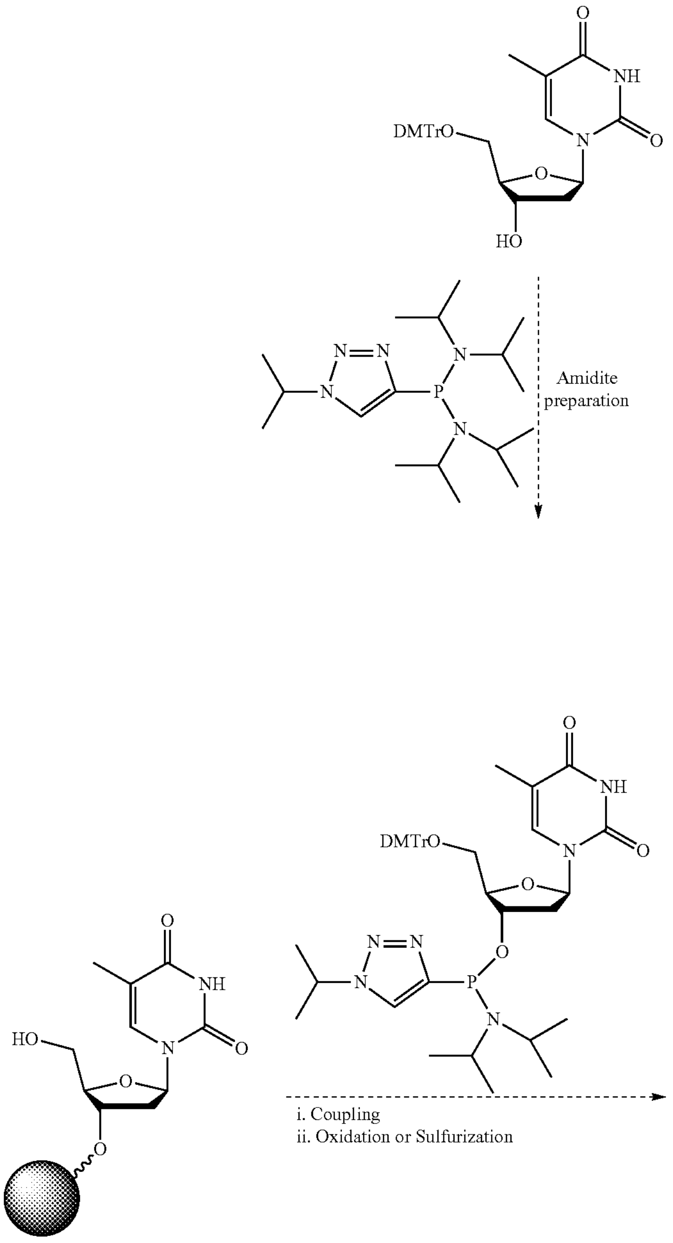

-continued
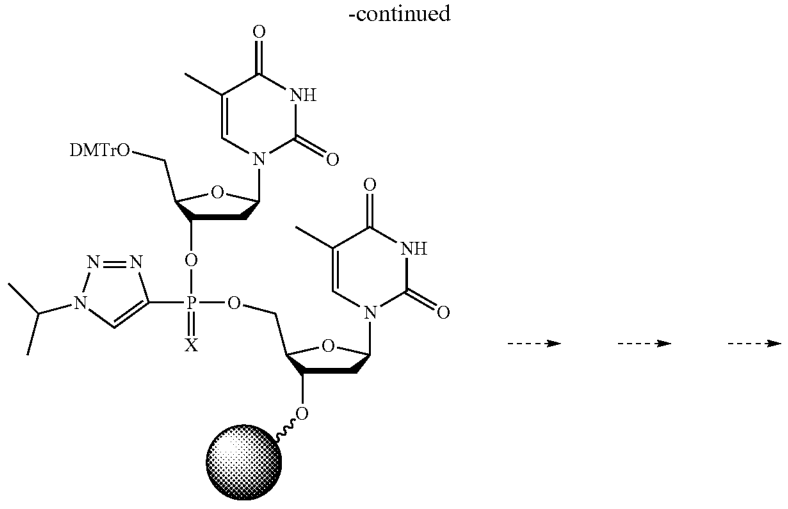
X = O or S
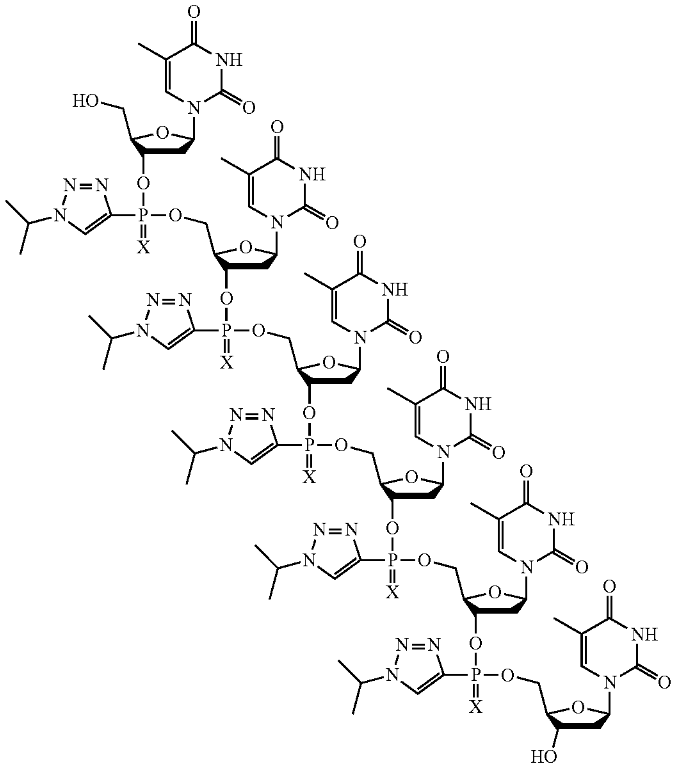
Synthesis scheme for dimer preparation in solution phase.
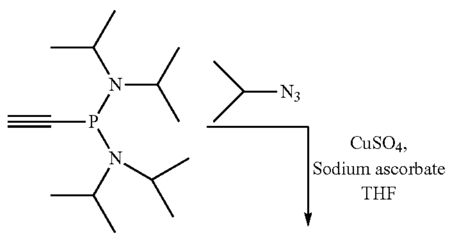

-continued
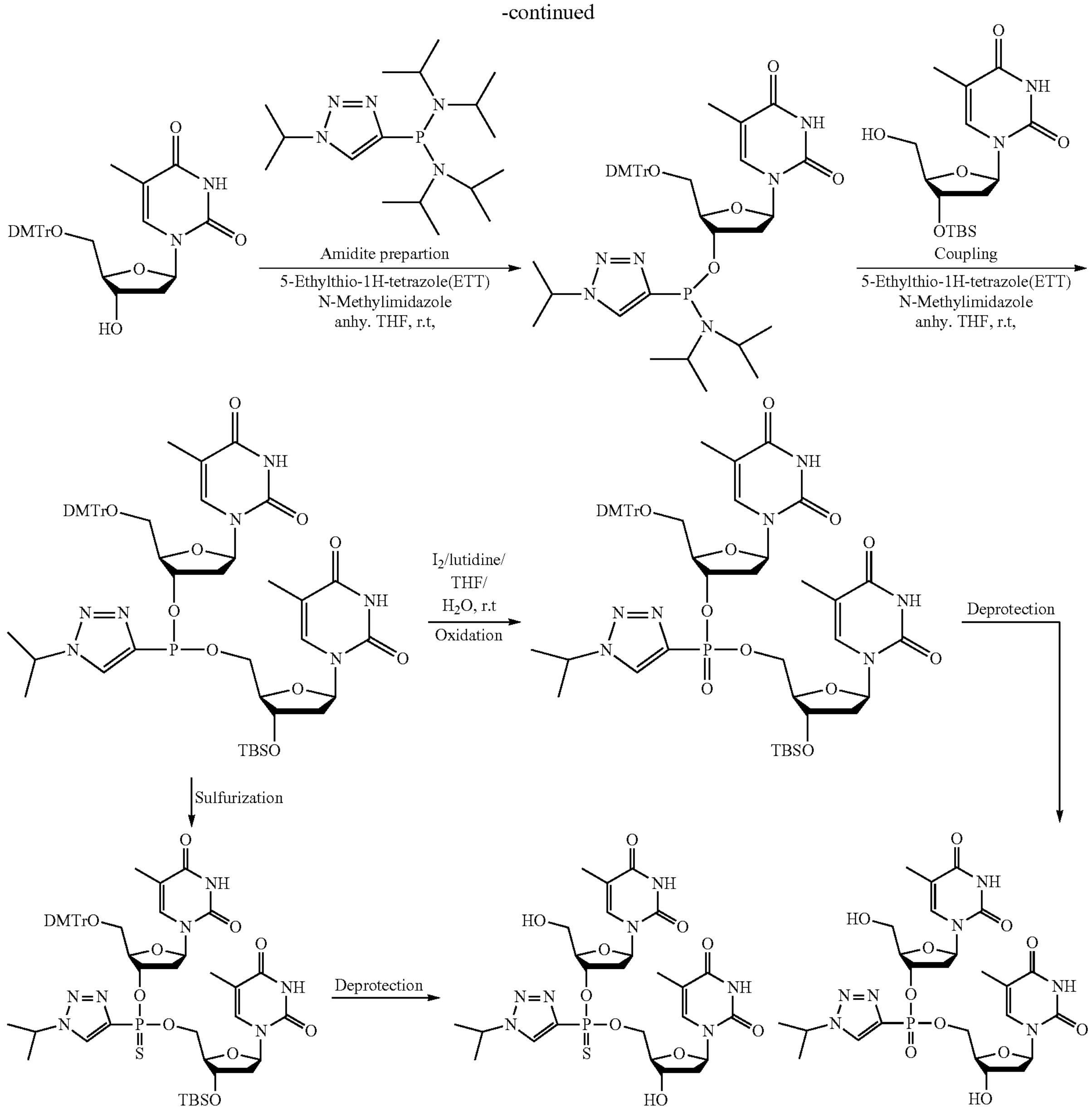
Synthesis scheme for dimer preparation on solid support.
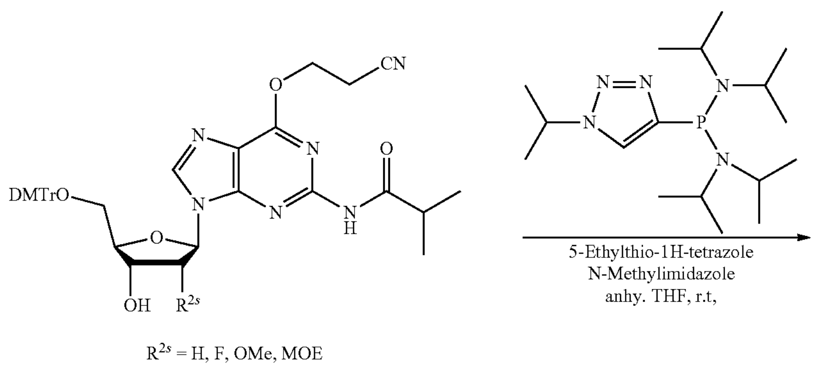
$R^{2s}$ = H, F, OMe, MOE -continued
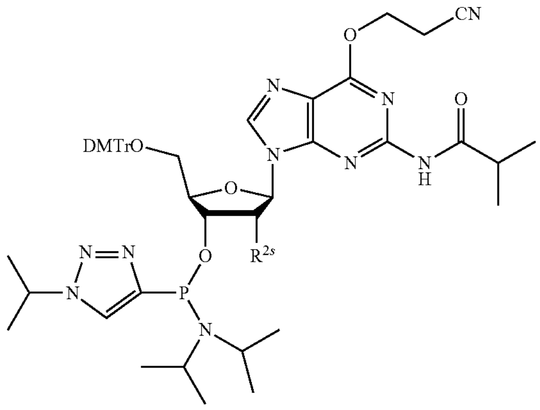
$R^{2s}$ = H, F, OMe, MOE
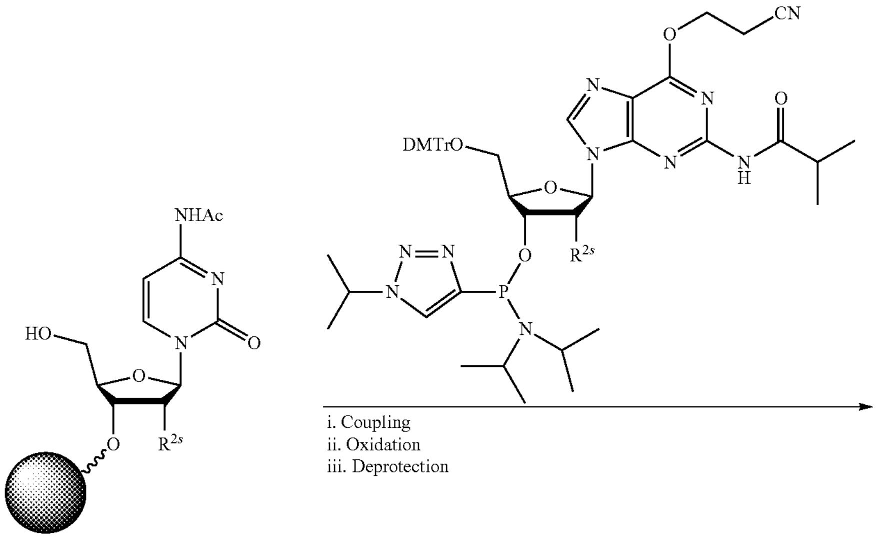
$R^{2s}$ = H, F, OMe, MOE
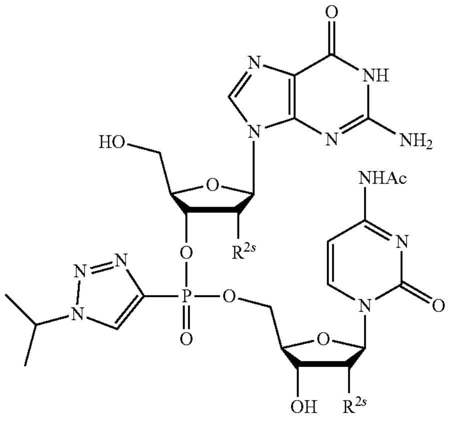
$R^{2s}$ = H, F, OMe, MOE -continued
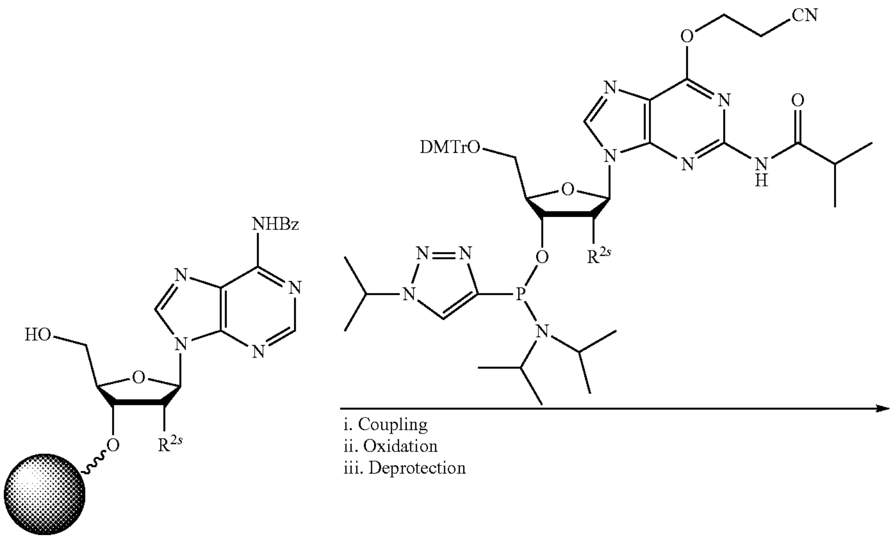
$R^{2s}$ = H, F, OMe, MOE
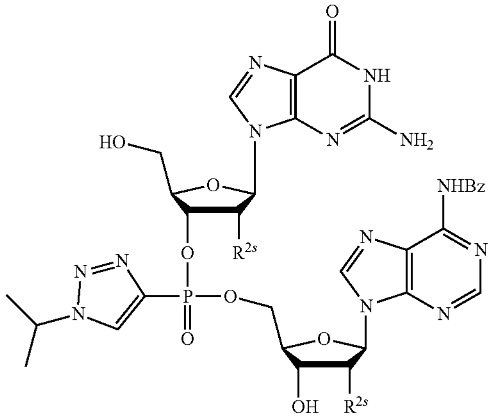
$R^{2s}$ = H, F, OMe, MOE
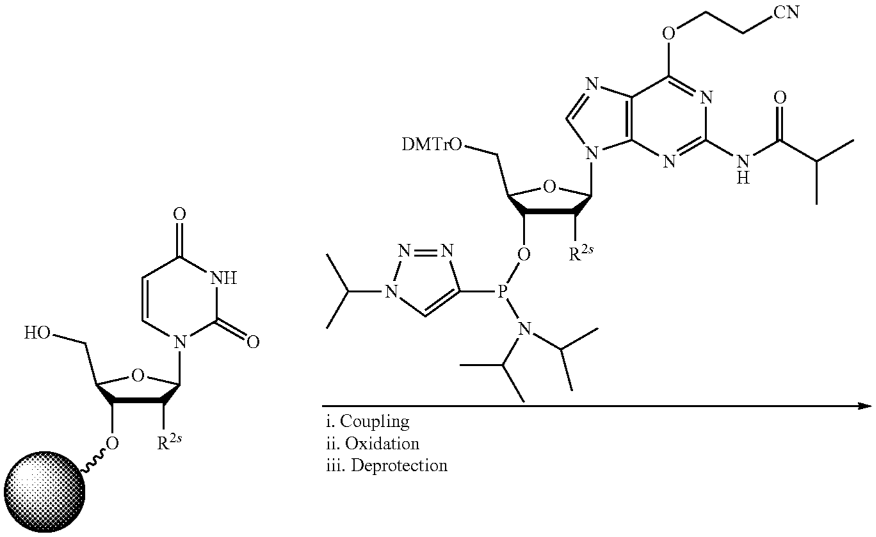
$R^{2s}$ = H, F, OMe, MOE -continued
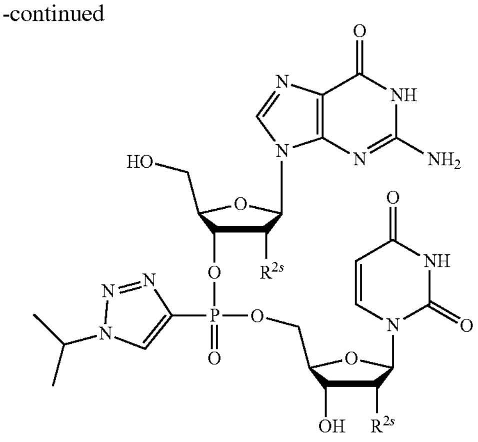
$R^{2s}$ = H, F, OMe, MOE
Triazole backbone oligonucleotides:
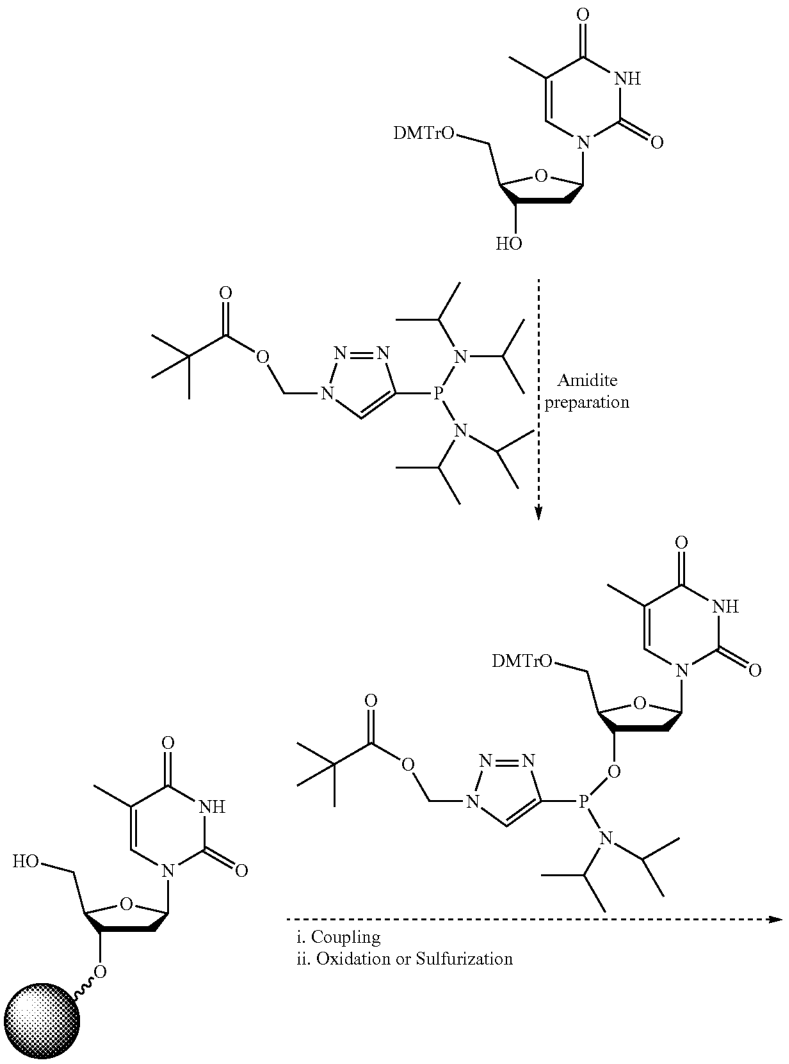

-continued
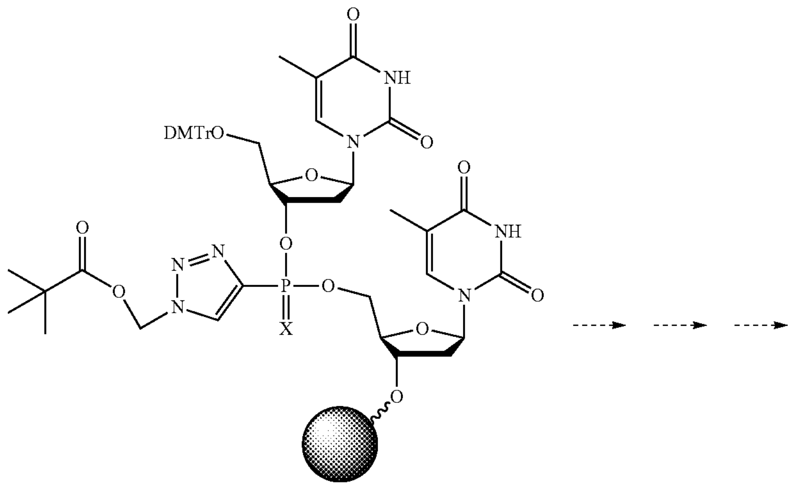
X = O or S
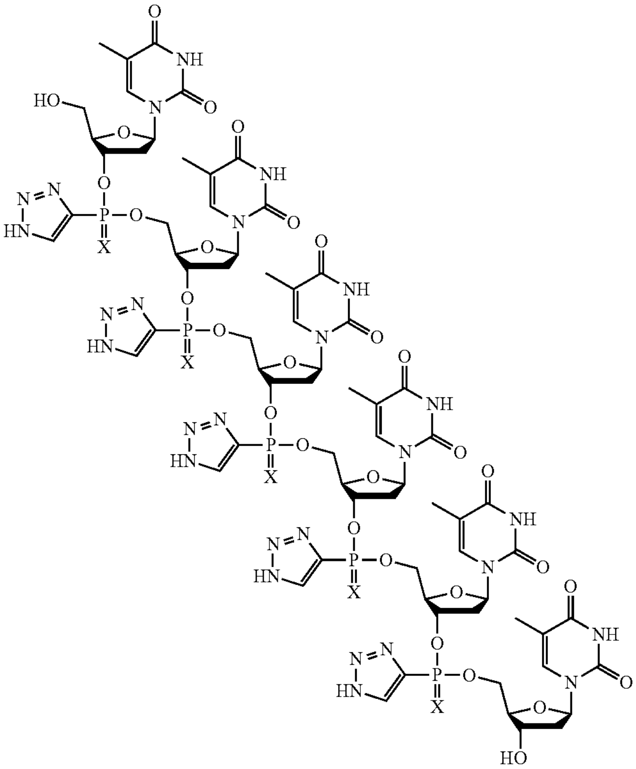

Synthesis scheme for dimer preparation in solution phase:
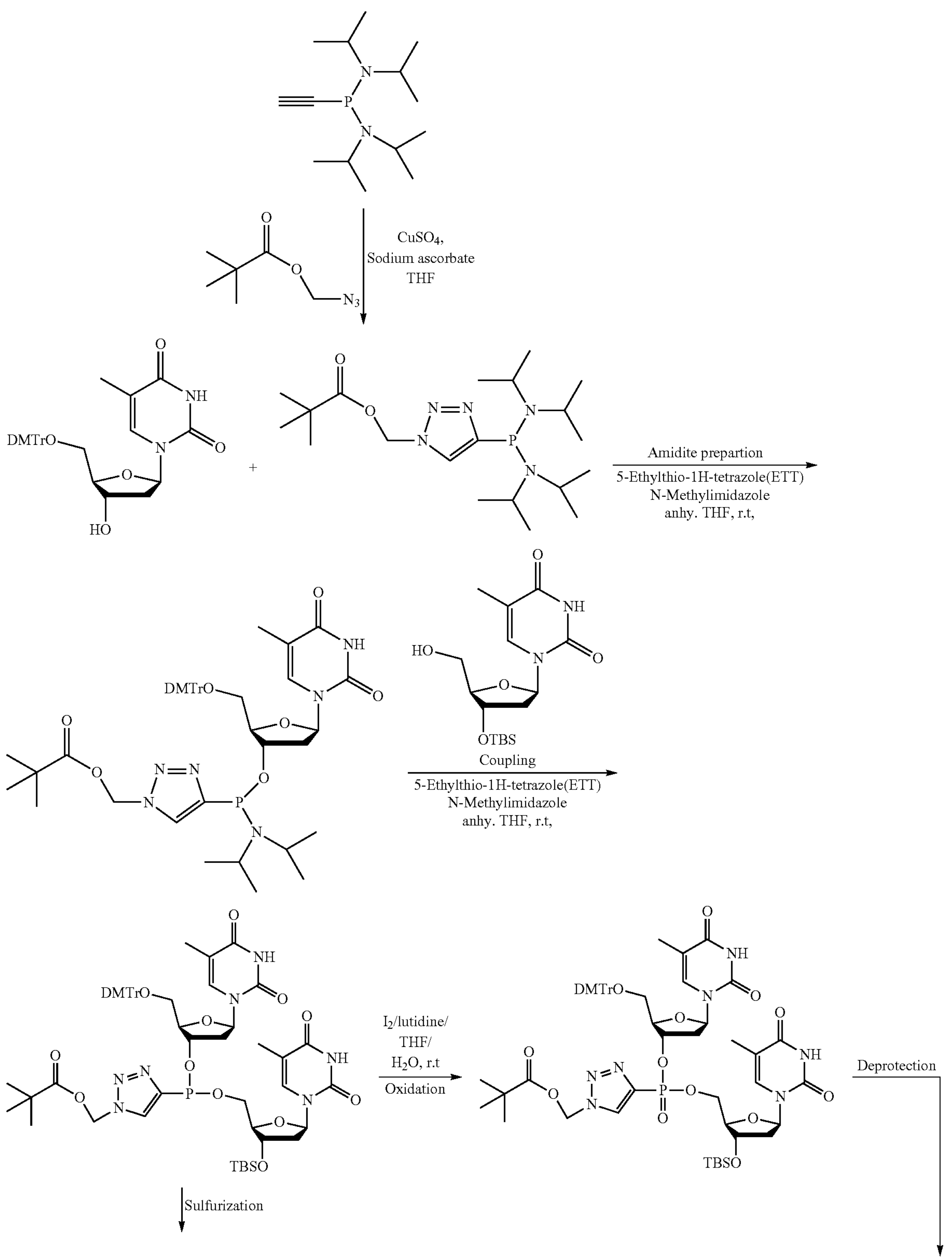

-continued
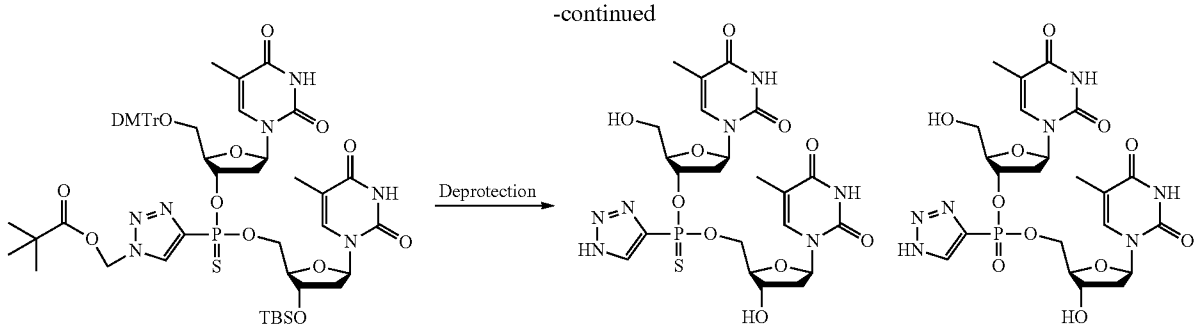
Synthesis scheme for dimer preparation on solid support:
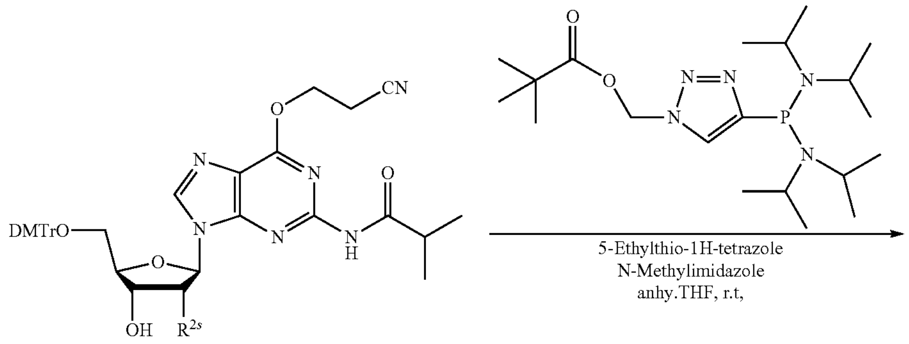
$R^{2s}$ = H, F, OMe, MOE
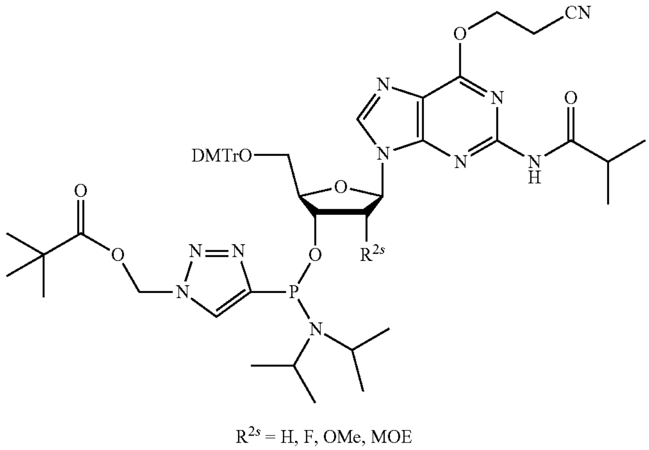
$R^{2s}$ = H, F, OMe, MOE -continued
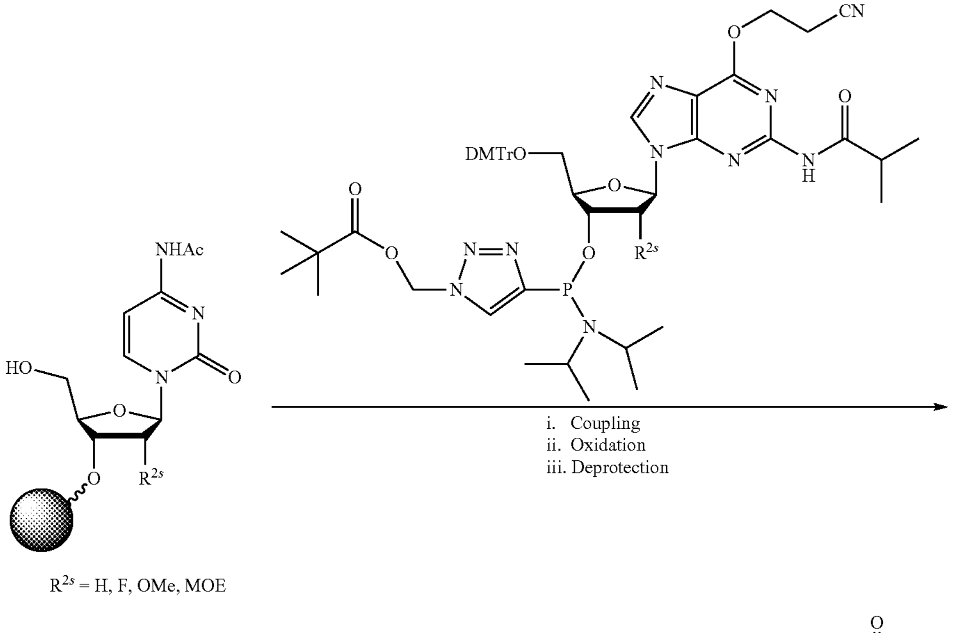
$R^{2s}$ = H, F, OMe, MOE
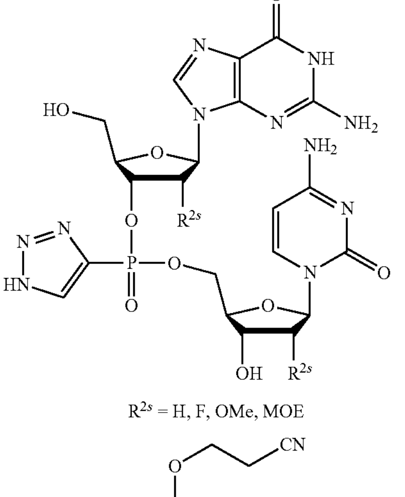
$R^{2s}$ = H, F, OMe, MOE
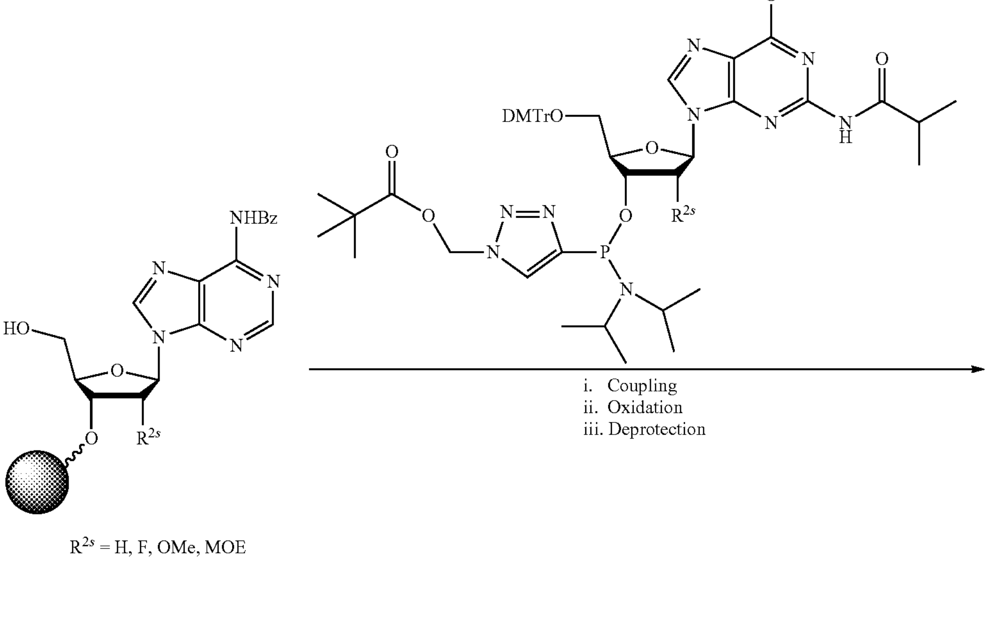
$R^{2s}$ = H, F, OMe, MOE -continued
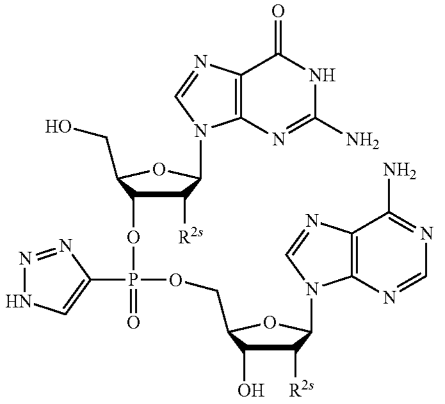
$R^{2s}$ = H, F, OMe, MOE
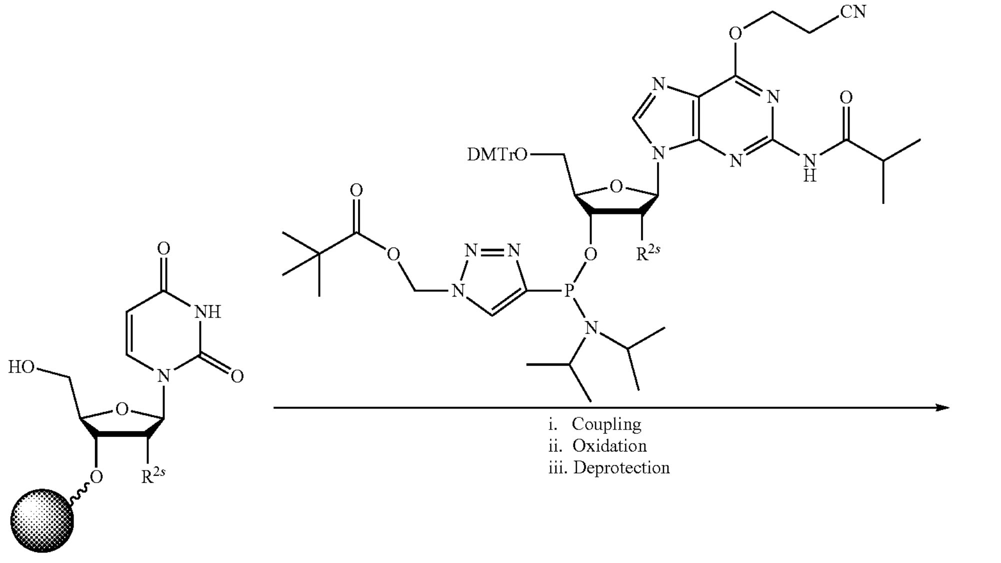
$R^{2s}$ = H, F, OMe, MOE
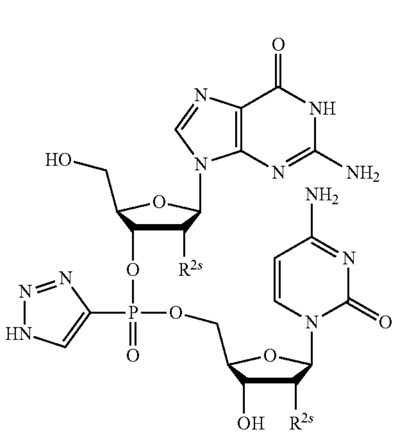
$R^{2s}$ = H, F, OMe, MOE Alkyne backbone oligonucleotides:
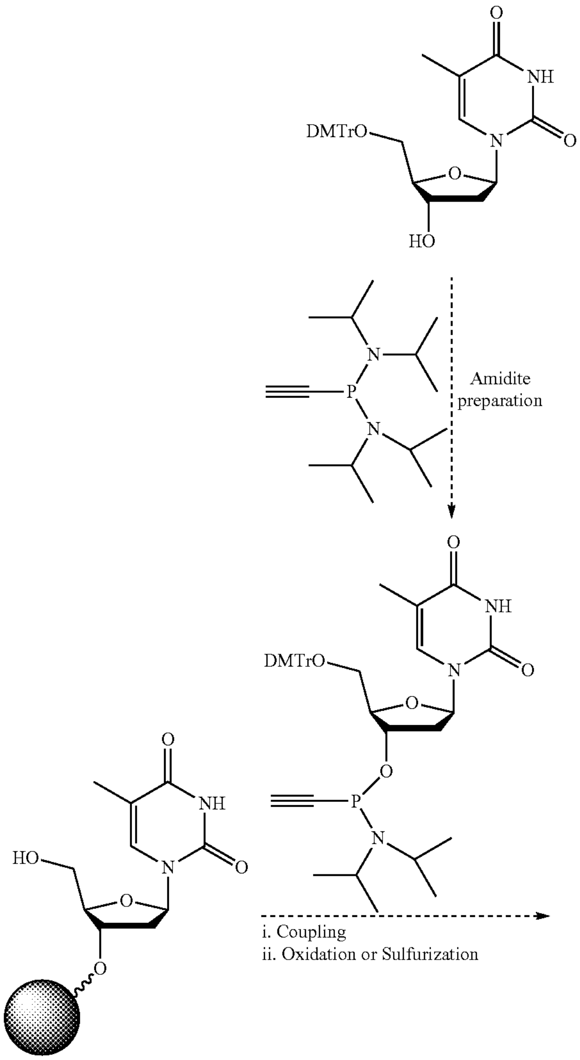
-continued
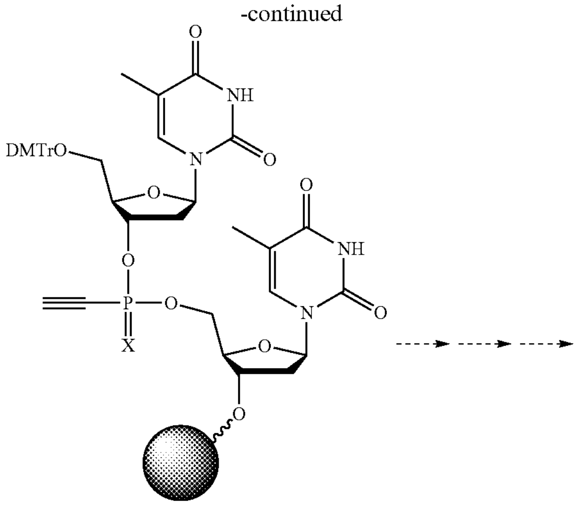
X = O or S
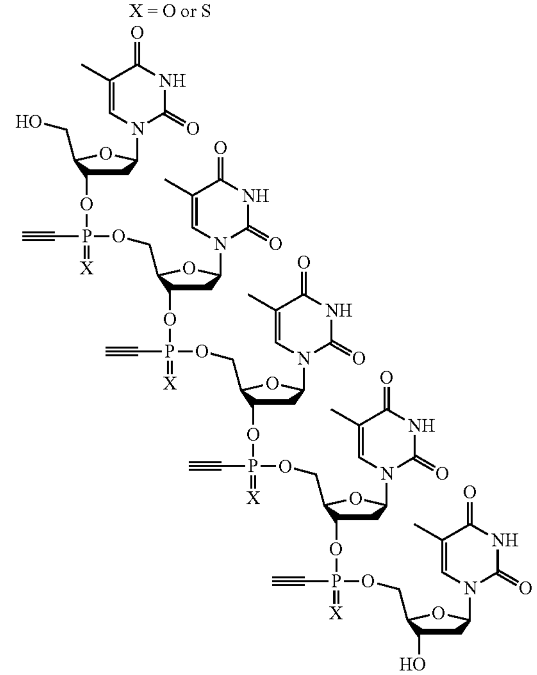
Synthesis scheme for dimer preparation on solid support:
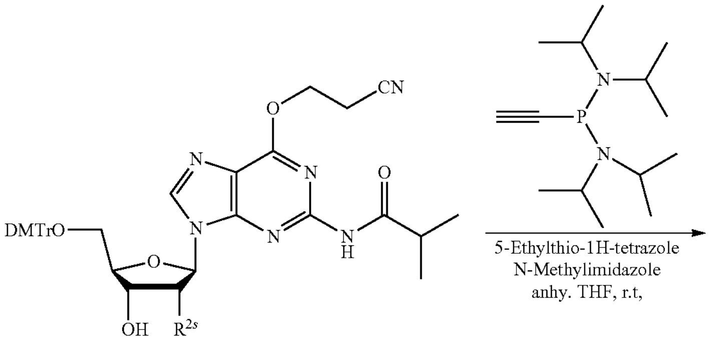
$R^{2s}$ = H, F, OMe, MOE -continued
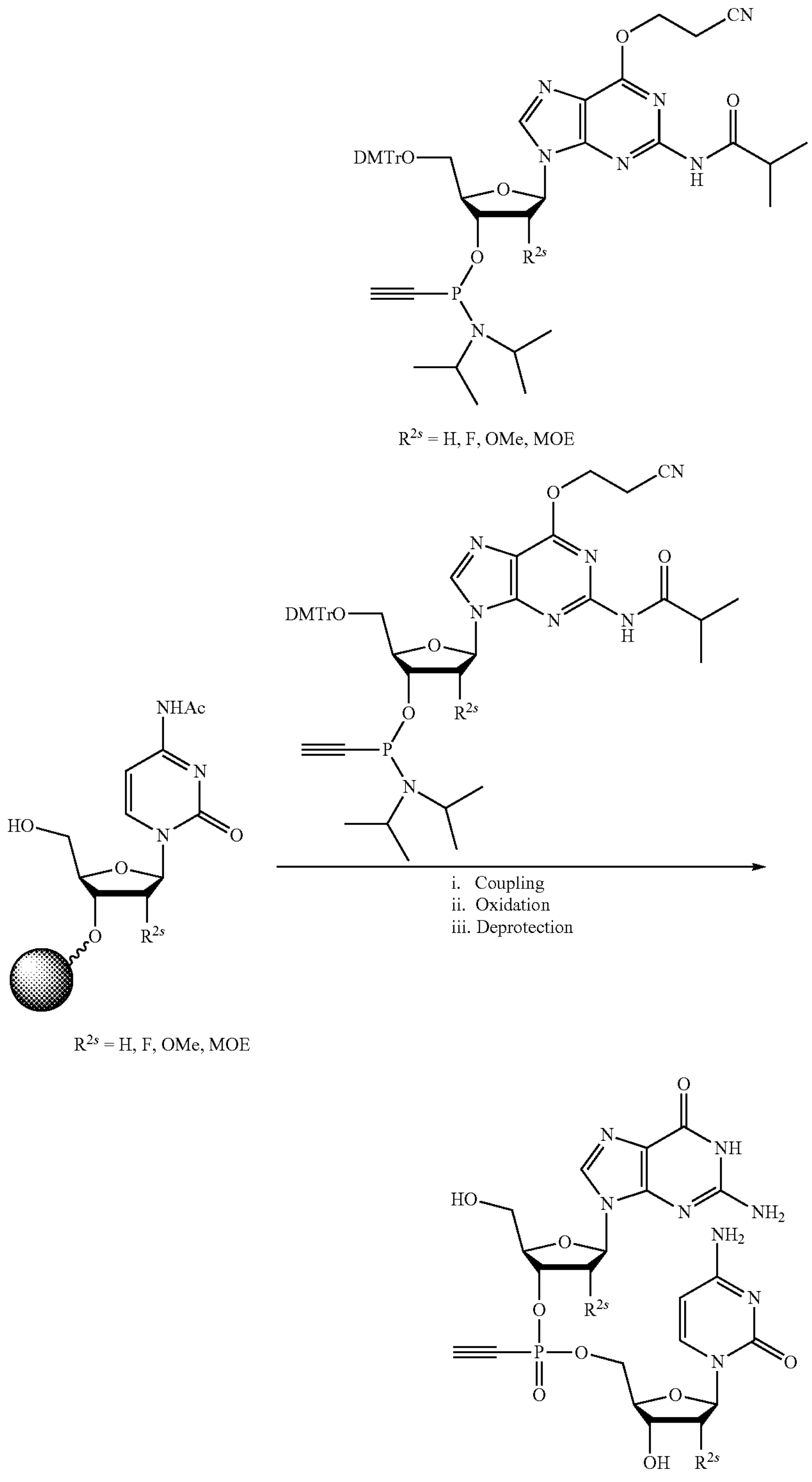
R$^{2s}$ = H, F, OMe, MOE -continued
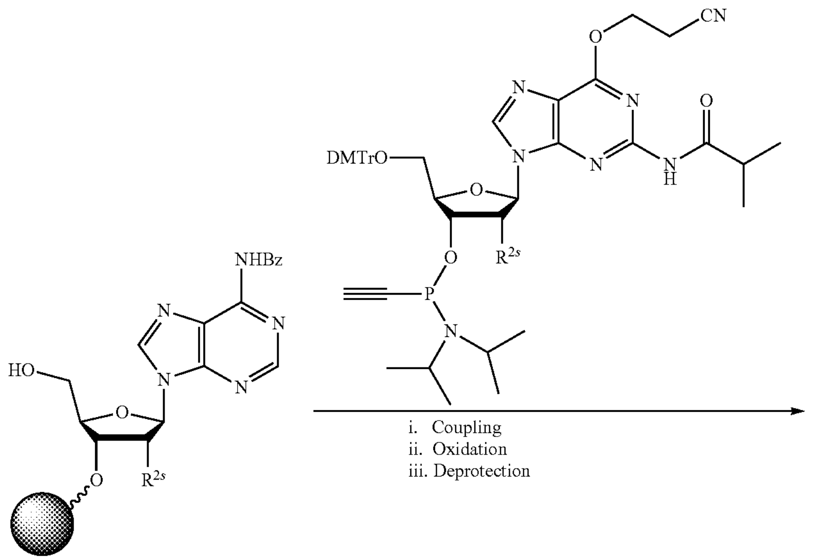
$R^{2s}$ = H, F, OMe, MOE
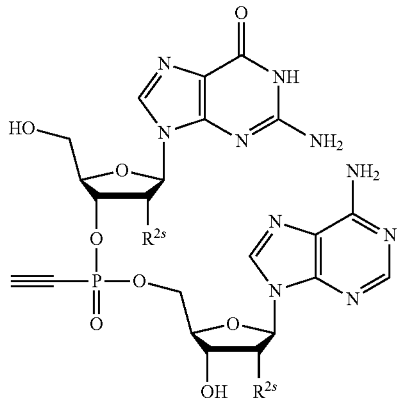
$R^{2s}$ = H, F, OMe, MOE
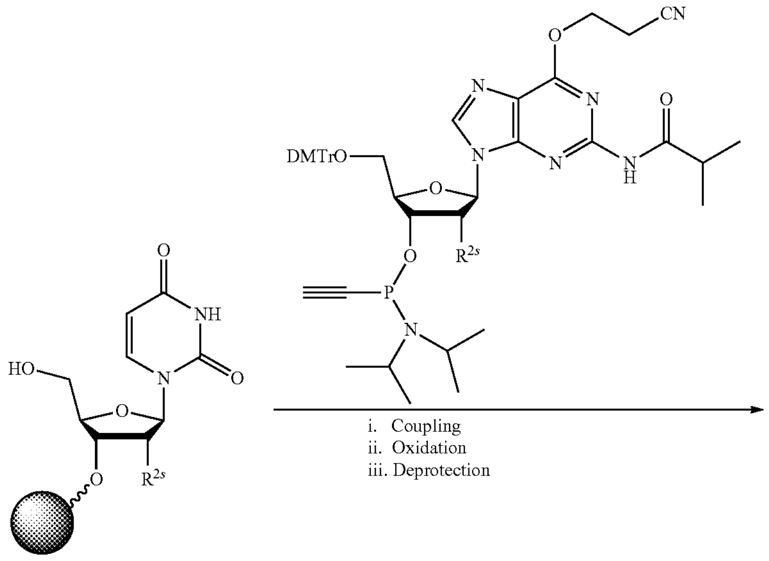
$R^{2s}$ = H, F, OMe, MOE -continued

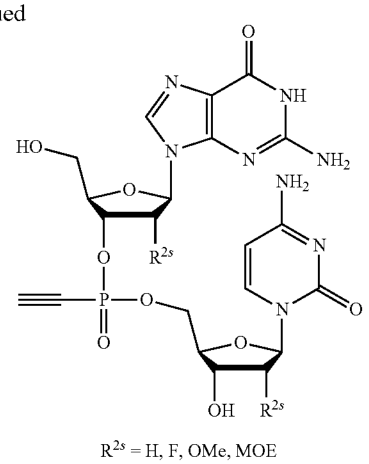

$R^{2s}$ = H, F, OMe, MOE

Example 3. Example Synthesis of Phosphoramidate Internucleotidic Linkages Comprising a Guanidine Moiety As illustrated herein, phosphoramidate internucleotidic linkages can be readily prepared from phosphite internucleotidic linkages, including stereopure phosphite internucleotidic linkages, in accordance with the present disclosure.

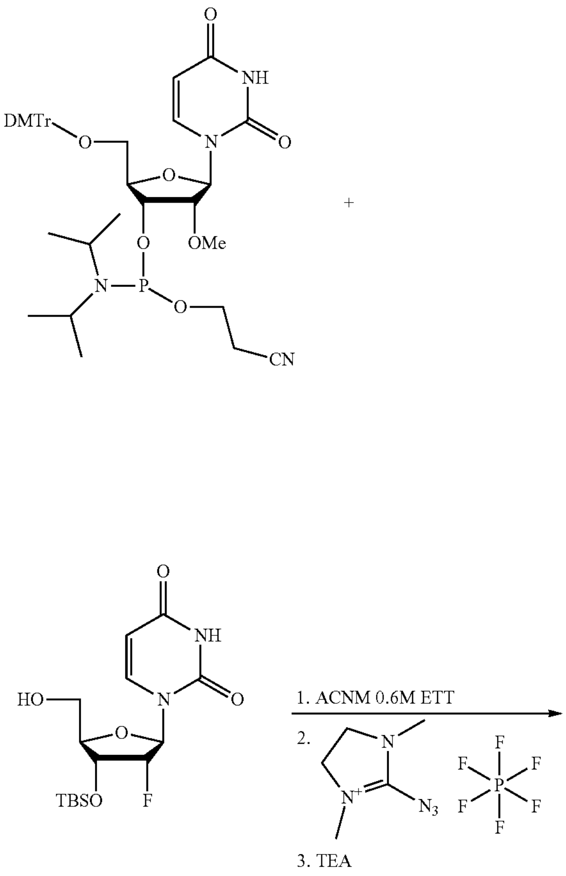

-continued

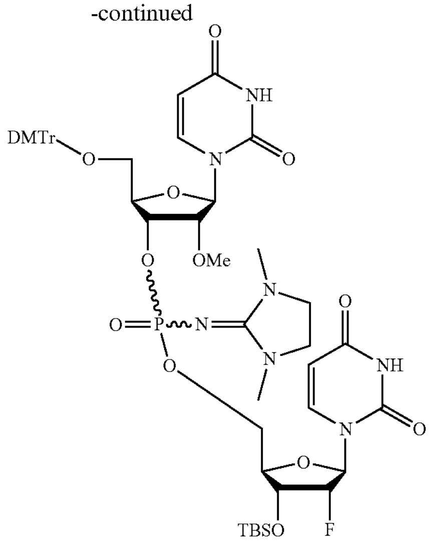

To a stirred solution of amidite (474 mg, 0.624 mmol, 1.5 equiv., pre-dried by co-evaporation with dry acetonitrile and under vacuum for a minimum of 12 h) and TBS protected alcohol (150 mg, 0.41 mmol, pre-dried by co-evaporation with dry acetonitrile and under vacuum for a minimum of 12 h) in dry acetonitrile (5.2 ml) was added 5-(ethylthio)-1H-tetrazole (ETT, 2.08 ml, 0.6M, 3 equiv.) under argon atmosphere at room temperature. The reaction mixture was stirred for 5 mins then monitored by LCMS and then a solution of 2-azido-1,3-dimethylimidazolinium hexafluorophosphate (356 mg, 1.24 mmol, 3 equiv.) in acetonitrile (1 ml) was added. Once the reaction was completed (after ~5 mins, monitored by LCMS) then triethylamine (0.17 ml, 1.24 mmol, 3 equiv) was added and the reaction was monitored by LCMS. The reaction mixture was concentrated under reduced pressure and then redissolved in dichloromethane (50 ml), washed with water (25 ml), saturated aq. sodium bicarbonate (25 ml), and brine (25 ml), and dried with magnesium sulfate. The solvent was removed under reduced pressure. The crude product was purified by silica gel column (80 g) using DCM (5% triethyl amine) and MeOH as eluent. Product-containing fractions were collected and the solvent was evaporated. The resulted product may contain Triethylamine trihydrochloride (TEA·HCl) salt.

To remove the salt, the product was re-dissolved in DCM (50 ml) and washed with saturated aq. sodium bicarbonate (20 ml) and brine (20 ml) then dried with magnesium sulfate and the the solvent was evaporated. A pale yellow solid was obtained. Yield: 440 mg (89%). $^{31}P$ NMR (162 MHz, $CDCl_3$) δ-1.34, −1.98. MS calculated for $C_{51}H_{65}FN_7O_{14}PSi$ $[M]^+$ 1078.17, Observed: 1078.57 $[M+H]^+$.

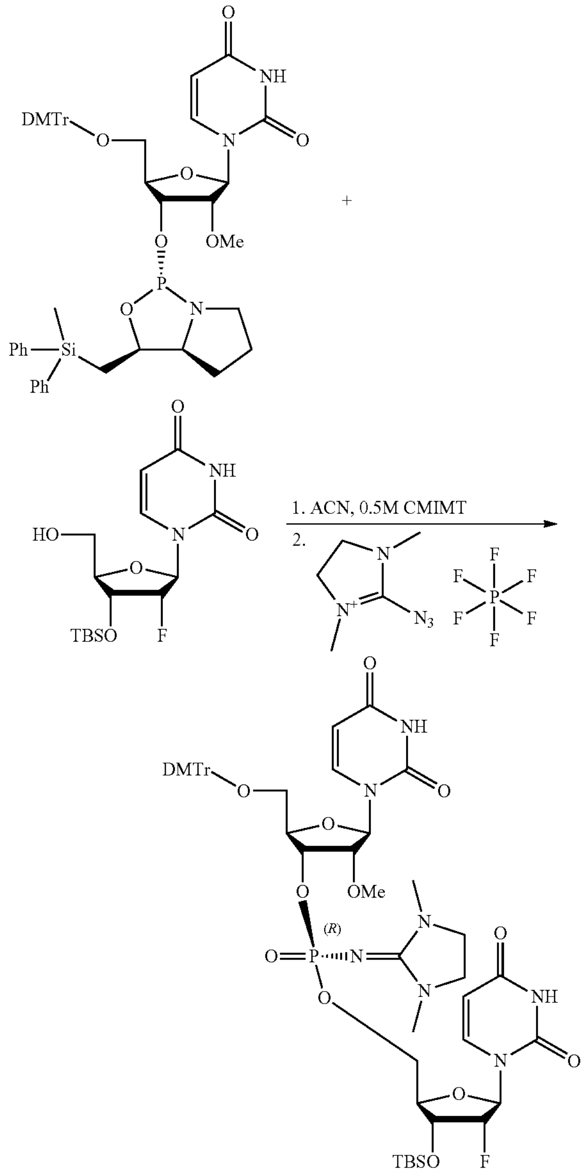

Synthesis of Stereopure (Rp) Dimer.

To a stirred solution of L-DPSE chiral amidite (1.87 g, 2.08 mmol, 1.5 equiv., pre-dried by co-evaporation with dry acetonitrile and under vacuum for a minimum of 12 h) and TBS protected alcohol (500 mg, 1.38 mmol, pre-dried by co-evaporation with dry acetonitrile and under vacuum for a minimum of 12 h) in dry acetonitrile (18 mL) was added 2-(1H-imidazol-1-yl) acetonitrile trifluoromethanesulfonate (CMIMT, 5.54 mL, 0.5M, 2 equiv.) under argon atmosphere at room temperature. The resulting reaction mixture was stirred for 5 mins then monitored by LCMS and then a solution of 2-azido-1,3-dimethylimidazolinium hexafluorophosphate (1.18 g, 4.16 mmol, 3 equiv.) in acetonitrile (2 mL) was added. Once the reaction was completed (after ~5 mins, monitored by LCMS), the reaction mixture was concentrated under reduced pressure and then redissolved in dichloromethane (70 mL), washed with water (40 mL), saturated aq. sodium bicarbonate (40 mL) and brine (40 mL), and dried with magnesium sulfate. The solvent was removed under reduced pressure. The crude product was purified by silica gel column (120 g) using DCM (5% triethyl amine) and MeOH as eluent. Product containing fractions were collected and the solvent was evaporated. The resulted product contained TEA·HCl salt. To remove the salt, the product was re-dissolved in DCM (50 mL) and washed with saturated aq. sodium bicarbonate (20 mL) and brine (20 mL) and then dried with magnesium sulfate and the solvent was evaporated. A pale yellow foamy solid was obtained. Yield: 710 mg (47%). $^{31}P$ NMR (162 MHz, $CDCl_3$) δ −1.38. MS calculated for $C_{51}H_{65}FN_7O_{14}PSi$ $[M]^+$ 1078.17, Observed: 1078.19.

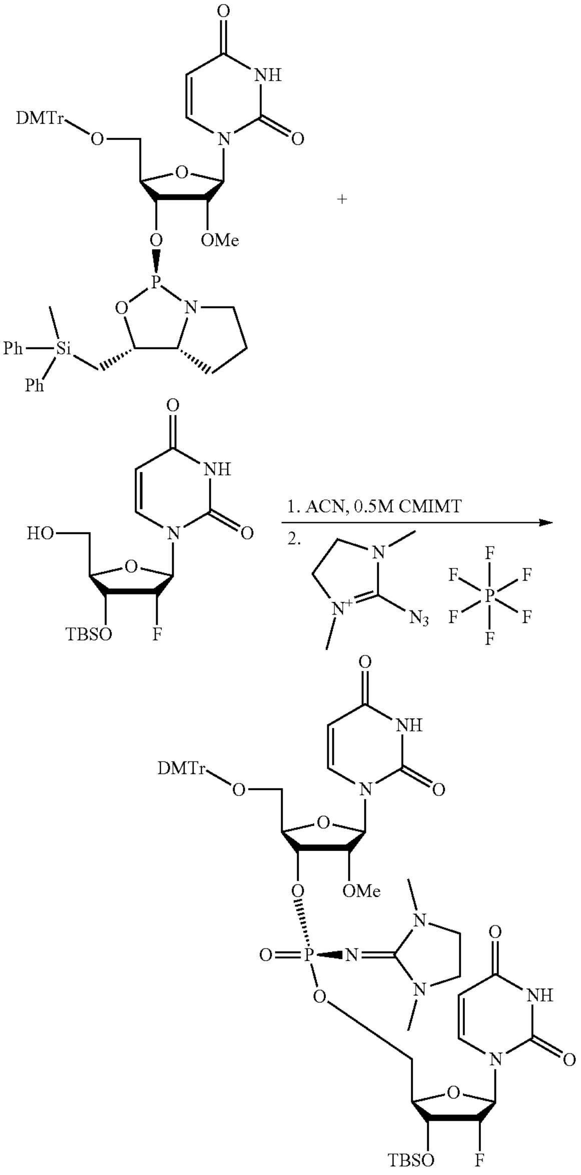

Synthesis of Stereopure (Sp) Dimer

The same procedure was followed as for the Rp dimer. In place of L-DPSE chiral amidite, D-DPSE chiral amidite was used. A pale yellow foamy solid was obtained. Yield: 890 mg (59%). $^{31}P$ NMR (162 MHz, $CDCl_3$) δ −1.93. MS calculated for $C_{51}H_{65}FN_2O_{14}PSi$ $[M]^+$ 1078.17, Observed: 1078.00.

In an example $^{31}P$ NMR (internal standard of phosphoric acid at δ 0.0), the stereorandom preparation showed two peaks at −1.34 and −1.98, respectively; the stereopure Rp preparation showed a peak at −1.93, and the stereopure Sp preparation showed a peak at −1.38.

Example 4A. Preparation of Oligonucleotides with Internucleotidic Linkages Comprising Neutral Guanidinium Group In accordance with technologies described in the present disclosure, oligonucleotides with various neutral and/or cationic internucleotidic linkages (e.g., at physiological pH) can be prepared. Illustrated below are preparation of oligonucleotides comprising representative such internucleotidic linkages.

WV-11237 is an oligonucleotide comprising four internucleotidic linkages having the structure of

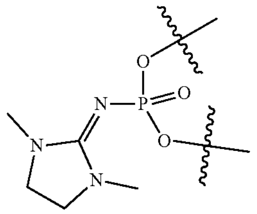

(n001) to introduce a neutral nature to the backbone and reduce the overall negative charges of the backbone. Expected molecular weight: 7113.4.

As an example, one preparation of WV-11237, including certain synthetic conditions and analytical results, is described below. Briefly, stereopure internucleotidic linkages were constructed using L-DPSE amidites and typical DPSE coupling cycles comprising Detritylation→Coupling→Pre-Cap→Thiolation→Post-Cap. Cycles for the n001 internucleotidic linkages were modified and comprised Detritylation→Coupling→Dimethyl imidazolium treatment→Post-cap. Compared to certain oxidation cycles, oxidation steps of oxidizing the P(III), e.g., with $I_2$-Pyridine (pyr)-water, was replaced with the dimethyl imidazolium treatment.

Certain conditions and/or results of an example preparation.

Synthetic scale: 127 μmol

Synthetic Conditions (Stereopure Internucleotidic Linkages)

| Synthetic Steps | Conditions |
|---|---|
| Detritylation | 3% DCA in Toluene; 300 cm/hr, 436 UV watch |
| Coupling | 2.5 eq. of 0.2M chiral amidite, 67% of 0.6M CMIMT<br>Recycle time: 10 min |
| Pre-Cap B | Reagent: 20:30:50::Acetic anhydride:Lutidine:Acetonitrile<br>1.5 CV, 3 min CT |
| Thiolation | Reagent: 0.2M Xanthane Hydride<br>0.6 CV, 6 mm CT |
| Capping (1:1 Cap A + Cap B) | 0.4 CV, 0.8 min CT |

Cap A=N-Methylimidazole in acetonitrile, 20/80, v/v (20%:80%=NMI:ACN (v/v))

Cap B=Acetic anhydride/2,6-Lutidine/Acetonitrile, 20/30/50, v/v/v, 20%:30%:50%=$Ac_2O$: 2,6-Lutidine:ACN(v/v/v)

Synthetic Conditions (Stereorandom n001)

| Synthetic Steps | Conditions |
|---|---|
| Detritylation | 3% DCA in Toluene; 300 cm/hr, 436 UV watch |
| Coupling | 2.5 eq. of 0.2M standard amidite, 67% of 0.6M ETT<br>Recycle time: 8 min |
| Dimethyl imidazolium treatment: | 2.30 CV, 5 mm CT, 3.5 eq. |
| Capping (1:1 Cap A + Cap B) | 0.4 CV, 0.8 min CT |

Synthesis Process Parameters:
- Synthesizer: AKTA Oligopilot 100
- Solid Support: CPG 2'Fluoro-U, (85 umol/g)
- Synthetic scale: 127 umol; 1.5 gm
- Column diameter: 20 mm
- Column volume: 6.3 mL Stereopure Coupling Reagents:
- Monomer: 0.2M in MeCN (2'Fluoro-dA-L-DPSE, 2'Fluoro-dG-L-DPSE, 2'-OMe-A-L-DPSE); 0.2M in 20% isobutyronitrle/MeCN (2'Fluoro-dC-L-DPSE, 2'Fluoro-U-L-DPSE)
- Deblocking: 3% Dichloroacetic acid (DCA) in Toluene Activator: 0.6M CMIMT in MeCN Sulfurization: 0.2M Xanthane Hydride in pyridine Cap A: N-Methylimidazole in acetonitrile, 20/80, v/v (20% NMI in MeCN)

Cap B: Acetic anhydride/2,6-Lutidine/Acetonitrile, 20/30/50, v/v/v, (Acetic anhydride, Lutidine, MeCN (20:30:50))

Pre-Cap: Neat Cap B

Stereorandom Coupling Reagents:

Monomer: 0.2M in MeCN (2'OMeA and 2'OMeG)

Deblocking: 3% DCA in Toluene

Activator: 0.6M ETT in MeCN

2-Azido-1,3-dimethylimidazolinium-hexafluorophosphate: 0.1M in MeCN

Cap A: 20% NMI in MeCN

Cap B: Acetic anhydride, Lutidine, MeCN

Deprotection Condition:

One pot deprotection by first treating the support with 5M Triethylamine trihydrofluoride (TEA·HF) in Dimethylsulfoxid (DMSO), H2O, Triethylamine (pH 6.8). Incubation: 3 h, room temperature, 80 μL/μmol. Followed by addition of aqueous ammonia (200 μL/μmol). Incubation: 24 h, 35° C. The deprotected material was sterile filtered using 0.45 μm filters.

Yield: 72 O.D./μmol

Recipe for 5× Solution of TEA·HF in DMSO/Water, 5/1, v/v:

| Reagent | Solvents/ Reagents | Volume (mL) | Total Volume (mL) |
|---|---|---|---|
| (5X) TEA.HF in DMSO/Water, 5/1, v/v | DMSO | 55.0 | 100 |
| | Water | 11.0 | |
| | Triethylamine (TEA) | 9.0 | |
| | Triethylamine trihydrofluoride (TEA.3HF) | 25.0 | |

In an example crude UPLC chromatogram, there were four distinct peaks all having same desired molecular weight of 7113.2:

| | RT | Area | % Area | Height |
|---|---|---|---|---|
| 9 | 7.843 | 402732 | 16.75 | 212901 |
| 10 | 7.884 | 941388 | 39.14 | 327190 |
| 11 | 7.968 | 595232 | 24.75 | 275741 |
| 12 | 8.025 | 353090 | 14.68 | 150141 |

The example final QC UPLC chromatogram showed four distinct peaks all having the desired molecular weight of 7113.2 (% Purity 95.32). Crude LC-MS showed a single peak of desired molecular weight of 7113.2 (data not shown). The example final QC LC-MS showed a major peak with the desired molecular weight of 7113.1.

Other oligonucleotides may be prepared using similar cycle conditions or variants thereof depending on specific chemistries of each oligonucleotides. MS data of certain oligonucleotides are listed below:

| ID | Average | Observed |
|---|---|---|
| WV-11237 | 7113.40288 | 7113.1 |
| WV-11340 | 6967.19736 | 6967.4 |
| WV-11341 | 6876.08178 | 6875.6 |
| WV-11342 | 6888.1173 | 6887.7 |

-continued

| ID | Average | Observed |
|---|---|---|
| WV-11343 | 7072.39402 | 7072.4 |
| WV-11344 | 6981.27844 | 6981.6 |
| WV-11345 | 6981.27844 | 6981.6 |
| WV-11346 | 6981.27844 | 6981.6 |
| WV-11347 | 6981.27844 | 6981.6 |
| WV-11532 | 6905.78632 | 6905 |
| WV-11533 | 7098.86298 | 7099 |
| WV-12116 | 7909.88196 | 7909.4 |
| WV-12117 | 7909.88196 | 7909.8 |
| WV-12118 | 7909.88196 | 7910.2 |
| WV-12119 | 7909.88196 | 7909.4 |
| WV-12120 | 7909.88196 | 7909.8 |
| WV-12121 | 7909.88196 | 7909.8 |
| WV-12123 | 7125.35748 | 7125 |
| WV-12124 | 6967.19736 | 6967 |
| WV-12125 | 6967.19736 | 6967 |
| WV-12126 | 6967.19736 | 6967 |
| WV-12127 | 7046.27742 | 7046 |
| WV-12128 | 7046.27742 | 7046 |
| WV-12129 | 7046.27742 | 7046 |
| WV-12504 | 8887.86402 | 8887.5 |
| WV-12505 | 7278.017 | 7278.2 |
| WV-12506 | 8944.9584 | 8945.2 |
| WV-12507 | 7335.11138 | 7334.4 |
| WV-12508 | 7155.95736 | 7156.3 |
| WV-12539 | 7171.78104 | 7171 |
| WV-12540 | 7171.78104 | 7171 |
| WV-12541 | 7457.21802 | 7457 |
| WV-12542 | 7219.97784 | 7219 |
| WV-12543 | 7235.97724 | 7236 |
| WV-12544 | 7112.86454 | 7113 |
| WV-12553 | 6872.0517 | 6872 |
| WV-12555 | 6876.08178 | 6875.8 |
| WV-12556 | 6888.1173 | 6887.8 |
| WV-12558 | 6876.08178 | 6875.6 |
| WV-12559 | 6888.1173 | 6887.7 |
| WV-12876 | 7204.43754 | 7204.4 |
| WV-12877 | 7113.32196 | 7113.5 |
| WV-12878 | 7125.35748 | 7125.4 |
| WV-12879 | 6919.00056 | 6919.1 |
| WV-12880 | 6923.03064 | 6923.2 |
| WV-12881 | 6935.06616 | 6935.3 |
| WV-12882 | 7094.4195 | 7094.1 |
| WV-12883 | 7410.73974 | 7411.1 |

Example 4B. Chirally Controlled Non-Negatively Charged Internucleotidic Linkages

Dimer Synthesis

This procedure is to make stereopure dimer phosphate backbone followed by incorporating it to the selective sites of oligonucleotides (e.g., antisense oligonucleotide or ASO, single-stranded RNAi agent or ssRNA, etc.). A second approach is to synthesize molecules using an automated oligonucleotide synthesizer to introduce a non-negatively charged internucleotidic linkage, e.g., a neutral internucleotidic linkage, at a specific site or full oligonucleotide.

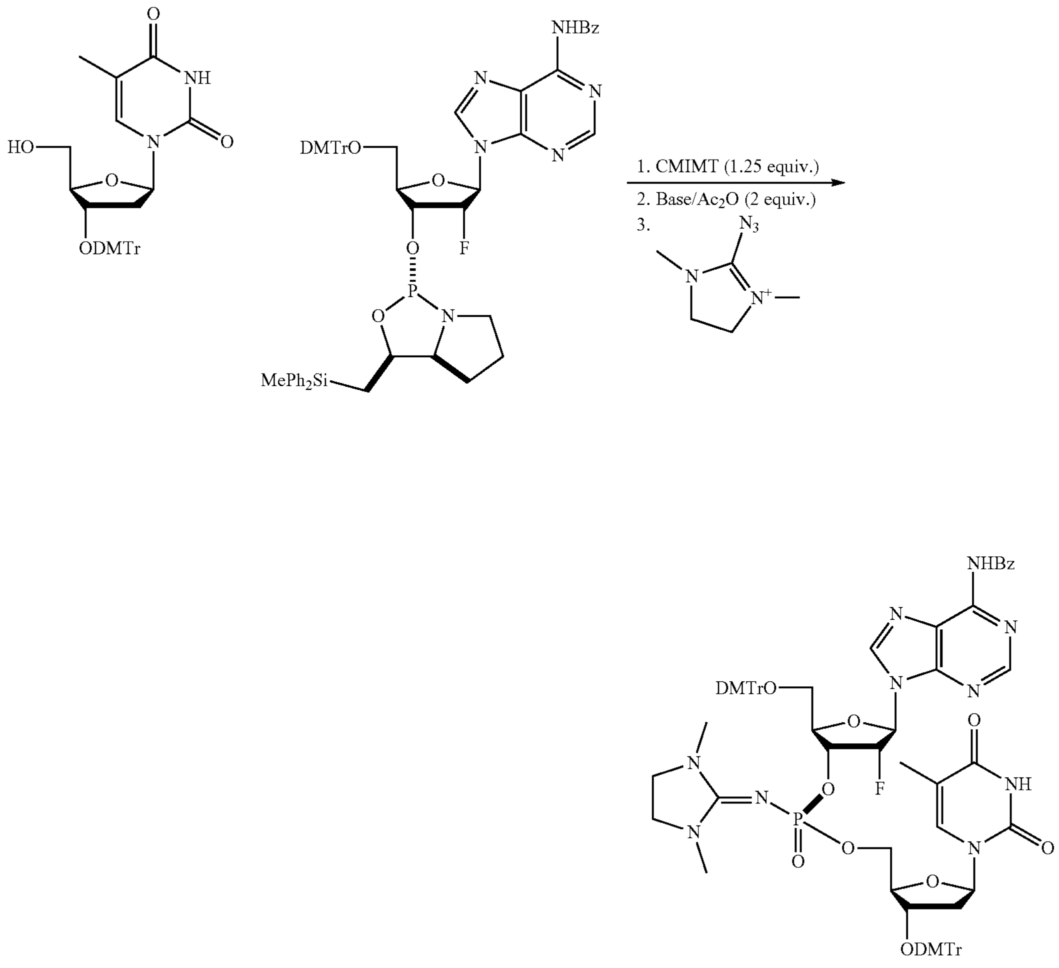
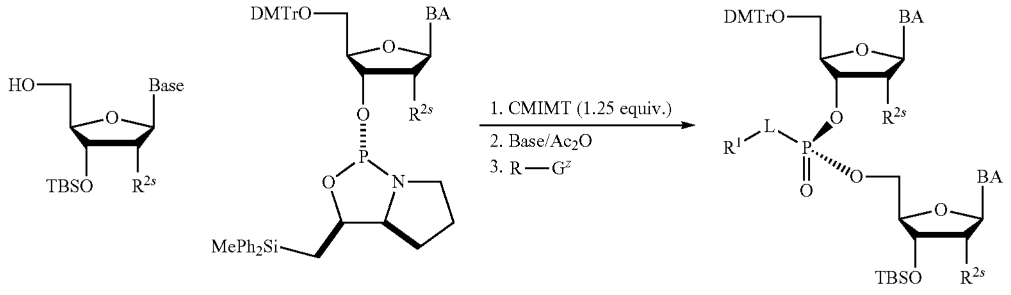
$—L—R^1$ = $CH_3$—, $CH_3CH_2$—, $CH_3CH_2CH_2$—, $CH_3OCH_2$—, $CH_3CH_2$—$OCH_2$—$PhCH_2OCH_2$—
$CHCCH_2$—, $CH_3CCCH_2$—, $CH_2CHCH_2$—, $CH_3SCH_2$— —$CH_2COOCH_3$, —$CH_2COOCH_2CH_3$,
—$CH_2COOCH_3$— $CH_2CONHCH_3$,
$G^z$ = Cl, Br, I, OTf, OMs, OTosyl etc.
$R^{2s}$ = H, $OCH_3$, $OCH_2CH2OCH_3$, F, $OCH_2CH_2W^z$ -continued
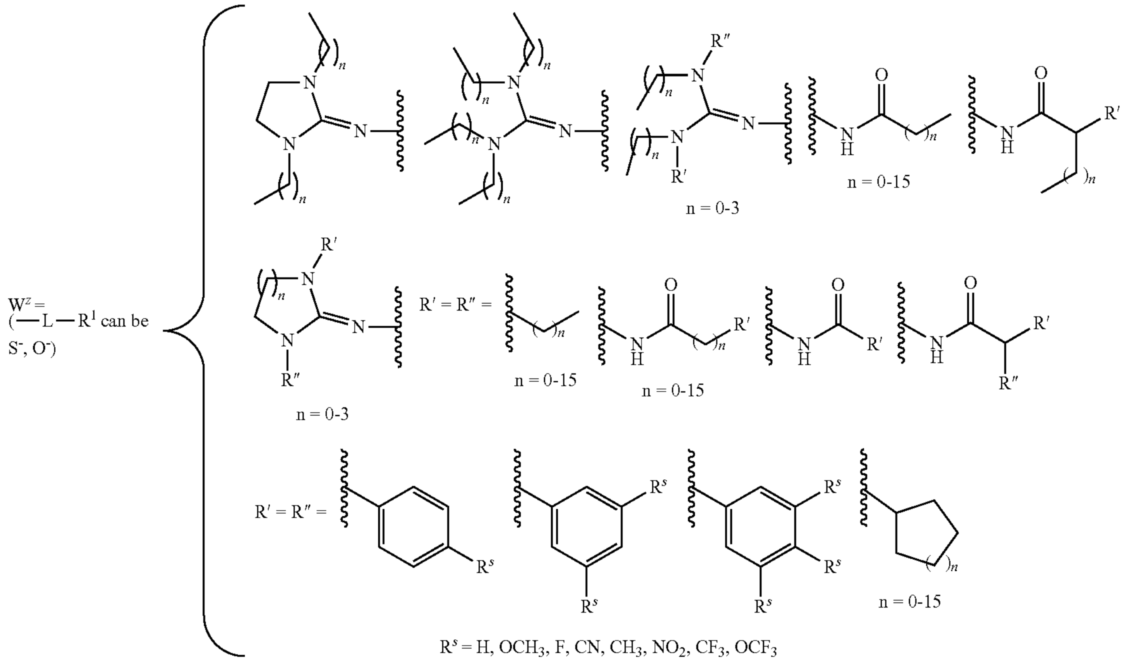
$R^s$ = H, $OCH_3$, F, CN, $CH_3$, $NO_2$, $CF_3$, $OCF_3$
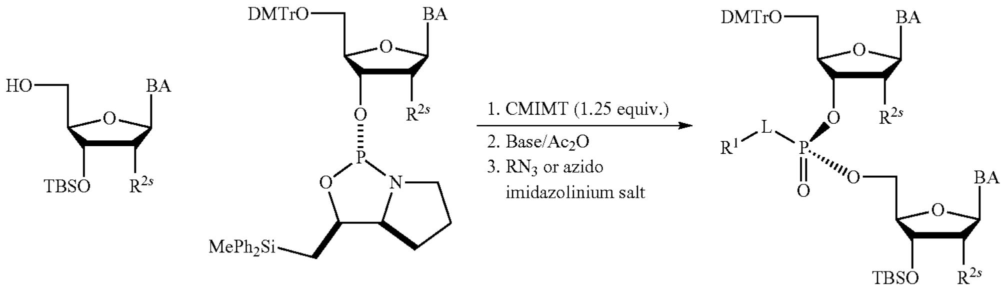
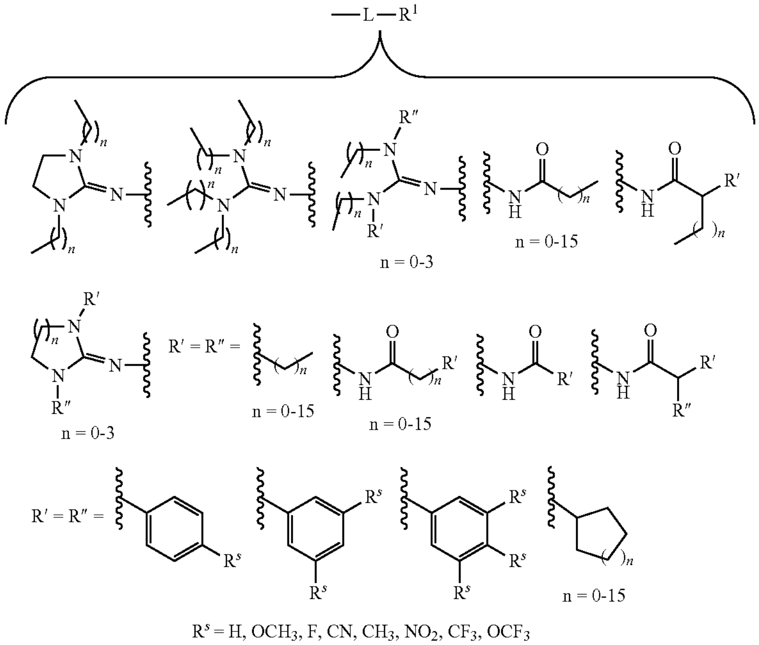
$R^s$ = H, $OCH_3$, F, CN, $CH_3$, $NO_2$, $CF_3$, $OCF_3$ -continued
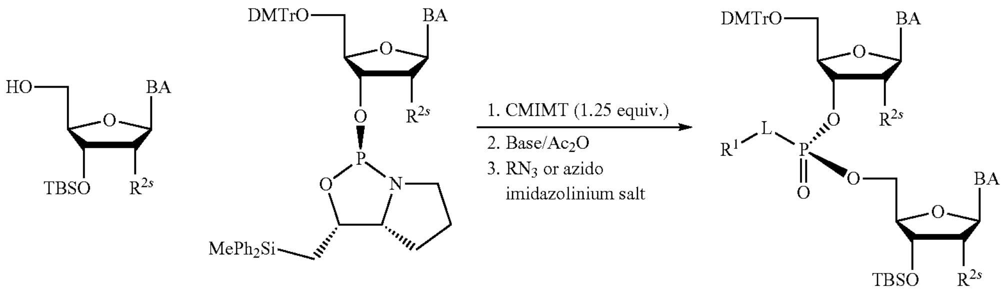
—L—$R^1$:
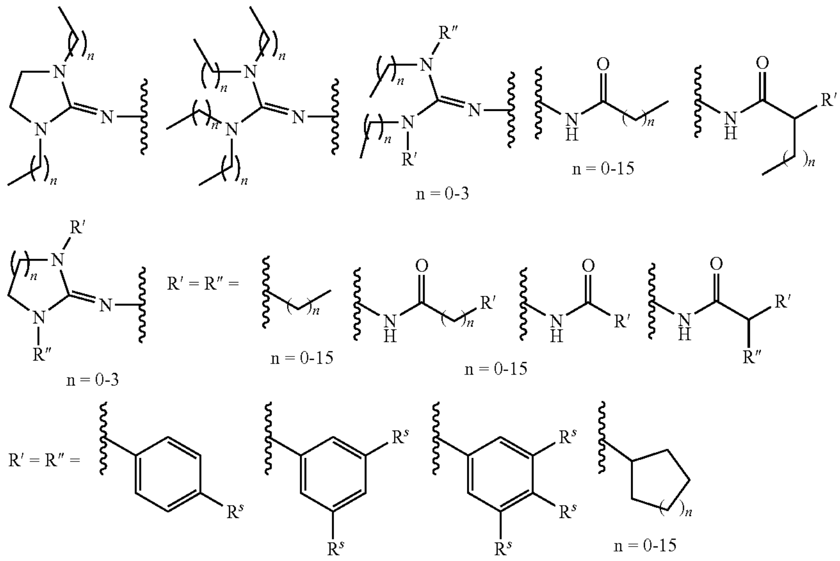
$R^s$ = H, $OCH_3$, F, CN, $CH_3$, $NO_2$, $CF_3$, $OCF_3$
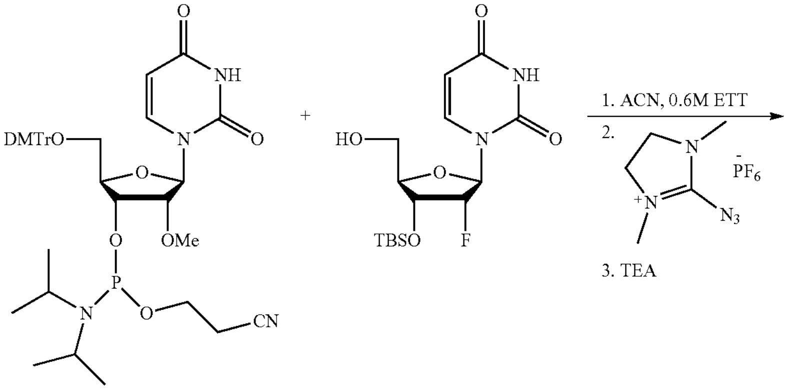

-continued

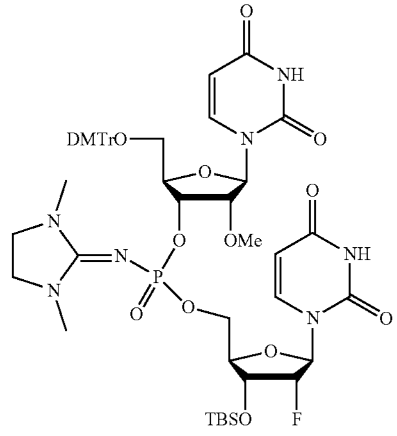

1001

General experimental procedure (A): To a stirred solution of stereorandom amidite (474 mg, 0.624 mmol, 1.5 equiv., pre-dried by co-evaporation with dry acetonitrile and kept it under vacuum for minimum 12 h) and TBS protected alcohol (150 mg, 0.41 mmol, pre-dried by co-evaporation with dry acetonitrile and kept it under vacuum for minimum 12 h) in dry acetonitrile (5.2 mL) was added 5-(Ethylthio)-1H-tetrazole (ETT, 2.08 ml, 0.6M, 3 equiv.) under argon atmosphere at room temperature. Resulting reaction mixture was stirred for 5 mins then monitored by LCMS and then a solution of 2-azido-1,3-dimethylimidazolinium hexafluorophosphate (356 mg, 1.24 mmol, 3 equiv.) in acetonitrile (1 mL) was added. Once the reaction was completed (after ~5 mins, monitored by LCMS) then triethylamine (0.17 mL, 1.24 mmol, 3 equiv.) was added and monitored LCMS. Reaction mixture was concentrated under reduced pressure and then re-dissolved in dichloromethane (50 mL) washed with water (25 mL), saturated aq. Sodium bicarbonate (25 mL) and brine (25 mL) dried with magnesium sulfate. Solvent was removed under reduced pressure. The crude product was purified by silica gel column (80 g) using DCM (2% triethylamine) and MeOH as eluent. Product containing fractions collected and evaporated. Pale yellow solid 1001 obtained. Yield: 440 mg (89%). $^{31}$P NMR (162 MHz, $CDCl_3$) δ −1.34, −1.98. MS (ES) m/z calculated for $C_{51}H_{65}FN_7O_{14}PSi$ $[M]^+$ 1077.40, Observed: 1078.57 $[M+H]^+$.

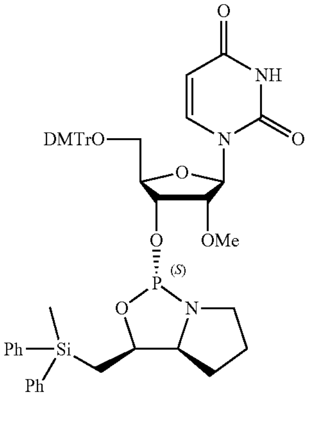

+

-continued

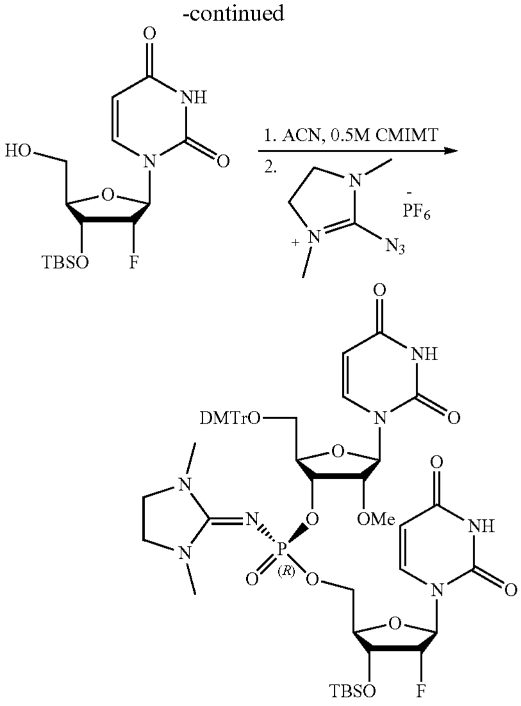

1002

General experimental procedure (B) for stereopure (Rp) dimer: To a stirred solution of L (or) D-DPSE chiral amidite (1.87 g, 2.08 mmol, 1.5 equiv., pre-dried by co-evaporation with dry acetonitrile and kept it under vacuum for minimum 12 h) and TBS protected alcohol (500 mg, 1.38 mmol, pre-dried by co-evaporation with dry acetonitrile and kept it under vacuum for minimum 12 h) in dry acetonitrile (18 mL) was added 2-(1H-imidazol-1-yl) acetonitrile trifluoromethanesulfonate (CMIMT, 5.54 mL, 0.5M, 2 equiv.) under argon atmosphere at room temperature. Resulting reaction mixture was stirred for 5 mins then monitored by LCMS and then a solution of 2-azido-1,3-dimethylimidazolinium hexafluorophosphate (1.18 g, 4.16 mmol, 3 equiv.) in acetonitrile (2 mL) was added. Once the reaction was completed (after ~5 mins, monitored by LCMS) then the reaction mixture was concentrated under reduced pressure and then redissolved in dichloromethane (70 mL) washed with water (40 mL), saturated aq. sodium bicarbonate (40 mL) and brine (40 mL) dried with magnesium sulfate. Solvent was removed under reduced pressure. The crude product was purified by silica gel column (120 g) using DCM (2% triethyl amine) and MeOH as eluent. Product containing fractions are evaporated. Pale yellow foamy solid 1002 was obtained. Yield: 710 mg (47%). $^{31}$P NMR (162 MHz, $CDCl_3$) δ −1.38. MS (ES) m/z calculated for $C_{51}H_{65}FN_7O_{14}PSi$ $[M]^+$ 1077.40, Observed: 1078.19 $[M+H]^+$.

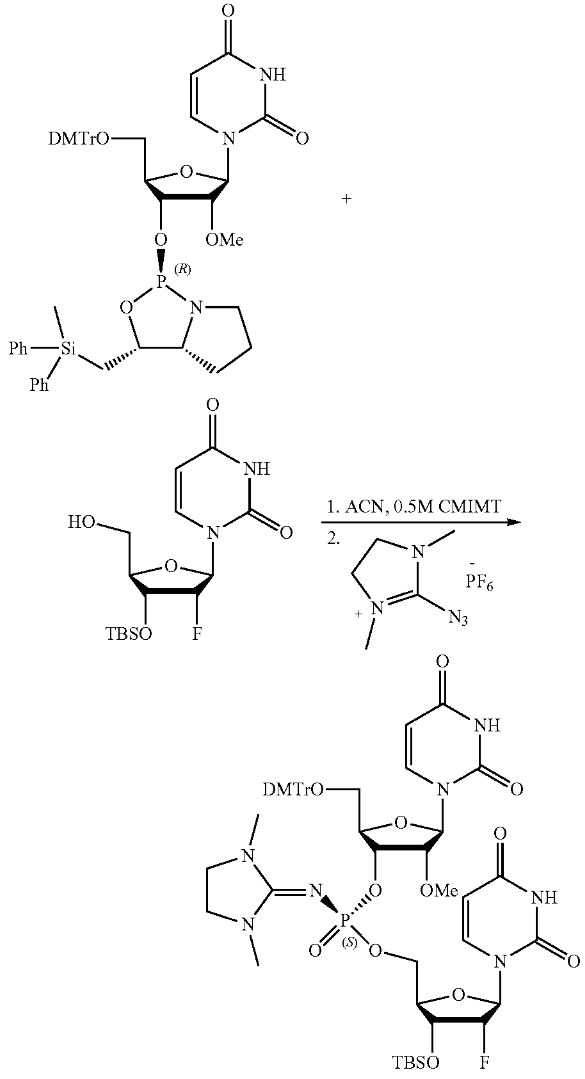

1003

Stereopure (Sp) dimer 1003: The procedure B was followed as shown above. D-DPSE chiral amidite was used. Pale yellow foamy solid was obtained. Yield: 890 mg (59%). $^{31}$P NMR (162 MHz, $CDCl_3$) δ −1.93. MS (ES) m/z calculated for $C_{51}H_{65}FN_7O_{14}PSi$ $[M]^+$ 1077.40, Observed: 1078.00 $[M+H]^+$.

General experimental procedure (C) for deprotection of TBS group: To a stirred solution of TBS protected compound (9.04 mmol) in trihydrofluoride (THF) (70 mL), was added TBAF (1.0 M, 13.6 mmol) at rt. The reaction mixture was stirred at room temperature for 2-4 h. LCMS showed there was no starting material left, then concentrated followed by purification using ISCO-combiflash system (330 g gold rediSep high performance silica column pre-equilibrated 3 CV with 2% TEA in DCM) and DCM/Methanol/2% TEA as a gradient eluent. Product containing column fractions were pooled together and evaporated followed by drying under high vacuum afforded the pure product.

General experimental procedure (D) for chiral amidites: The TBS deprotected compound (2.5 mmol) was dried by co-evaporation with 80 mL of anhydrous toluene (30 mL×2) at 35° C. and dried under at high vacuum for overnight. Then dried it was dissolved in dry THF (30 mL), followed by the addition of triethylamine (17.3 mmol) then the reaction mixture was cooled to −65° C. [for Guanine flavors: TMS-Cl, 2.5 mmol was added at −65° C., for non-Guanine flavors no TMS-Cl was added]. The THF solution of [(1R,3S,3aS)-1-chloro-3-((methyldiphenylsilyl)methyl)tetrahydro-1H, 3H-pyrrolo[1,2-c][1,3,2]oxazaphosphole (or) (1S,3R,3aR)-1-chloro-3-((methyldiphenylsilyl)methyl)tetrahydro-1H, 3H-pyrrolo[1,2-c][1,3,2]oxazaphosphole (1.8 equiv.) was added through syringe to the above reaction mixture over 2 min then gradually warmed to room temperature. After 20-30 min, at rt, TLC as well as LCMS indicated starting material was converted to product (reaction time: 1 h). Then the reaction mixture was filtered under argon using air free filter tube, washed with THF and dried under rotary evaporation at 26° C. afforded crude solid material, which was purified by ISCO-combiflash system (40 g gold rediSep high performance silica column (pre-equilibrated 3 CV with $CH_3CN$/5% TEA then 3 CV with DCM/5% TEA) using DCM/$CH_3CN$/5% TEA as a solvent (compound eluted at 10-40 DCM/$CH_3CN$/5% TEA). After evaporation of column fractions pooled together was dried under high vacuum afforded white solid to give isolated yield.

$^{31}$P NMR (internal standard of Phosphoric acid at δ 0.0): 1001: −1.34 and −1.98. 1002: −1.93. 1003: −1.38. $^{1}$H NMR of 1001, 1002, and 1003 demonstrated different chemical shifts for multiple hydrogens of the diastereomers. LCMS showed different retention times for the two diastereomers as well. Under one condition, the following retention times were observed: 1.90 and 2.15 for 1001, 1.92 for one diastereomer, and 2.17 for the other.

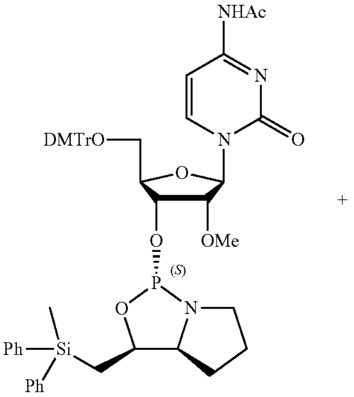

-continued
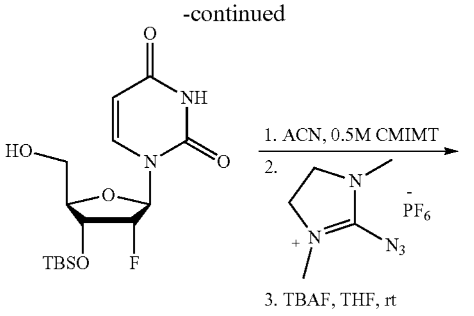
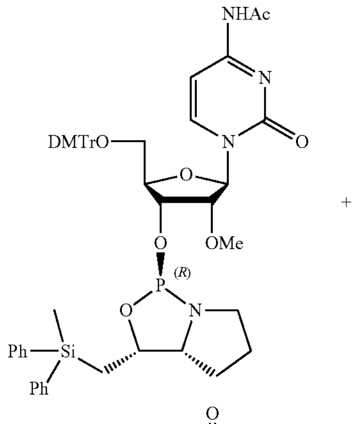
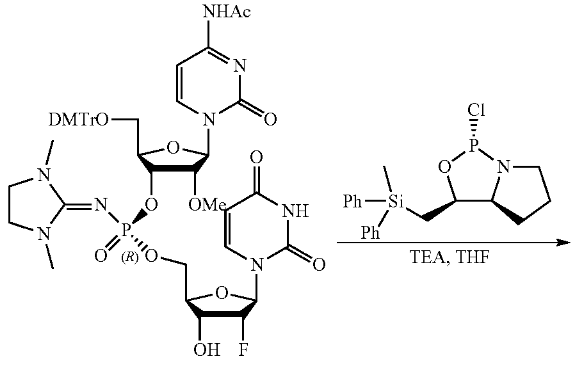
1004
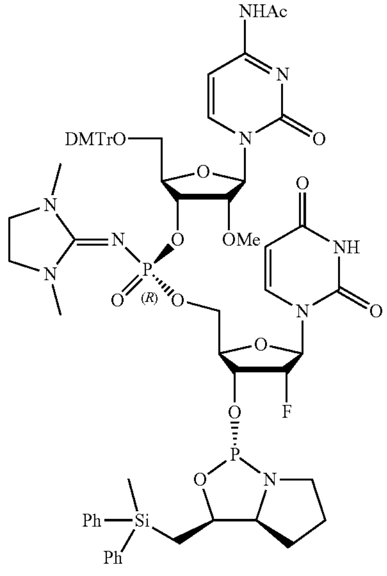
1005
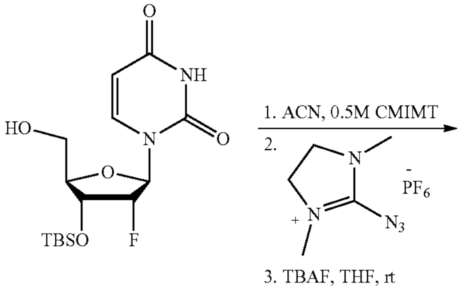
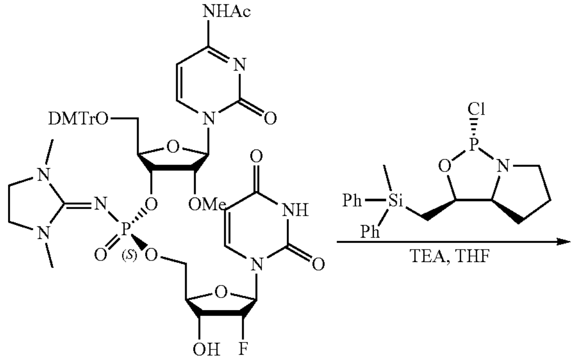
1006
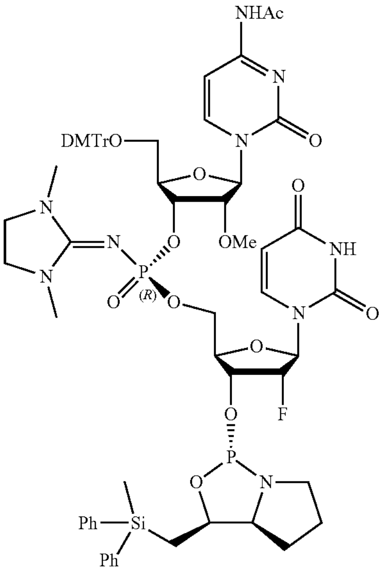
1007
Compound 1004: Procedures B and C followed, Off-white foamy solid, Yield: (36%). $^{31}P$ NMR (162 MHz, $CDCl_3$) δ −1.23. MS (ES) m/z calculated for $C_{47}H_{54}FN_8O_{14}P$ $[M]^+$ 1004.34, Observed: 1043.21 $[M+K]^+$.
Compound 1005: Procedure D used, Off-white foamy solid, Yield: (81%). $^{31}P$ NMR (162 MHz, $CDCl_3$) δ 154.43, −2.52. MS (ES) m/z calculated for $C_{66}H_{76}FN_9O_{15}P_2Si$ $[M]^+$ 1343.46, Observed: 1344.85 $[M+H]^+$.

Compound 1006: Procedures B, and C followed, Off-white foamy solid, Yield: (47%). $^{31}P$ NMR (162 MHz, $CDCl_3$) δ −2.54. MS (ES) m/z calculated for $C_{47}H_{54}FN_8O_{14}P$ $[M]^+$ 1004.34, Observed: 1043.12 $[M+K]^+$.
Compound 1007: Procedure D used, Off-white foamy solid, Yield: (81%). $^{31}P$ NMR (162 MHz, $CDCl_3$) δ 153.55, −2.20. MS (ES) m/z calculated for $C_{66}H_{76}FN_9O_{15}P_2Si$ $[M]^+$ 1343.46, Observed: 1344.75 $[M+H]^+$.
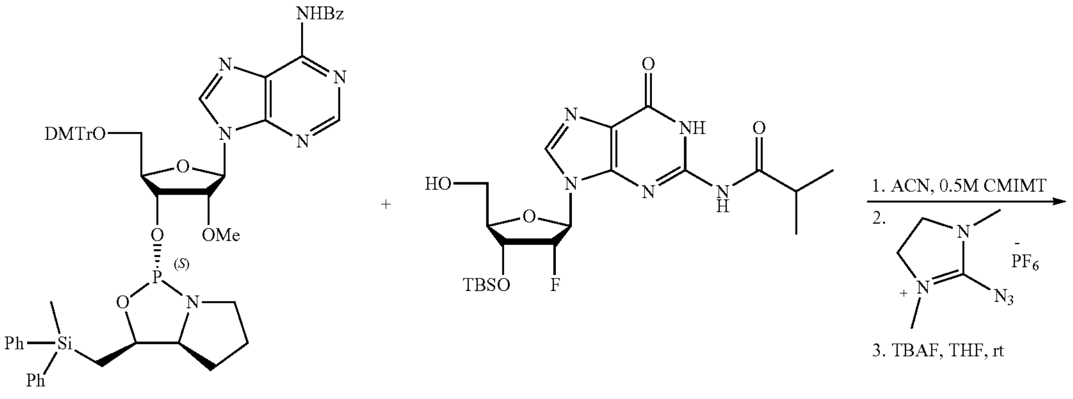
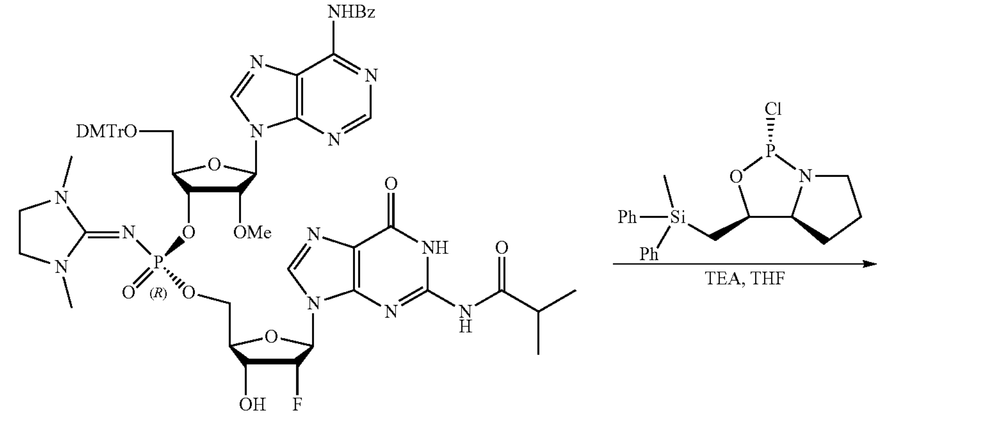
1008
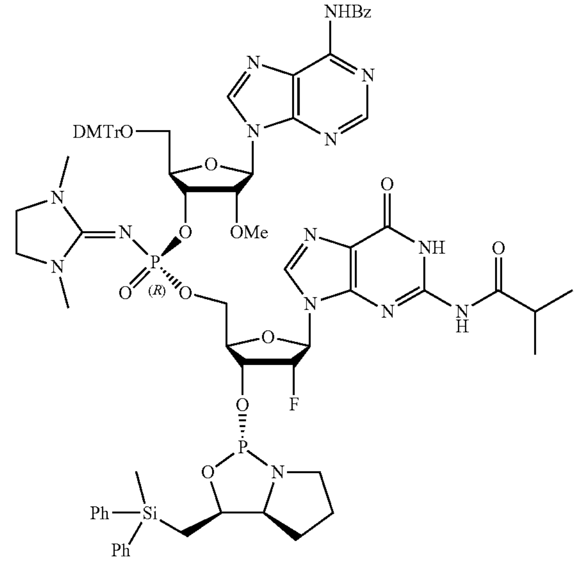
1009

Compound 1008: Procedures B and C followed, Off-white foamy solid, Yield: (36%). $^{31}P$ NMR (162 MHz, $CDCl_3$) δ −1.38. MS (ES) m/z calculated for $C_{58}H_{63}FN_{13}O_{13}P$ $[M]^+$ 1199.43, Observed: 1200.76 $[M+H]^+$.
Compound 1009: Procedure D used, Off-white foamy solid, Yield: (60%). $^{31}P$ NMR (162 MHz, $CDCl_3$) δ 157.26, −2.86. MS (ES) m/z calculated for $C_{77}H_{85}FN_{14}O_{14}P_2Si$ $[M]^+$ 1538.55, Observed: 1539.93 $[M+H]^+$.
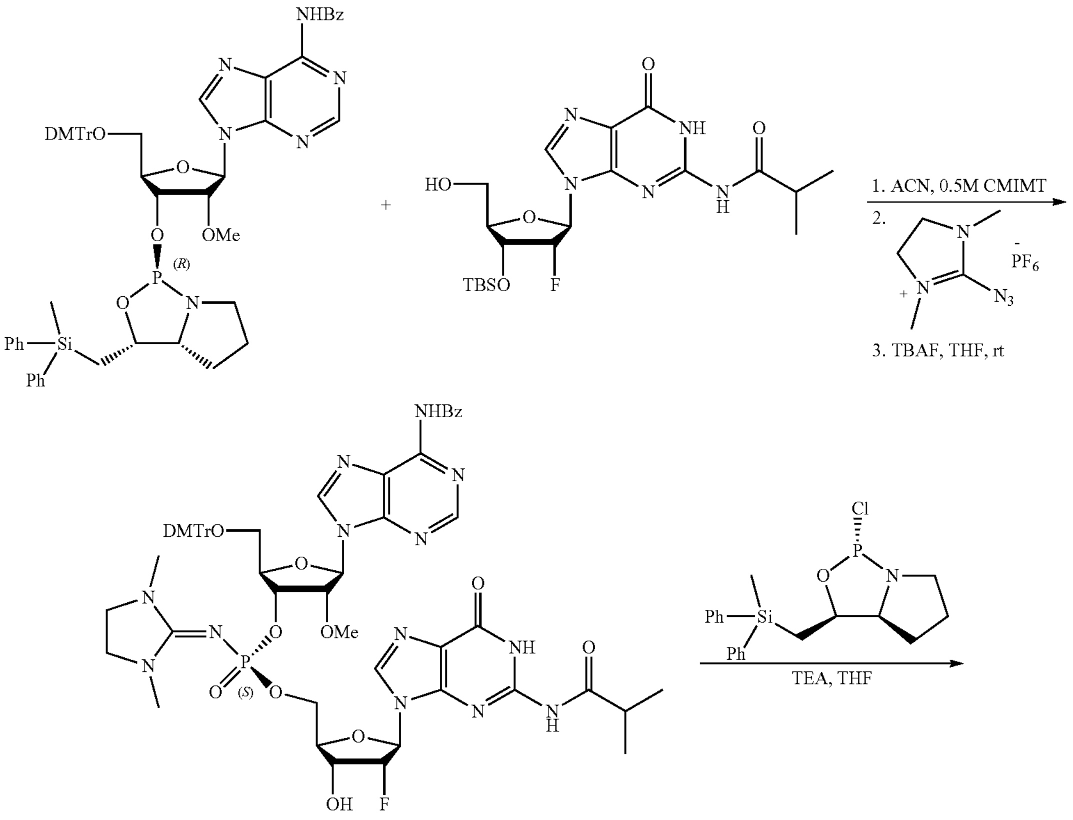
1010
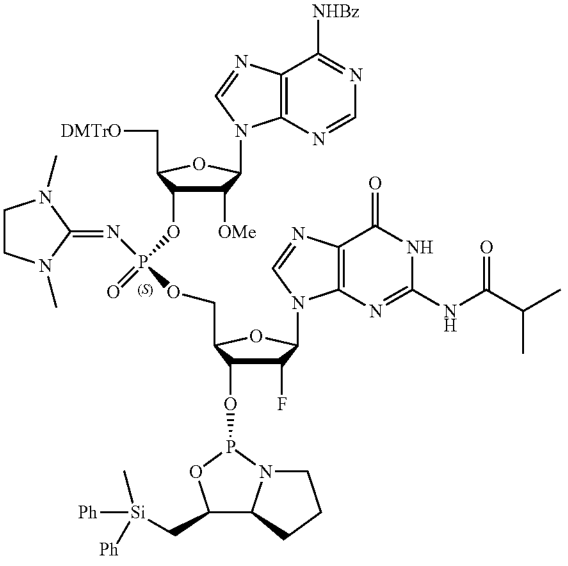
1011

Compound 1010: Procedures B and C followed, Off-white foamy solid, Yield: (36%). 31p NMR (162 MHz, $CDCl_3$) δ −2.82. MS (ES) m/z calculated for $C_{58}H_{63}FN_{13}O_{13}P$ $[M]^+$ 1199.43, Observed: 1200.19 $[M+H]^+$.
Compound 1011: Procedure D used, Off-white foamy solid, Yield: (63%). $^{31}P$ NMR (162 MHz, $CDCl_3$) δ 159.56, −2.99. MS (ES) m/z calculated for $C_{77}H_{85}FN_{14}O_{14}P_2Si$ $[M]^+$ 1538.55, Observed: 1539.83 $[M+H]^+$.
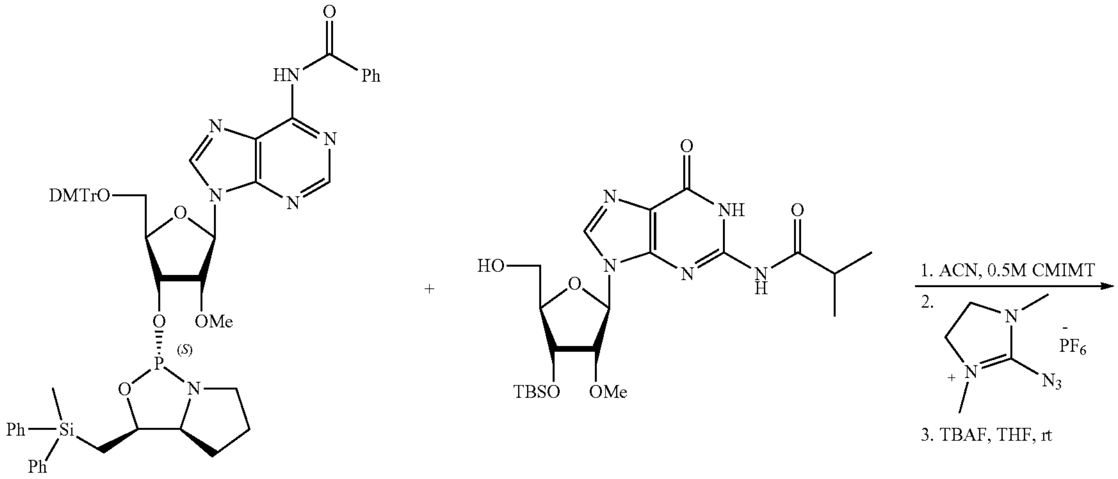
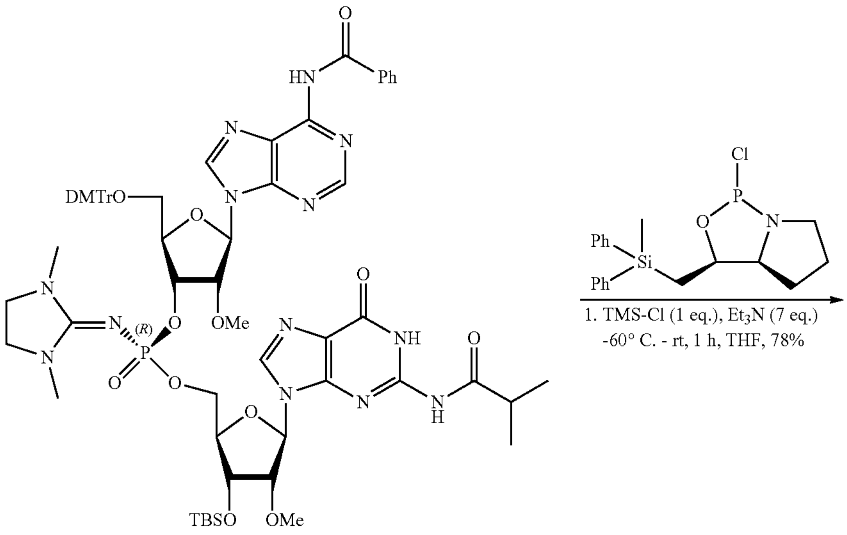
1012

-continued

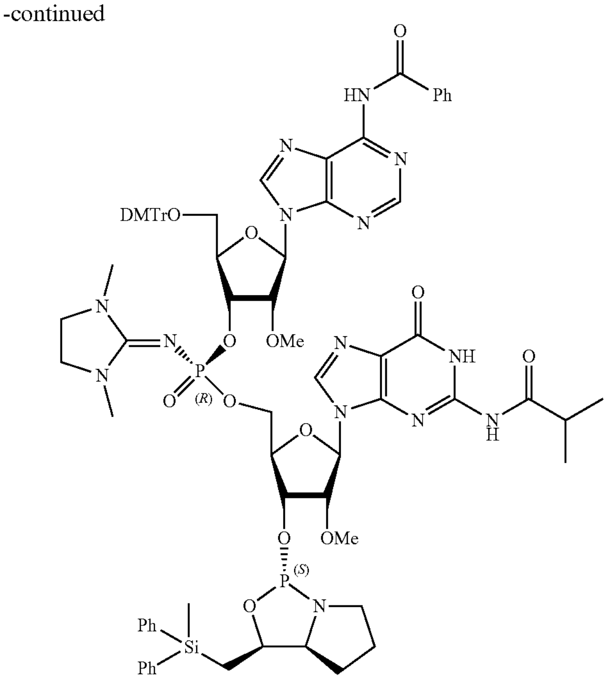

1013

Compound 1012: Procedures B and C followed, Off-white foamy solid, Yield: (36%). $[\alpha]_D^{23}$=−25.74 (c 1.06, $CHCl_3$). $^{31}$P NMR (162 MHz, Chloroform-d) δ −1.83. $^{1}$H NMR (400 MHz, Chloroform-d) δ 12.14 (s, 1H), 11.28 (s, 1H), 9.15 (s, 1H), 8.56 (s, 1H), 8.25-7.94 (m, 2H), 7.90 (s, 1H), 7.72-7.48 (m, 2H), 7.44 (dd, J=8.2, 6.7 Hz, 2H), 7.35-7.26 (m, 2H), 7.24-7.02 (m, 8H), 6.81-6.56 (m, 4H), 6.04 (d, J=5.2 Hz, 1H), 5.67 (d, J=5.5 Hz, 1H), 4.83 (dt, J=8.6, 4.4 Hz, 1H), 4.71-4.54 (m, 2H), 4.49 (dt, J=14.2, 4.8 Hz, 2H), 4.35 (ddt, J=11.0, 5.1, 3.2 Hz, 1H), 4.28-4.09 (m, 2H), 3.68 (s, 6H), 3.37 (d, J=3.3 Hz, 7H), 3.33-3.17 (m, 5H), 2.82 (s, 5H), 2.74-2.60 (m, 1H), 1.92 (s, 2H), 1.72-1.50 (m, 1H), 1.08 (d, J=6.9 Hz, 3H), 0.94 (d, J=6.9 Hz, 3H). MS (ES) m/z calculated for $C_{59}H_{66}N_{13}O_{14}P$ 1211.45 $[M]^+$, Observed: 1212.42 $[M+H]^+$.

Compound 1013: Procedure D used, Off-white foamy solid, Yield: (78%). $[\alpha]_D^{23}$=−15.48 (c 0.96, $CHCl_3$). $^{31}$P NMR (162 MHz, Chloroform-d) δ 159.42, −2.47. MS (ES) m/z calculated for $C_{78}H_{88}N_{14}O_{15}P_2Si$ 1550.57 $[M]^+$, Observed: 1551.96 $[M+H]^+$.

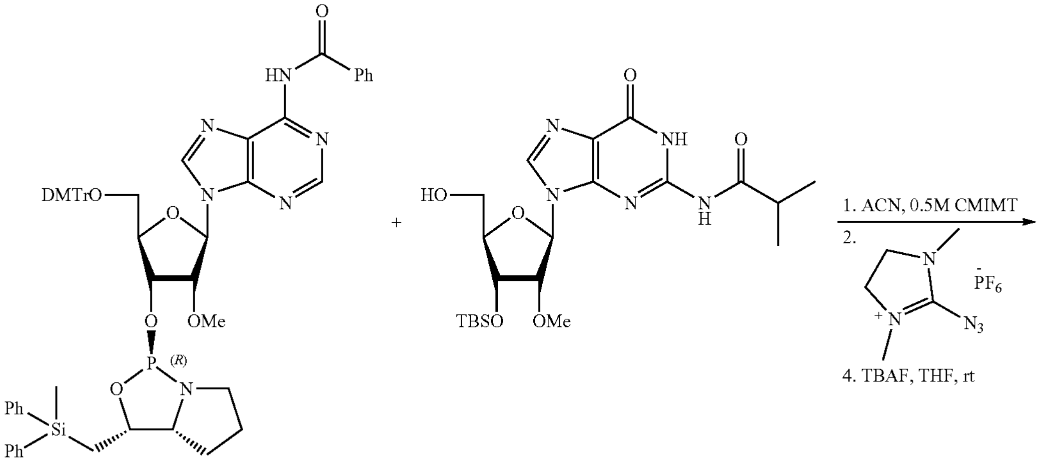

-continued

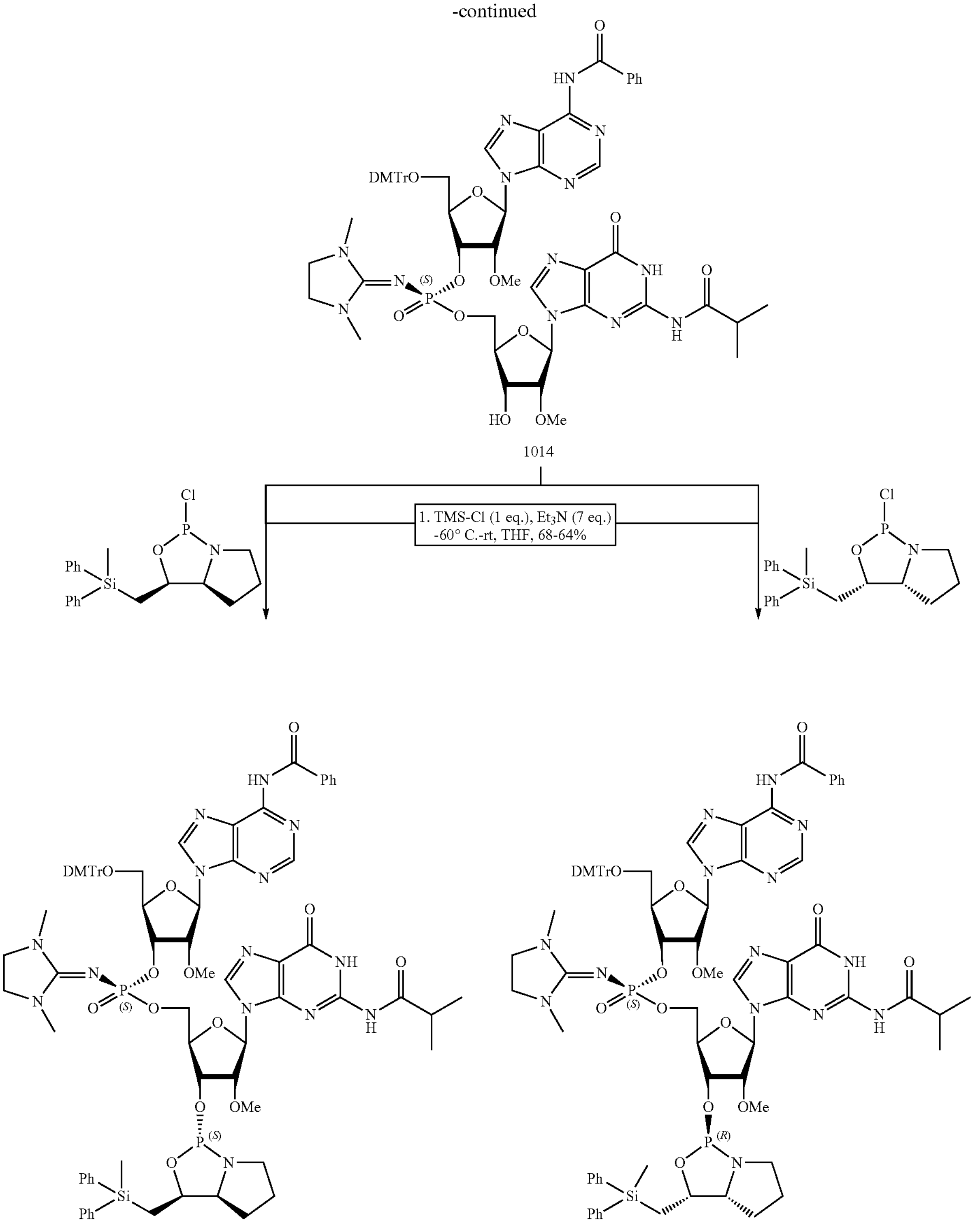

1014

1015

1016

Compound 1014: Procedures B and C followed, Off-white foamy solid, Yield: (30%). $[\alpha]_D^{23}$=−21.45 (c 0.55, $CHCl_3$). MS (ES) m/z calculated for $C_{59}H_{66}N_{13}O_{14}P$ 1211.45 $[M]^+$, Observed: 1212.80 $[M+H]^+$.

Compound 1015: Procedure D used, Off-white foamy solid, Yield: (68%). $[\alpha]_D^{23}$=−15.63 (c 1.44, $CHCl_3$). MS (ES) m/z Calculated for $C_{78}H_{88}N_{14}O_{15}P_2Si$ 1550.57 $[M]^+$, Observed: 1551.77 $[M+H]^+$.

Compound 1016: Procedure D used, Off-white foamy solid, Yield: (64%). $^{31}P$ NMR (162 MHz, $CDCl_3$) δ 156.64, −2.67. MS (ES) m/z Calculated for $C_{78}H_{88}N_{14}O_{15}P_2Si$ 1550.57 $[M]^+$, Observed: 1551.77 $[M+H]^+$.

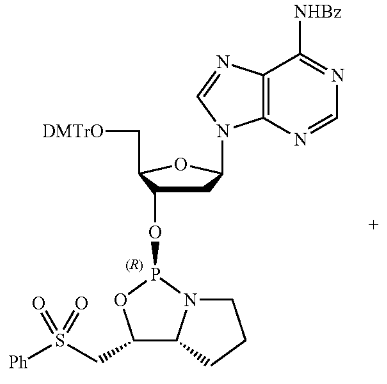

1017

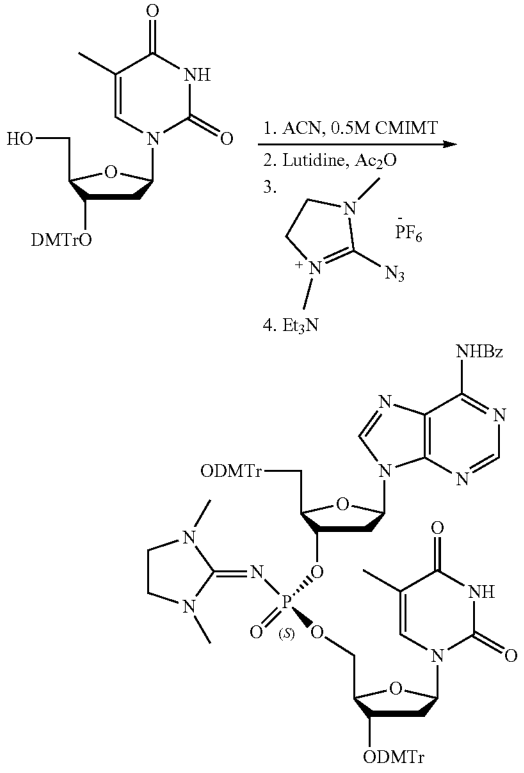

1018

General experimental procedure (E) for stereopure dimer using sulfonyl amidite: To a stirred solution of steropure sulfonyl amidite 1017 (259 mg, 0.275 mmol, 1.5 equiv) and TBS protected alcohol (100 mg, 0.18 mmol) in dry acetonitrile (2 mL) was added 2-(1H-imidazol-1-yl) acetonitrile trifluoromethanesulfonate (CMIMT, 0.73 mL, 0.36 mmol, 0.5M, 2 equiv.) under argon atmosphere at room temperature. Resulting reaction mixture was stirred for 5 mins and monitored by LCMS then a mixture of acetic anhydride (2M in ACN, 0.18 ml, 0.36 mmol, 2 equ) and lutidine (2M in ACN, 0.18 ml, 0.36 mmol, 2 equ) was added then stirred for ~5 mins then a solution of 2-azido-1,3-dimethylimidazolinium hexafluorophosphate (104.7 mg, 0.367 mmol, 2 equiv.) in acetonitrile (1 mL) was added. Once the reaction was completed (after ~5 mins, monitored by LCMS) then triethylamine (0.13 mL, 0.91 mmol, 5 equiv.) was added and monitored by LCMS. Once the reaction was completed, it was concentrated under reduced pressure and then re-dissolved in dichloromethane (50 mL) washed with water (25 mL), saturated aq. Sodium bicarbonate (25 mL) and brine (25 mL) dried with magnesium sulfate. Solvent was removed under reduced pressure. The crude product was purified by silica gel column (80 g) using DCM (2% triethylamine) and MeOH as eluent. Product containing fractions collected and evaporated. Off white solid 1018 obtained. Yield: 204 mg (82%). $^{31}P$ NMR (162 MHz, $CDCl_3$) δ −1.87. MS (ES) m/z calculated for $C_{74}H_{75}FN_{10}O_{14}P$ $[M]^+$ 1359.44, Observed: 1360.39 $[M+H]^+$.

Additional phosphoramidites that may be utilized for synthesis include:

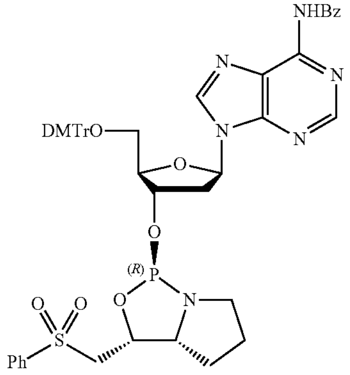

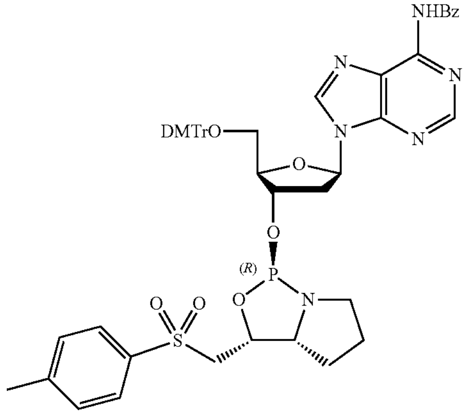

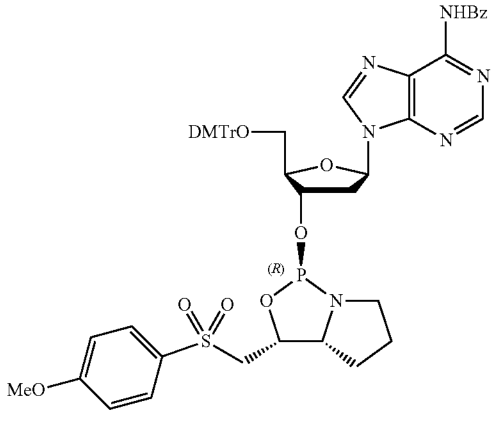

-continued

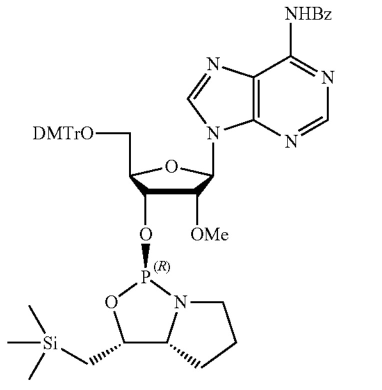

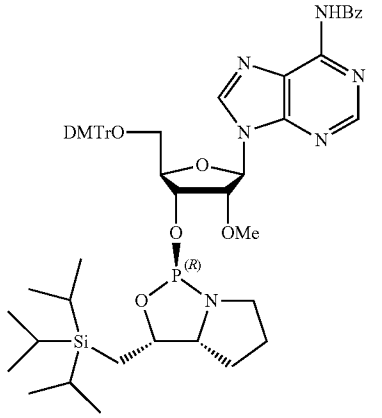

Additional useful chiral auxiliaries include:

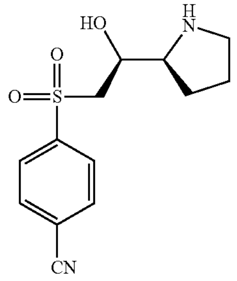

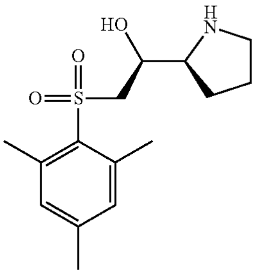

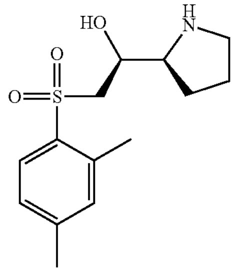

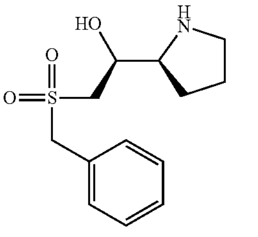

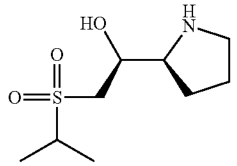

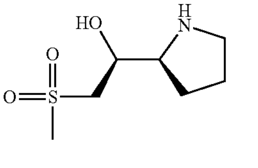

-continued

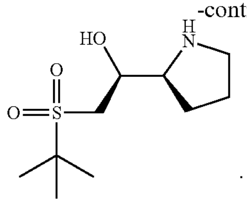

Other phosphoramidites and chiral auxiliaries, such as those described in U.S. Pat. Nos. 9,695,211, 9,605,019, 9,598,458, US 2013/0178612, US20150211006, US20170037399, WO 2017/015555, WO 2017/062862, WO 2017/160741, WO 2017/192664, WO 2017/192679, WO 2017/210647, WO 2018/098264, WO 2018/223056, and/or WO 2018/237194, the chiral auxiliaries and phosphoramidites of each of which is incorporated by reference.

Example 4C. Synthesis of $N^2$,$N^6$-bis(4-sulfamoylbenzoyl)-L-lysine

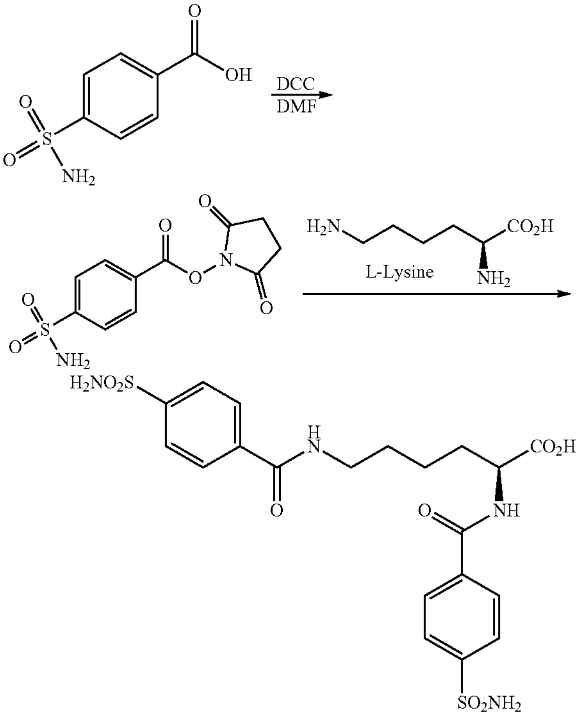

Step 1. To a solution of 4-sulfamoylbenzoic acid (10.00 g, 49.70 mmol) and HOSu (6.29 g, 54.67 mmol) in DMF (300 mL) was added DCC(10.25 g, 49.70 mmol) at 0° C. The mixture was stirred at 0° C. for 16 hours. LCMS showed compound was consumed. The resulting mixture was combined and workup with another batch of crude (1 g scale). The white suspension of N,N'-dicyclohexylurea (DCU) was filtered and removed white solid. The filtrate was concentrated to give an oil. This crude product was washed with hot 2-propanol (50 mL*3) to afford an off-white solid. Compound (2,5-dioxopyrrolidin-1-yl) 4-sulfamoylbenzoate (11.80 g, 38.66 mmol, 77.78% yield, 97.713% purity) (yield from conversion rate for 10 g batch) was obtained as a white solid. Compound (2,5-dioxopyrrolidin-1-yl) 4-sulfamoylbenzoate (13 g) was totally obtained as a white solid for two batches of reactions. $^1$H NMR (400 MHz, CHLOROFORM-d) δ=8.30 (d, J=8.4 Hz, 2H), 8.08 (d, J=8.3 Hz, 2H), 7.70 (s, 2H), 2.96-2.87 (m, 4H); $^{13}$C NMR (101 MHz, DMSO-$d_6$) δ=170.62, 161.47, 150.32, 131.40, 127.65, 127.18, 26.04; HPLC purity: 97.71%.

Step 2. To a solution of (2,5-dioxopyrrolidin-1-yl) 4-sulfamoylbenzoate (5.00 g, 16.76 mmol) and (2S)-2,6-diaminohexanoic acid (1.23 g, 8.38 mmol) in $H_2O$ (50 mL) and DMF (50.00 mL) was added $NaHCO_3$ (2.11 g, 25.14 mmol). The mixture was stirred at 15° C. for 16 hours. LCMS showed MS with desired compound was detected. The mixture concentrated under reduced pressure to give a crude (6 g). The crude (3.5 g) was purified by prep-HPLC (column: Phenomenex luna C18 250*50 mm*10 um; mobile phase: [water(0.1% TFA)-ACN]; B %: 1%-30%,20 min). $N^2$,$N^6$-bis(4-sulfamoylbenzoyl)-L-lysine (1.40 g, 30.40% yield, 93.268% purity) was obtained as a white solid and 2.5 g crude as a yellow solid. $^1$H NMR (400 MHz, DMSO-$d_6$) δ=12.64 (br s, 1H), 8.80 (br d, J=7.5 Hz, 1H), 8.65 (br t, J=5.3 Hz, 1H), 8.04 (d, J=8.2 Hz, 2H), 7.99-7.95 (m, 2H), 7.95-7.84 (m, 4H), 7.48 (br d, J=11.6 Hz, 4H), 4.44-4.32 (m, 1H), 3.28 (br d, J=6.1 Hz, 2H), 1.94-1.71 (m, 3H), 1.63-1.36 (m, 4H); $^{13}$C NMR (101 MHz, DMSO-$d_6$) δ=174.04, 166.08, 165.58, 146.89, 146.57, 138.05, 137.36, 128.60, 128.26, 126.05, 53.21, 30.77, 29.11, 23.84. LCMS (M−$H^+$): 511.0 $(M+H)^+$; HPLC purity: 93.268%.

Example 4D. Example Technologies for Chirally Controlled Oligonucleotide Preparation—Example Useful Chiral Auxiliaries Among other things, the present disclosure provides technologies (e.g., chiral auxiliaries, phosphoramidites, cycles, conditions, reagents, etc.) that are useful for preparing chirally controlled internucleotidic linkages. In some embodiments, provided technologies are particularly useful for preparing certain internucleotidic linkages, e.g., non-negatively charged internucleotidic linkages, neutral internucleotidic linkages, etc., comprising P—N═, wherein P is the linkage. In some embodiments, the linkage phosphorus is trivalent. In some embodiments, the linkage phosphorus is pentavalent. In some embodiments, such internucleotidic linkages have the structure of formula I-n-1, I-n-2, I-n-3, I-n-4, II, II-a-1, II-a-2, II-b-1, II-b-2, II-c-1, II-c-2, II-d-1, II-d-2, or a salt form thereof. Certain example technologies (chiral auxiliaries and their preparations, phosphoramidites and their preparations, cycles, conditions, reagents, etc.) are described in the Examples herein. Among other things, such chiral auxiliaries provide milder reaction conditions, higher functional group compatibility, alternative deprotection and/or cleavage conditions, higher crude and/or purified yields, higher crude purity, higher product purity, and/or higher (or substantially the same or comparable) stereoselectivity when compared to a reference chiral auxiliary (e.g., of formula O, P, Q, R or DPSE).

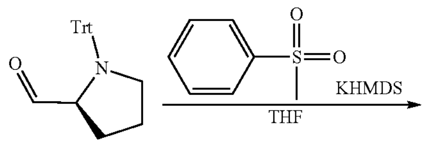

1

-continued

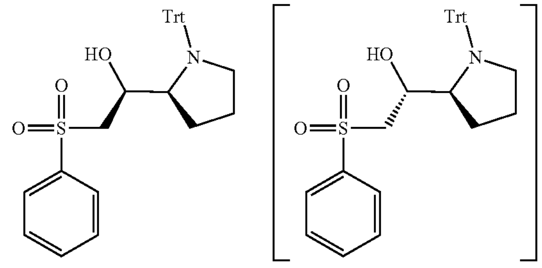

2 3

Two batches in parallel: To a solution of methylsulfonylbenzene (102.93 g, 658.96 mmol, 1.5 eq.) in THF (600 mL) was added KHMDS (1 M, 658.96 mL, 1.5 eq.) dropwise at −70° C., and warmed to −30° C. slowly over 30 min. The mixture was then cooled to −70° C. A solution of compound 1 (150 g, 439.31 mmol, 1 eq.) in THF (400 mL) was added dropwise at −70° C. The mixture was stirred at −70° C. for 3 hr. TLC(Petroleum ether: Ethyl acetate=3:1, Rf=0.1) indicated compound 1 was consumed completely and one major new spot with larger polarity was detected. Combined 2 batches. The reaction mixture was quenched by added to the sat. $NH_4Cl$ (aq. 1000 mL), and then extracted with EtOAc (1000 mL×3). The combined organic layers were dried over $Na_2SO_4$, filtered, and concentrated under reduced pressure to give 1000 mL solution. Then added the MeOH (600 mL), concentrated under reduced pressure to give 1000 mL solution, then filtered the residue and washed with MeOH (150 mL); the residue was dissolved with THF (1000 mL) and MeOH (600 mL), then concentrated under reduced pressure to give 1000 mL solution. Then filtered to give a residue and washed with MeOH (150 mL). And repeat one more time. Compound 2 (248 g, crude) was obtained as a white solid. And the combined mother solution was concentrated under reduced pressure to give compound 3 (200 g, crude) as yellow oil.

Compound 2: $^1$H NMR (400 MHz, CHLOROFORM-d) δ=7.80 (d, J=7.5 Hz, 2H), 7.74-7.66 (m, 1H), 7.61-7.53 (m, 2H), 7.47 (d, J=7.5 Hz, 6H), 7.24-7.12 (m, 9H), 4.50-4.33 (m, 1H), 3.33 (s, 1H), 3.26 (ddd, J=2.9, 5.2, 8.2 Hz, 1H), 3.23-3.10 (m, 2H), 3.05-2.91 (m, 2H), 1.59-1.48 (m, 1H), 1.38-1.23 (m, 1H), 1.19-1.01 (m, 1H), 0.31-0.12 (m, 1H).

Preparation of Compound WV-CA-108.

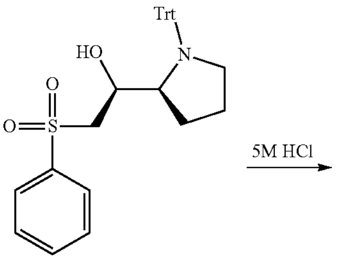

2

-continued

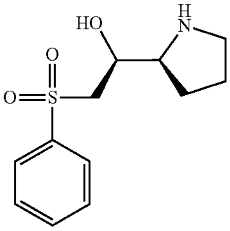

WV-CA-108

To a solution of compound 2 (248 g, 498.35 mmol, 1 eq.) in THF (1 L) was added HCl (5 M, 996.69 mL, 10 eq.). The mixture was stirred at 15° C. for 1 hr. TLC(Petroleum ether: Ethyl acetate=3:1, Rf=0.03) indicated compound 2 was consumed completely and one major new spot with larger polarity was detected. The resulting mixture was washed with MTBE (500 mL×3). The combined organic layers were back-extracted with water (100 mL). The combined aqueous layer was adjusted to pH 12 with 5M NaOH aq. and extracted with DCM (500 mL×3). The combined organic layers were dried over anhydrous $Na_2SO_4$, filtered and concentrated to afford a white solid. WV-CA-108 (122.6 g, crude) was obtained as a white solid.

$^1$H NMR (400 MHz, CHLOROFORM-d) δ=7.95 (d, J=7.5 Hz, 2H), 7.66 (t, J=7.5 Hz, 1H), 7.57 (t, J=7.7 Hz, 2H), 4.03 (ddd, J=2.6, 5.3, 8.3 Hz, 1H), 3.37-3.23 (m, 2H), 3.20-3.14 (m, 1H), 2.91-2.75 (m, 3H), 2.69 (br s, 1H), 1.79-1.54 (m, 5H); $^{13}$C NMR (101 MHz, CHLOROFORM-d) δ=139.58, 133.83, 129.28, 127.98, 67.90, 61.71, 59.99, 46.88, 25.98, 25.84; LCMS $[M+H]^+$: 256.1. LCMS purity: 100%. SFC 100% purity.

Among other things, the present disclosure encompasses the recognition that bases utilized in reactions (e.g., from compound 1 to compound 2) can impact stereoselectivity of such reactions. Certain example results are described below:

| S. No | Aldehyde | Nucleophile | Base | Chiral Auxiliary (Diastereoselectivity, cis/trans) |
|---|---|---|---|---|
| 1 | 1 | 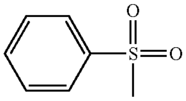 | n-BuLi | WV-CA-108 (87:13) |
| 2 | 1 | 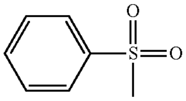 | LiHMDS | WV-CA-108 (1.85:1) |
| 3 | 1 | 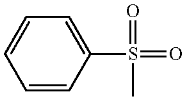 | LDA | WV-CA-108 (1.85:1) |
| 4 | 1 | 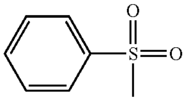 | KHMDS | WV-CA-108 (10:1) |
| 5 | 1 | 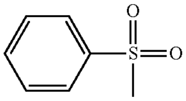 | t-BuOK | WV-CA-108 (10:1) |
| 6 | 4 | 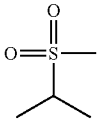 | n-BuLi | WV-CA-242 (2:1) |
| 7 | 4 | 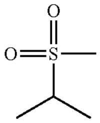 | KHMDS | WV-CA-242 (8:1) |
| 8 | 4 | 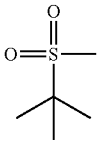 | n-BuLi | WV-CA-243 (2:1) |

-continued

| S. No | Aldehyde | Nucleophile | Base | Chiral Auxiliary (Diastereoselectivity, cis/trans) |
|---|---|---|---|---|
| 9 | 4 | 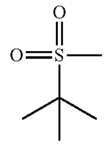 | KHMDS | WV-CA-243 (8:1) |
| 10 | 4 | 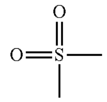 | n-BuLi | WV-CA-347 (5.5:1) |
| 11 | 4 | 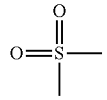 | KHMDS | WV-CA-347 (10:1) |
| 12 | 4 | 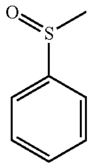 | KHMDS | WV-CA-247 (43:57) |
| 13 | 4 | 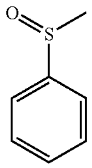 | n-BuLi | WV-CA-247 (~1:1) |
| 14 | 4 | 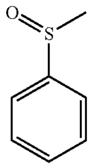 | LiHMDS | WV-CA-247 (~39:51) |
| 15 | 4 | 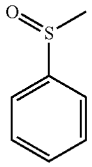 | NaHMDS | WV-CA-247 (~40:66) |

Preparation of Compound WV-CA-237.

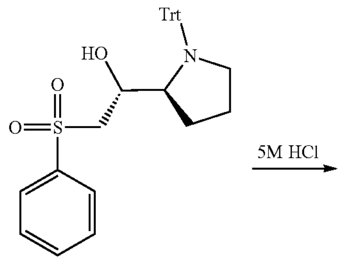

3

-continued

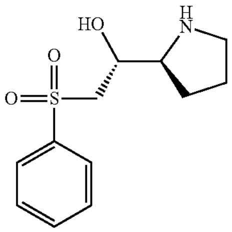

WV-CA-237

To a solution of compound 3 (400.00 g, 803.78 mmol) in THF (1.5 L) was added HCl (5 M, 1.61 L). The mixture was stirred at 15° C. for 2 hr. TLC indicated compound 3 was consumed completely and one major new spot with larger polarity was detected. The resulting mixture was washed with MTBE (500 mL×3). The combined aqueous layer was adjusted to pH 12 with 5M NaOH aq. and extracted with DCM (500 mL×1) and EtOAc (1000 mL×2). The combined organic layers were dried over anhydrous $Na_2SO_4$, filtered, and concentrated to afford as a brown solid. WV-CA-237 (100 g, crude) was obtained as a brown solid.

The residue was purified by column chromatography ($SiO_2$, Petroleum ether/Ethyl acetate=3/1 to Ethyl acetate: Methanol=1:2) to give 24 g crude. Then the 4 g residue was purified by prep-HPLC(column: Phenomenex luna C18 250×50 mm×10 um; mobile phase: [water(0.05% HCl)-ACN]; B %: 2%→20%, 15 min) to give desired compound (2.68 g, yield 65%,) as a white solid. WV-CA-237 (2.68 g) was obtained as a white solid. WV-CA-237: $^1$H NMR (400 MHz, CHLOROFORM-d) δ=7.98-7.88 (m, 2H), 7.68-7.61 (m, 1H), 7.60-7.51 (m, 2H), 4.04 (dt, J=2.4, 5.6 Hz, 1H), 3.85 (ddd, J=3.1, 5.6, 8.4 Hz, 1H), 3.37-3.09 (m, 3H), 2.95-2.77 (m, 3H), 1.89-1.53 (m, 4H), 1.53-1.39 (m, 1H); $^{13}$C NMR (101 MHz, CHLOROFORM-d) δ=139.89, 133.81, 133.70, 129.26, 129.16, 128.05, 127.96, 68.20, 61.77, 61.61, 61.01, 60.05, 46.67, 28.02, 26.24, 25.93; LCMS $[M+H]^+$: 256.1. LCMS purity: 80.0%. SFC dr=77.3: 22.7.

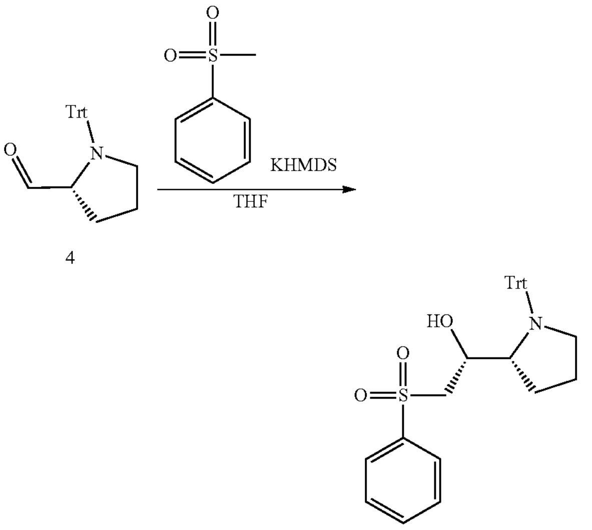

4

5

To a solution of compound 4 (140 g, 410.02 mmol) in THF (1400 mL) was added methylsulfonylbenzene (96.07 g, 615.03 mmol), then added KHMDS (1 M, 615.03 mL) in 0.5 hr. The mixture was stirred at −70∼−40° C. for 3 hr. TLC indicated compound 4 was consumed and one new spot formed. The reaction mixture was quenched by addition sat. $NH_4Cl$ aq. 3000 mL at 0° C., and then diluted with EtOAc (3000 mL) and extracted with EtOAc (2000 mL×3). Dried over $Na_2SO_4$, filtered, and concentrated under reduced pressure to give a residue. To the crude was added THF (1000 mL) and MeOH (1500 mL), concentrated under reduced pressure at 45° C. until about 1000 mL residue remained, filtered the solid. Repeat 3 times. Compound 5 (590 g, 72.29% yield) was obtained as a yellow solid. $^1$H NMR (400 MHz, CHLOROFORM-d) δ=7.81 (d, J=7.5 Hz, 2H), 7.75-7.65 (m, 1H), 7.62-7.53 (m, 2H), 7.48 (br d, J=7.2 Hz, 6H), 7.25-7.11 (m, 9H), 4.50-4.37 (m, 1H), 3.31-3.11 (m, 3H), 3.04-2.87 (m, 2H), 1.60-1.48 (m, 1H), 1.39-1.24 (m, 1H), 1.11 (dtd, J=4.5, 8.8, 12.8 Hz, 1H), 0.32-0.12 (m, 1H).

Preparation of Compound WV-CA-236.

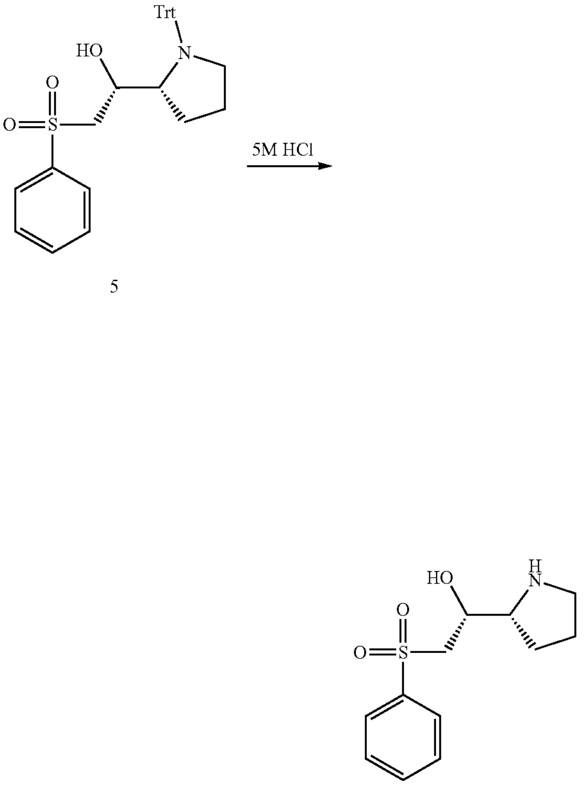

5

WV-CA-236

To a solution of compound 5 (283 g, 568.68 mmol) in THF (1100 mL) was added HCl (5 M, 1.14 L). The mixture was stirred at 25° C. for 2 hr. TLC indicated compound 5 was consumed and two new spots formed. The reaction mixture was washed with MTBE (1000 mL×3), then the aqueous phase was basified by addition NaOH (5M) until pH=12 at 0° C., and then extracted with DCM (1000 mL×3) to give a residue, dried over $Na_2SO_4$, filtered, and concentrated under reduced pressure to give a residue. Compound WV-CA-236 (280 g, 1.10 mol, 96.42% yield) was obtained as a yellow solid.

The crude product was added HCl/EtOAc (1400 mL, 4M) at 0° C., 2 hr later, filtered the white solid and washed the solid with MeOH (1000 mL×3). LCMS showed the solid contained another peak (MS=297). Then the white solid was added $H_2O$ (600 mL) and washed with DCM (300 mL×3). The aqueous phase was added NaOH (5 M) until pH=12. Then diluted with DCM (800 mL) and extracted with DCM (800 mL×4). The combined organic layer was dried over $Na_2SO_4$, filtered, and concentrated under reduced pressure to give the product. Compound WV-CA-236 (280 g) was obtained as a yellow solid. $^1$H NMR (400 MHz, CHLOROFORM-d) δ=8.01-7.89 (m, 2H), 7.69-7.62 (m, 1H), 7.61-7.51 (m, 2H), 4.05 (ddd, J=2.8, 5.2, 8.4 Hz, 1H), 3.38-3.22 (m, 2H), 3.21-3.08 (m, 1H), 2.95-2.72 (m, 4H), 1.85-1.51 (m, 4H); $^{13}$C NMR (101 MHz, CHLOROFORM-d) δ=139.75, 133.76, 129.25, 127.94, 67.57, 61.90, 60.16, 46.86, 25.86. LCMS $[M+H]^+$: 256. LCMS purity: 95.94. SFC purity: 99.86%.

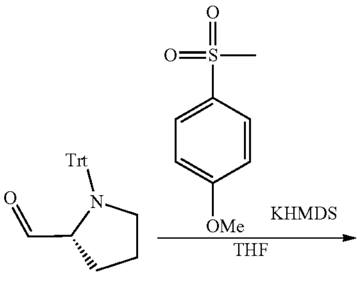

4

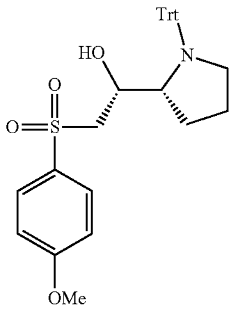

6

To a solution of 1-methoxy-4-methylsulfonyl-benzene (36.82 g, 197.69 mmol) in THF (500 mL) was added KHMDS (1 M, 197.69 mL) at −70° C., 0.5 hr later added compound 4 (45 g, 131.79 mmol) in THF (400 mL) at −70° C. The mixture was stirred at −70→−30° C. for 4 hr, and then the mixture was added with KHMDS (1M, 131.79 mL) at −70° C. The mixture was stirred at −70° C. for 1 hr. TLC indicated compound 4 was remained, and two new spots were detected. The reaction mixture was quenched by sat. $NH_4Cl$ (aq. 300 mL), and then extracted with EtOAc (500 mL×3). The combined organic layers were dried over $Na_2SO_4$, filtered, and concentrated under reduced pressure to give a residue. The residue was dissolved in THF (800 mL) and MeOH (500 mL), and then concentrated under reduced pressure until 200 mL solvent left. The mixture was added with MeOH (500 mL) and concentrated under reduced pressure to 200 mL solvent left and solid appeared. The solid was filtered to give product. Repeated the trituration 2 times. Compound 6 (49.8 g, 71.61% yield) was obtained as a brown solid. $^1$H NMR (400 MHz, CHLOROFORM-d) δ=7.73-7.66 (m, 2H), 7.46 (d, J=7.5 Hz, 6H), 7.24-7.11 (m, 9H), 7.04-6.96 (m, 2H), 4.37 (td, J=3.1, 8.3 Hz, 1H), 3.94-3.88 (m, 3H), 3.36 (s, 1H), 3.26-3.10 (m, 3H), 3.00-2.89 (m, 2H), 1.58-1.45 (m, 1H), 1.37-1.23 (m, 1H), 1.15-1.00 (m, 1H), 0.26-0.10 (m, 1H).

Preparation of Compound WV-CA-241.

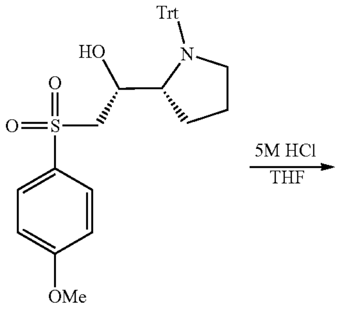

6

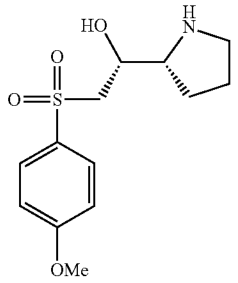

WV-CA-241

To a solution of compound 6 (50 g, 94.76 mmol) in THF (250 mL) was added HCl (5 M, 189.51 mL). The mixture was stirred at 20° C. for 3 hr. TLC indicated compound 6 was consumed and two new spots formed. The reaction mixture was extracted with MTBE (200 mL×3) and the MTBE phases were discarded. And then the water phase was added with 5 M NaOH (aq.) to pH=9 and extracted with DCM (200 mL×5). The combined organic layers were washed with brine (100 mL), dried over $Na_2SO_4$, filtered, and concentrated under reduced pressure to give the product. WV-CA-241 (27 g, 98.10% yield, LCMS purity: 98.24% purity) was obtained as a colorless oil. $^1$H NMR (400 MHz, CHLOROFORM-d) δ=7.83-7.76 (m, 2H), 6.98-6.91 (m, 2H), 4.00 (ddd, J=2.9, 5.0, 8.4 Hz, 1H), 3.81 (s, 3H), 3.33-3.07 (m, 5H), 2.87-2.75 (m, 2H), 1.74-1.49 (m, 4H); $^{13}$C NMR (101 MHz, CHLOROFORM-d) δ=163.79, 131.10, 130.21, 114.44, 67.66, 61.88, 60.25, 55.69, 46.85, 25.84, 25.81. LCMS $[M+H]^+$: 286.1. LCMS purity: 98.24%. SFC: dr=0.18:99.82. LCMS purity: 99.9%; SFC purity: 99.82%.

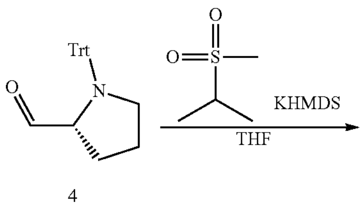

4

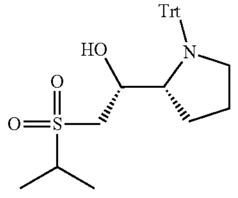

7

To a solution of 2-methylsulfonylpropane (32.21 g, 263.59 mmol) in THF (1200 mL) was added KHMDS (1 M, 263.59 mL) dropwise at −60° C., and warm to −30° C., slowly over 30 min. The mixture was then cooled to −70° C. A solution of compound 4 (60 g, 175.72 mmol) in THF (300 mL) was added dropwise at −70° C.→60° C., over 30 min. The mixture was stirred at −70° C.→60° C. for 2 hr. TLC showed compound 4 was consumed and new spot was detected. The reaction mixture was quenched with sat. aq. $NH_4Cl$ (800 mL), and then extracted with EtOAc (1 L×3). The combined organic layers were dried over anhydrous $Na_2SO_4$, filtered and concentrated. Compound 7 (95 g, crude) was obtained as a yellow oil.

Preparation of Compound WV-CA-242.

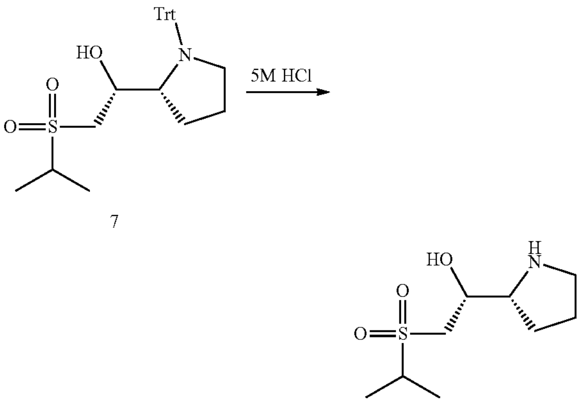

7

WV-CA-242

To a solution of compound 7 (95 g, 204.90 mmol) in THF (400 mL) was added HCl (5 M, 409.81 mL). The mixture was stirred at 0→25° C. for 2 hr. TLC indicated compound 7 was consumed and one new spot formed. The reaction mixture was washed with MTBE (300 mL×3), then the aqueous phase was basified by addition NaOH (5 M) until pH=12 at 0° C., and then extracted with DCM (300 mL×3) to give a residue dried over $Na_2SO_4$, filtered, and concentrated under reduced pressure to give a residue. Compound WV-CA-242 (45 g, 99.23% yield) was obtained as a yellow oil. LCMS $[M+H]^+$: 222.0.

Purification of Compound WV-CA-242.

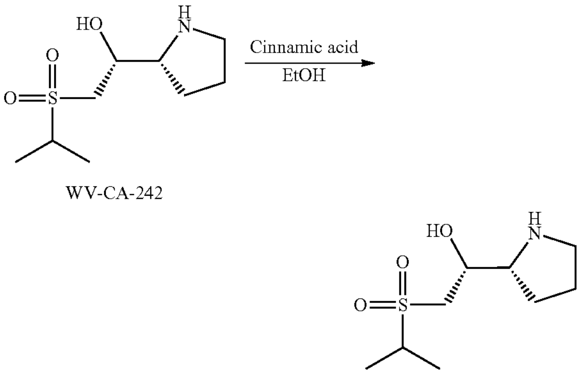

WV-CA-242

WV-CA-242

A solution of WV-CA-242 (45 g, 203.33 mmol), (E)-3-phenylprop-2-enoic acid (30.12 g, 203.33 mmol) in EtOH (450 mL) was stirred at 80° C. for 1 hr. The reaction was concentrated in vacuo. The residue was dissolved in TBME (400 mL), and then stirred at 80° C. for 15 min, and then to the mixture was added EtOH (20 mL) and MeCN(30 mL), and then the mixture was filtered, and the filtered cake was washed with TBME (30 mL×2) and then did this for 8 times. The salt (35 g, crude) was obtained as a red solid.

To a solution of salt (34 g, 92.02 mmol) in $H_2O$ (20 mL) was added aq. 5N NaOH (5 M, 36.81 mL). The mixture was stirred at 25° C. for 10 min. The reaction was extracted with DCM (100 mL×8), and then the organic phase was concentrated in vacuo. Compound WV-CA-242 (18.9 g, 91.09% yield, LCMS purity: 98.16%) was obtained as an off-white solid. $^1H$ NMR (400 MHz, CHLOROFORM-d) δ=4.13 (ddd, J=2.1, 4.6, 9.5 Hz, 1H), 3.38 (spt, J=6.9 Hz, 1H), 3.23-3.14 (m, 2H), 3.01 (dd, J=2.1, 14.4 Hz, 1H), 2.95-2.91 (m, 2H), 1.83-1.60 (m, 4H), 1.40 (dd, J=4.0, 6.8 Hz, 6H); $^{13}C$ NMR (101 MHz, CHLOROFORM-d) δ=67.45, 61.71, 53.93, 53.42, 46.80, 25.86, 5.43, 16.03, 14.17. LCMS $[M+H]^+$: 222.1. LCMS purity: 98.17%.

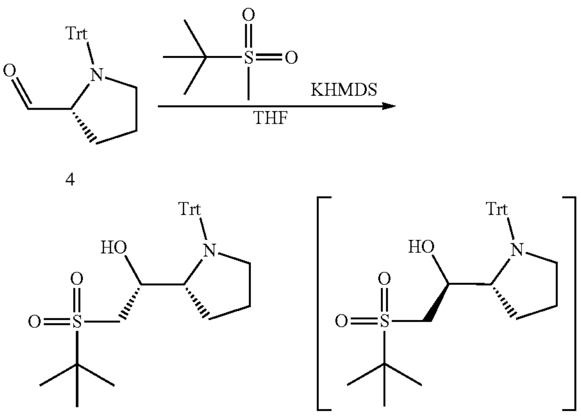

4

8

8A

To a solution 2-methyl-2-(methylsulfonyl)propane (14.96 g, 109.83 mmol) in THF (150 mL) was added KHMDS (1 M, 109.83 mL) dropwise at −70° C., and warm to −30° C. slowly over 30 min. The mixture was then cooled to −70° C. A solution of compound 4 (25.00 g, 73.22 mmol) in THF (100 mL) was added dropwise at −70° C. The mixture was stirred at −70° C. for 4 hr. TLC(Petroleum ether: Ethyl acetate=3:1 Rf=0.3) showed compound 4 was remained a little, and one major new spot with larger polarity was detected. The reaction mixture was quenched by added to the sat. $NH_4Cl$ (aq., 100 mL), and then extracted with EtOAc (100 mL×3). The combined organic layers were dried over $Na_2SO_4$, filtered, and concentrated under reduced pressure to give 30 mL solution. Then added MeOH (30 mL), concentrated under reduced pressure to give 30 mL solution, then filtered the residue and washed with MeOH (10 mL); the residue was dissolved with THF (30 mL) and MeOH (30 mL), and then concentrated under reduced pressure to give 30 mL solution. Then filtered to give a residue and washed with MeOH (10 mL). And repeat one more time to give 21 g white solid and 20 g brown oil. Compound 8 (21 g, crude) was obtained as a white solid, and Compound 8A (20 g, crude) as a brown oil. $^1H$ NMR (400 MHz, CHLOROFORM-d) δ=7.56 (d, J=7.5 Hz, 6H), 7.32-7.23 (m, 6H), 7.21-7.14 (m, 3H), 4.85-4.68 (m, 1H), 3.52-3.43 (m, 4H), 3.41 (td, J=3.8, 8.1 Hz, 1H), 3.28 (td, J=8.5, 11.9 Hz, 1H), 3.09-2.91 (m, 2H), 2.78 (dd, J=2.6, 13.6 Hz, 1H), 1.65-1.50 (m, 1H), 1.37 (s, 10H), 1.16-0.98 (m, 2H), 0.39-0.21 (m, 1H). LCMS $[M+H]^+$: 235.9.

Preparation of Compound WV-CA-243.

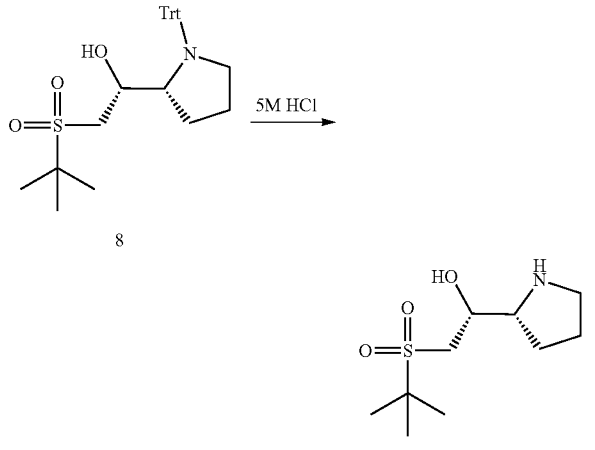

8

WV-CA-243

To a solution of compound 8 (20 g, 41.87 mmol) in THF (200 mL) was added HCl (5 M, 83.74 mL). The mixture was stirred at 15° C. for 3 hr. TLC indicated compound 8 was consumed completely and one major new spot with larger polarity was detected. The resulting mixture was washed with MTBE (100 mL×3). The combined aqueous layer was adjusted to pH 12 with 5M NaOH aq. and extracted with DCM (50 mL×3). The combined organic layers were dried over anhydrous $Na_2SO_4$, filtered and concentrated to afford a white solid. WV-CA-243 (9 g, 90.42% yield, 99% purity) was obtained as a white solid. $^1H$ NMR (400 MHz, CHLOROFORM-d) δ 4.18 (ddd, J=2.8, 5.8, 8.2 Hz, 1H), 3.29-3.21 (m, 1H), 3.19 (d, J=2.6 Hz, 1H), 3.16-3.08 (m, 1H), 2.92 (t, J=6.6 Hz, 2H), 2.74 (br s, 1H), 1.92-1.81 (m, 1H), 1.81-1.61 (m, 3H), 1.42 (s, 10H); $^{13}C$NMR (101 MHz, CHLOROFORM-d) δ=68.01, 62.00, 59.73, 49.79, 46.96, 26.77, 25.80, 23.22. LCMS $[M+H]^+$: 236.1. LCMS purity: 99.46%.

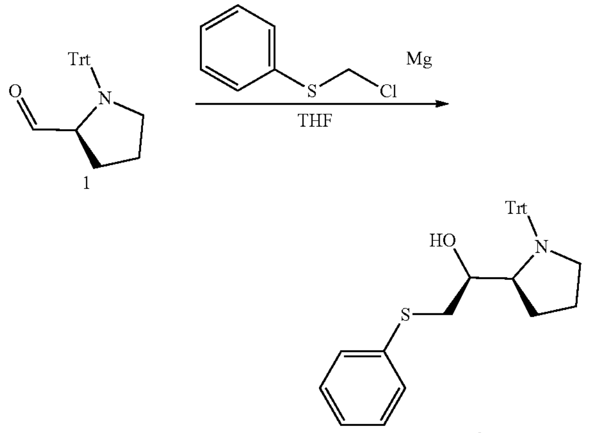

1

9

To a solution (chloromethyl)(phenyl)sulfane of Mg (17.08 g, 702.90 mmol, 4 eq.) and $I_2$ (0.50 g, 1.97 mmol, 396.83 uL, 1.12-2 eq.) in THF (100 mL) was added with 1,2-dibromoethane (1.25 g, 6.63 mmol, 0.5 mL, 3.77-2 eq.). Once the mixture turned to be colorless, chloromethylsulfanylbenzene (111.51 g, 702.90 mmol, 4 eq.) in THF (100 mL) was dropwise added at 10-20° C. for 1 hr. After addition, the mixture was stirred at 10-20° C. for 1 hr, most of Mg was consumed. And then the mixture was added in the mixture of compound 1 (60 g, 175.72 mmol, 1 eq.) in THF (600 mL) at −78° C., the mixture was stirred at −78° C.-20° C. for 4 hr. TLC(Petroleum ether: Ethyl acetate=9:1, $R_f$=0.26) indicated compound 1 was remained and two new spots formed. The reaction mixture was quenched by addition water (100 mL) at 0° C., and then extracted with EtOAc (100 mL×3). The combined organic layers were dried over $Na_2SO_4$, filtered, and concentrated under reduced pressure to give a residue. The residue was purified by column chromatography ($SiO_2$, Petroleum ether/Ethyl acetate=200/1 to 10:1) 2 times. Compound 9 (80 g, 171.80 mmol, 97.77% yield) was obtained as a white solid. $^1H$ NMR (400 MHz, CHLOROFORM-d) δ=7.52 (d, J=7.5 Hz, 6H), 7.31-7.09 (m, 14H), 4.24-4.14 (m, 1H), 3.54-3.44 (m, 1H), 3.30-3.18 (m, 1H), 3.08-2.96 (m, 1H), 2.91 (s, 1H), 2.80 (d, J=7.0 Hz, 2H), 1.69-1.53 (m, 1H), 1.39-1.30 (m, 1H), 1.15-1.01 (m, 1H), 0.30-0.12 (m, 1H).

Preparation of Compound WV-CA-244.

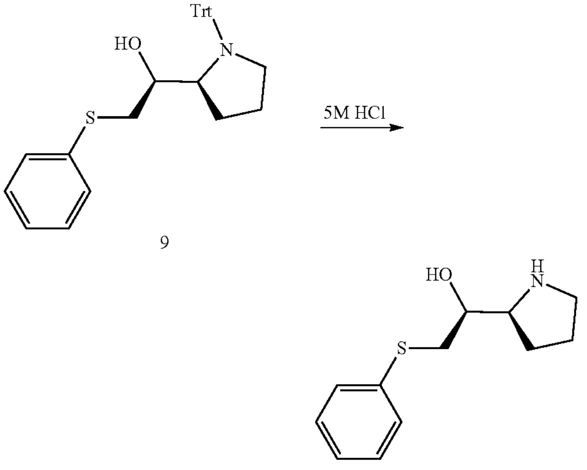

9

WV-CA-244

To a solution of compound 9 (80 g, 171.80 mmol, 1 eq.) in EtOAc (350 mL) was added HCl (5 M, 266.30 mL, 7.75 eq.). The mixture was stirred at 15° C. for 18 hr. TLC (Petroleum ether: Ethyl acetate=9:1, $R_f$=0.01) indicated compound 9 was consumed and new spots formed. The reaction mixture was extracted with MTBE (200 mL×3) and the MTBE phases were discarded. And then the water phase was added with 2 M NaOH (aq.) to pH=9 and extracted with EtOAc (200 mL×5). The combined organic layers were washed with brine (200 mL), dried over $Na_2SO_4$, filtered, and concentrated under reduced pressure to give the crude product. To the crude product was added EtOAc (100 mL) at 70° C. The mixture was stirred at 70° C.→20° C. for 1 hr. The reaction mixture was filtered, and the filter cake was dried to give the product. WV-CA-244 (31.9 g, 142.84 mmol, 94.66% yield) was obtained as a white solid. $^1H$ NMR (400 MHz, CHLOROFORM-d) δ=7.37 (d, J=7.5 Hz, 2H), 7.26 (t, J=7.7 Hz, 2H), 7.20-7.12 (m, 1H), 3.74-3.65 (m, 1H), 3.24-3.15 (m, 1H), 3.13-3.00 (m, 2H), 3.00-2.21 (m, 4H), 1.77-1.59 (m, 4H); $^{13}C$ NMR (101 MHz, CHLO- ROFORM-d) δ=136.04, 129.35, 128.95, 126.15, 70.75, 61.64, 46.86, 38.54, 25.86, 25.17. LCMS $[M+H]^+$: 224.1. LCMS purity: 99.57% .

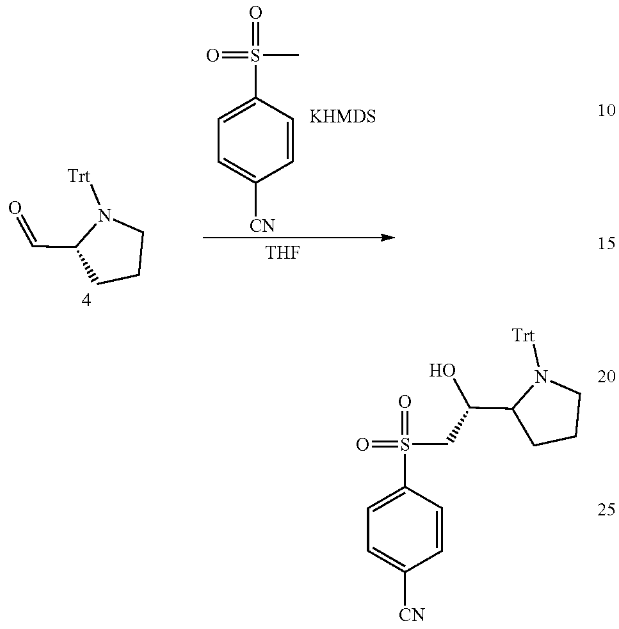

10

To a solution of 4-methylsulfonylbenzonitrile (47.76 g, 263.59 mmol, 1.5 eq.) in THE (800 mL) was added KHMDS (1 M, 263.59 mL, 1.5 eq.) at −70° C.→−40° C., 0.5 hr later, added compound 4 (60.00 g, 175.72 mmol, 1 eq.) in THF (400 mL) at −70° C. The mixture was stirred at −70° C. for 2.5 hr. TLC(Petroleum ether: Ethyl acetate=1:1, $R_f$=0.4) indicated compound 4 was consumed and one new spot formed. The reaction mixture was quenched by addition sat. $NH_4Cl$ (20 mL) at 0° C. and extracted with DCM (600 mL×3). Dried over $Na_2SO_4$, filtered, and concentrated under reduced pressure to give a residue. The residue was washed with MeOH (500 mL×5) to get compound 10 (28 g, 53.57 mmol, 30.49% yield) as a yellow solid. $^1$H NMR (400 MHz, CHLOROFORM-d) δ −7.84-7.74 (m, 2H), 7.73-7.65 (m, 2H), 7.32 (d, J=7.2 Hz, 6H), 7.15-6.99 (m, 9H), 4.20 (td, J=2.9, 5.6 Hz, 1H), 3.22 (ddd, J=3.1, 5.7, 8.3 Hz, 1H), 3.12-3.03 (m, 2H), 3.02-2.92 (m, 1H), 2.90-2.77 (m, 2H), 1.39-1.26 (m, 1H), 1.20-0.93 (m, 2H), 0.13-0.11 (m, 1H).

Preparation of Compound WV-CA-238.

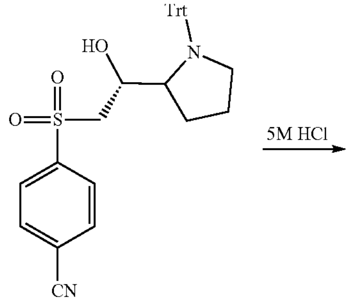

-continued

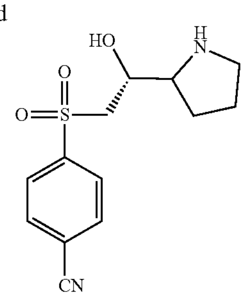

WV-CA-238

To a solution of compound 10 (28 g, 53.57 mmol, 1 eq.) in DCM (196 mL) was added TFA (12.22 g, 107.15 mmol, 7.93 mL, 2 eq.). The mixture was stirred at 0° C. for 3 hr. TLC and LCMS indicated compound 10 was consumed and two new spots formed. The reaction mixture was washed with MTBE (100 mL×3), then the aqueous phase was basified by addition NaOH (5 M) until pH=12 at 0° C., and then extracted with DCM (50 mL×3) to give a residue dried over $Na_2SO_4$, filtered, and concentrated under reduced pressure to give a residue. Compound WV-CA-238 (9.5 g, 33.42 mmol, 62.38% yield, 98.62% purity) was obtained as a yellow solid. $^1$H NMR (400 MHz, CHLOROFORM-d) δ=8.09 (d, J=8.4 Hz, 2H), 7.87 (d, J=8.4 Hz, 2H), 4.06 (ddd, J=2.9, 4.9, 8.3 Hz, 1H), 3.38-3.16 (m, 3H), 2.96-2.79 (m, 2H), 1.81-1.64 (m, 3H), 1.61-1.45 (m, 1H). $^{13}$C NMR (101 MHz, CHLOROFORM-d) δ=144.05, 132.88, 128.93, 117.48, 117.15, 67.63, 61.50, 60.09, 46.83, 25.88, 25.55. LCMS $[M+H]^+$: 281.1. LCMS purity: 98.62%. SFC: dr=99.75:0.25.

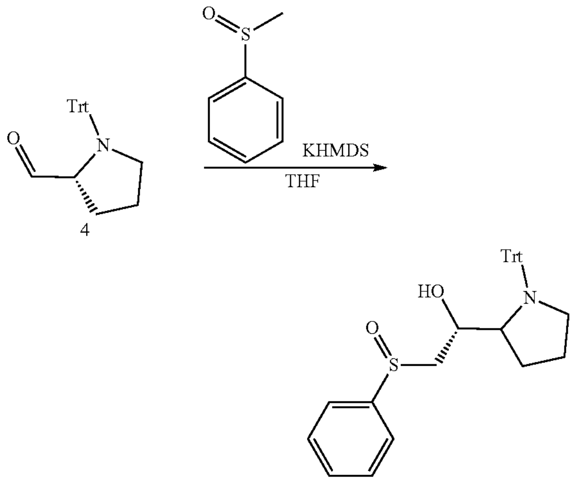

11

To a solution of methylsulfinylbenzene (25 g, 178.31 mmol, 1.5 eq.) in THF (400 mL) was added KHMDS (1 M, 178.31 mL, 1.5 eq.) dropwise at −60° C., and warm to −30° C. slowly over 30 min. The mixture was then cooled to −70° C. A solution of compound 4 (40.59 g, 118.88 mmol, 1 eq.) in THF (100 mL) was added dropwise at −70° C. The mixture was stirred at −70° C.→−50° C. for 2 hr. TLC (Petroleum ether: Ethyl acetate=3:1) showed compound 4 was remained. The reaction mixture was cooled to −70° C., additionally added KHMDS (1M, 40 mL), and stirred at −70° C.→~−40° C. for 2 hr. TLC(Petroleum ether: Ethyl acetate=3:1) showed compound 4 was little remained. The reaction mixture was quenched with sat. $NH_4Cl$ (aq. 300 mL), and the separated aqueous layer was extracted with EtOAc (200 mL×3). The combined organic layers were dried over anhydrous $Na_2SO_4$, filtered and concentrated to afford a residue as a yellow gum, which was crystallized in MeOH (100 mL), filtered and rinsed with MeOH (50 mL) to give an off-white solid (17 g), and the filtrate was concentrated to afford a yellow gum (50 g). The white solid product (17 g) was re-dissolved in THF (150 mL), and added MeOH (80 mL), and the mixture was concentrated to remove THE, filtered and dried to give an off-white solid, which was re-dissolved in THF (150 mL), and added MeOH (80 mL), and the mixture was concentrated to remove THE, filtered and dried to give the product as an off-white solid (13 g). The filtrate was concentrated to give 4 g crude. No further purification. The product compound 11 (13 g, 26.99 mmol, 22.70% yield) was obtained as an off-white solid. $^1H$ NMR (400 MHz, CHLOROFORM-d) δ=7.62-7.56 (m, 2H), 7.55-7.52 (m, 3H), 7.51-7.45 (m, 6H), 7.25-7.12 (m, 9H), 4.60 (td, J=2.4, 10.1 Hz, 1H), 3.72 (s, 1H), 3.27-3.13 (m, 2H), 3.04-2.84 (m, 2H), 2.46 (dd, J=2.2, 13.5 Hz, 1H), 1.71-1.53 (m, 1H), 1.42-1.28 (m, 1H), 1.07-0.90 (m, 1H), 0.37-0.21 (m, 1H).

Preparation of Compound WV-CA-247.

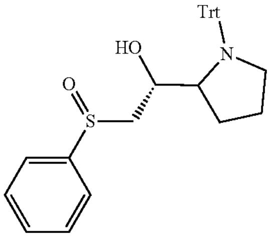

11

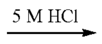

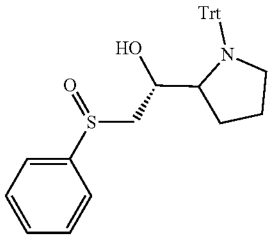

WV-CA-247

To a solution of compound 11 (13 g, 26.99 mmol, 1 eq.) in THF (45 mL) was added HCl (5 M, 52.00 mL, 9.63 eq.) aqueous. The mixture was stirred at 20° C. for 2 hr. TLC(Petroleum ether: Ethyl acetate=3:1) showed the reaction was completed. The resulting mixture was washed with MTBE (60 mL×3). The combined aqueous layer was adjusted to pH 12 with 5 M NaOH aq. and extracted with DCM (80 mL×3). The combined organic layers were dried over anhydrous $Na_2SO_4$, filtered, and concentrated to afford a white solid (5.8 g). Without further purification. The compound WV-CA-247 (5.8 g, 24.17 mmol, 89.55% yield, 99.74% purity) was obtained as a white solid. $^1H$ NMR (400 MHz, CHLOROFORM-d) δ=7.67-7.60 (m, 2H), 7.55-7.42 (m, 3H), 4.17 (ddd, J=2.6, 4.2, 9.9 Hz, 1H), 3.74-3.23 (brs, 2H), 3.13 (dt, J=4.3, 7.3 Hz, 1H), 2.96-2.74 (m, 4H), 1.81-1.52 (m, 4H). $^{13}C$ NMR (101 MHz, CHLOROFORM-d) δ=143.99, 130.93, 129.32, 123.92, 66.97, 62.23, 61.58, 46.86, 25.88, 25.3. LCMS $[M+H]^+$: 240. LCMS purity: 99.74%. SFC: dr=99.48:0.52.

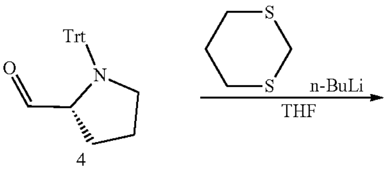

4

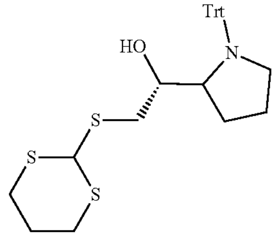

12

To a solution of 1,3-dithiane (13.21 g, 109.83 mmol) in THF (250 mL) was added n-BuLi (2.5 M, 29.29 mL) at −20° C., 0.5 hr later added compound 1 (25 g, 73.22 mmol) in THF (250 mL) at −70° C. The mixture was stirred at −70→20° C. for 16 hr. TLC indicated compound 4 was remained, and one new spot was detected. The reaction mixture was quenched by sat. $NH_4Cl$ (200 mL), and then extracted with EtOAc (200 mL×5). The combined organic layers were dried over $Na_2SO_4$, filtered and concentrated under reduced pressure to give a residue. The residue was purified by MPLC ($SiO_2$, Petroleum ether/Ethyl acetate=50/1 to 10/1, 5% TEA) 2 times. Compound 12 (16 g, 47.33% yield) was obtained as a yellow oil. $^1H$ NMR (400 MHz, CHLOROFORM-d) δ=7.59 (d, J=7.0 Hz, 5H), 7.29-7.25 (m, 6H), 7.20-7.14 (m, 3H), 4.39 (dd, J=2.4, 10.3 Hz, 1H), 4.03 (ddd, J=2.4, 5.6, 8.2 Hz, 1H), 3.38 (d, J=10.1 Hz, 1H), 3.28 (ddd, J=7.0, 10.1, 12.3 Hz, 1H), 3.07-2.99 (m, 1H), 2.93-2.85 (m, 1H), 2.63-2.54 (m, 1H), 2.34-2.18 (m, 2H), 1.97-1.82 (m, 2H), 1.59-1.45 (m, 1H), 1.22-1.11 (m, 1H), 0.22-0.06 (m, 1H).

Preparation of Compound WV-CA-246.

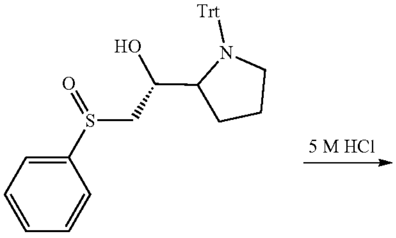

12

-continued

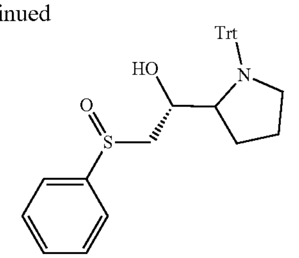

WV-CA-246

To a solution of compound 12 (16 g, 34.66 mmol) in EtOAc (80 mL) was added HCl (5 M, 69.31 mL). The mixture was stirred at 15° C. for 16 hr. TLC indicated compound 12 was consumed completely and new spots formed. The reaction mixture was extracted with TBME (100 mL×3) and the TBME phases were discarded. And then the water phase was added with 5 M NaOH (aq.) to pH=9 and extracted with DCM (100 mL×5). The combined organic layers were washed with brine (100 mL), dried over $Na_2SO_4$, filtered and concentrated under reduced pressure to give the crude product. The residue was purified by prep-HPLC(column: Phenomenex luna C18 250×50 mm×10 um; mobile phase: [water (0.1% TFA)-ACN]; B %: 0%-15%, 20 min and column: Phenomenex luna (2) C18 250×50×10 um; mobile phase: [water(0.1% TFA)-ACN]; B %: 0%-12%,20 min). WV-CA-246 (4.2 g, 55.25% yield) was obtained as a white solid. $^1$H NMR (400 MHz, CHLOROFORM-d) δ=4.13 (d, J=7.2 Hz, 1H), 3.83 (dd, J=5.1, 7.2 Hz, 1H), 3.49 (dt, J=5.1, 7.3 Hz, 1H), 3.13-2.76 (m, 6H), 2.60 (br s, 2H), 2.20-2.05 (m, 1H), 2.04-1.90 (m, 1H), 1.89-1.62 (m, 4H). $^{13}$C NMR (101 MHz, CHLOROFORM-d) δ=73.76, 59.94, 50.42, 46.83, 28.95, 28.45, 25.87, 25.32. HPLC purity: 97.75%. LCMS $[M+H]^+$: 220.1. SFC: dr=0.22:99.78.

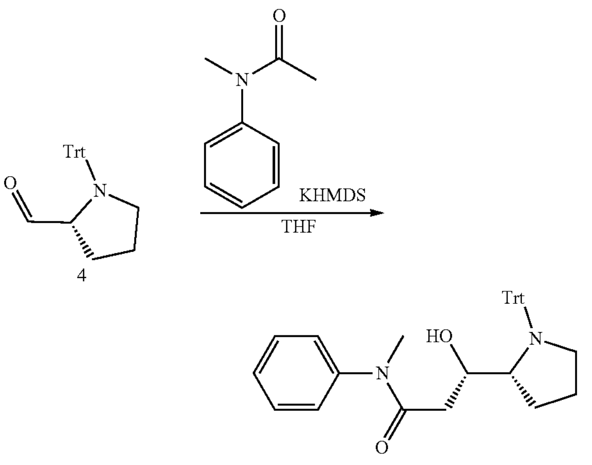

4

13

To a solution of N-methyl-N-phenyl-acetamide (18.5 g, 124.00 mmol) in THF (250 mL) was added KHMDS (1 M, 124.00 mL) dropwise at −70° C., and to warm to −30° C. slowly over 30 min. The mixture was then cooled to −70° C. A solution of compound 4 (28.23 g, 82.67 mmol) in THF (150 mL) was added dropwise at −70° C. The mixture was stirred at −70° C.~−50° C. for 3 hr. TLC showed the reaction was almost completed. The reaction mixture was quenched with sat. $NH_4Cl$ (aq., 30 mL), and extracted with EtOAc (25 mL×3). The combined organic layers were dried over anhydrous $Na_2SO_4$, filtered and concentrated to afford a residue as yellow gum. The crude was purified by column chromatography on silica gel (Petroleum ether: Ethyl acetate=10:1, 3:1, 1:1, 1:2, 5% TEA). Compound 13 (38 g, 93.7% yield) was obtained as a white solid. $^1$H NMR (400 MHz, CHLOROFORM-d) δ=7.53 (br d, J=7.5 Hz, 6H), 7.44-7.31 (m, 4H), 7.26-7.09 (m, 12H), 4.46-4.40 (m, 1H), 3.90 (br s, 1H), 3.31-3.19 (m, 4H), 3.15-3.07 (m, 1H), 3.00-2.91 (m, 1H), 1.48-1.26 (m, 2H), 0.86-0.74 (m, 1H), 0.33-0.19 (m, 1H).

Preparation of Compound WV-CA-248.

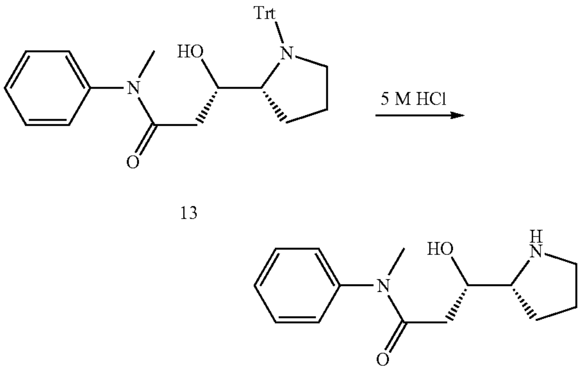

13

WV-CA-248

To a solution of compound 13 (38 g, 77.45 mmol) in THF (125 mL) was added HCl (5 M, 152.00 mL) aqueous. The mixture was stirred at 20° C. for 2 hr. TLC showed the reaction was completed. The resulting mixture was washed with MTBE (80 mL×3), EtOAc (100 mL×3), and DCM (100 mL×2) in turn. The combined aqueous layer was adjusted to pH=12 with 5M NaOH aq. and extracted with DCM (120 mL×3). The combined organic layers were dried over anhydrous $Na_2SO_4$, filtered and concentrated to afford a yellow gum. The crude of WV-CA-248 (15.2 g, 73.26% yield, 92.7% purity) appears a yellow gum. To a solution of WV-CA-248 (14.5 g, 58.39 mmol) in EtOH (150 mL) was added (E)-3-phenylprop-2-enoic acid (8.65 g, 58.39 mmol). The mixture was stirred at 80° C. for 1 hr. The mixture was concentrated in vacuo. The residue was dissolved in TBME (50 mL), and then the mixture was added MeCN (3 mL), the mixture was turned clear, then the solution was standed, and then solid was appeared, and the mixture was filtered, and the filtered cake was washed with TMBE (10 mL×2), and the filtered cake was desired compound. The residue (6.5 g, crude) was obtained as a yellow solid. The residue was dissolved in $H_2O$ (10 mL) was added aq. NaOH (5 M, 6.56 mL, 2 eq.). The mixture was stirred at 25° C. for 10 min. The pH of the mixture was 13. The solution was extracted with DCM (40 mL×6), and the organic phase was concentrated in vacuo. Compound WV-CA-248 (4 g, 91.74% yield, 93.4% purity) was obtained as a brown oil. $^1$H NMR (400 MHz, CHLOROFORM-d) δ=7.49-7.31 (m, 3H), 7.21 (br d, J=7.3 Hz, 2H), 4.00 (td, J=4.3, 8.6 Hz, 1H), 3.48 (br s, 2H), 3.28 (s, 3H), 3.10-2.98 (m, 1H), 2.97-2.80 (m, 2H), 2.36-2.17 (m, 2H), 1.79-1.47 (m, 3H), 1.79-1.47 (m, 1H). $^{13}$C NMR (101 MHz, CHLOROFORM-d) δ=172.38, 143.42, 129.89, 128.04, 127.27, 69.90, 62.29, 46.77, 37.98, 37.23, 25.99, 25.65. LCMS $[M+H]^+$: 249.1. LCMS purity: 93.35%. SFC: SFC purity de=94.26%.

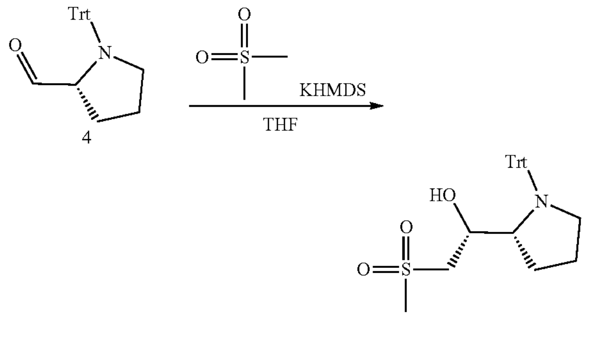

4

14

To a solution of methylsulfonylmethane (8.27 g, 87.86 mmol) in THF (150 mL) was added KHMDS (1 M, 87.86 mL) at −70° C.~−40° C., 0.5 hr later added compound 1 (20 g, 58.57 mmol) in THF (100 mL). The mixture was stirred at −70° C. for 1.5 hr. TLC indicated compound 4 was remained a little and one new spot formed. The reaction mixture was quenched by addition sat. $NH_4Cl$ (aq. 200 mL) at 0° C., and then diluted with EtOAc (200 mL) and extracted with EtOAc (200 mL×3). Dried over $Na_2SO_4$, filtered and concentrated under reduced pressure to give a residue. The residue was purified by column chromatography ($SiO_2$, Petroleum ether/Ethyl acetate=1/0→0:1). Compound 14 (12 g, crude, HNMR showed cis/trans isomer ratio ~10:1) was obtained as a yellow oil. $^1H$ NMR (400 MHz, CHLOROFORM-d) δ=7.58-7.47 (m, 7H), 7.26-7.22 (m, 5H), 7.20-7.13 (m, 3H), 4.51-4.46 (m, 1H), 3.99-3.88 (m, 1H), 3.48-3.39 (m, 1H), 3.21-2.97 (m, 4H), 2.96-2.91 (m, 3H), 2.68 (br d, J=14.6 Hz, 1H), 1.57-1.43 (m, 1H), 1.36-1.26 (m, 1H), 1.20-1.10 (m, 1H), 0.57-0.44 (m, 1H), 0.25-0.04 (m, 1H).

Preparation of WV-CA-252.

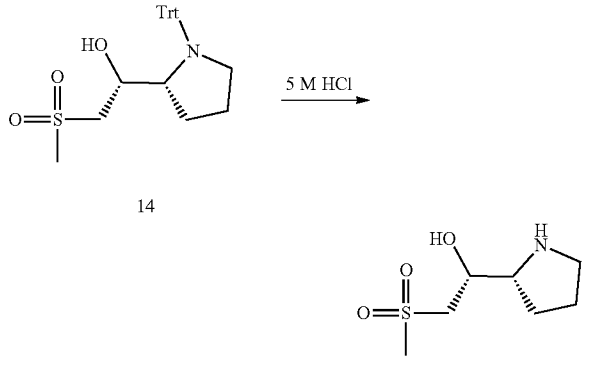

14

WV-CA-252

To a solution of compound 14 (18 g, 41.32 mmol) in THF (82 mL) was added HCl (5 M, 82.65 mL). The mixture was stirred at 25° C. for 3 hr. TLC indicated compound 14 was consumed and two new spots formed. The reaction mixture was washed with MTBE (50 mL×3), then the aqueous phase was basified by addition NaOH (5M) until pH=12 at 0° C., and then extracted with DCM (50 mL×6) to give a residue dried over $Na_2SO_4$, filtered and concentrated under reduced pressure to give a residue. The crude compound WV-CA-252 (6.5 g, 81.4% yield) was obtained as a yellow solid. $^1H$ NMR (400 MHz, CHLOROFORM-d) δ=4.13 (ddd, J=1.8, 4.0, 9.7 Hz, 1H), 3.23 (dt, J=4.2, 7.4 Hz, 1H), 3.18-3.09 (m, 1H), 3.05 (s, 4H), 3.00-2.90 (m, 3H), 1.95-1.68 (m, 4H), 1.67-1.48 (m, 1H). LCMS $[M+H]^+$: 194.0.

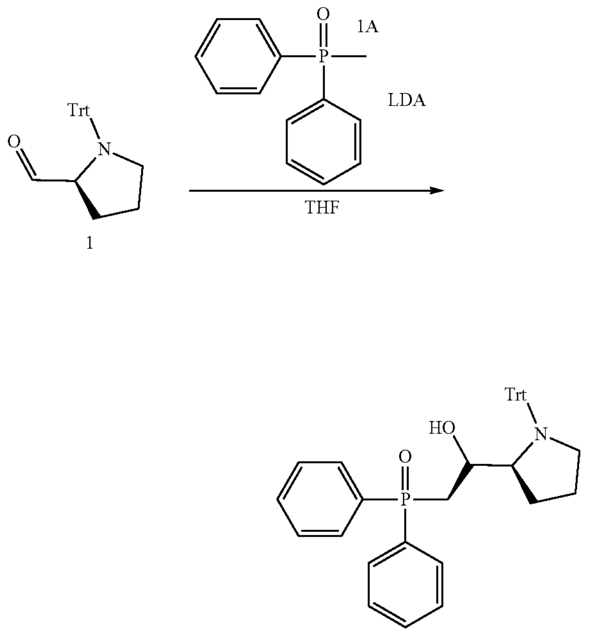

1A

1

15

A mixture of compound 1A (52.24 g, 241.62 mmol) in THF (500 mL) was degassed and purged with $N_2$ for 3 times, and then the mixture was cooled to −70° C., and then to the mixture was added LDA (2 M, 112.76 mL). The mixture was stirred at −40° C. for 30 min, and then to the mixture was added compound 1 (55 g, 161.08 mmol) in THF (250 mL) at −70° C. The mixture was stirred at −70° C. for 2 hr under $N_2$ atmosphere. TLC indicated compound 1 was consumed completely and one new spot formed. The reaction was clean according to TLC. The reaction was quenched by sat. aq. $NH_4Cl$ (300 mL) and then extracted with EtOAc (100 mL×3). The combined organic phase was washed with brine (100 mL), dried over anhydrous $Na_2SO_4$, filtered and concentrated in vacuo. The residue was dissolved in MeOH (300 mL) and filtered; the filtered cake was the desired product. Compound 2 (53 g, crude) was obtained as a white solid.

Preparation of Compound WV-CA-245.

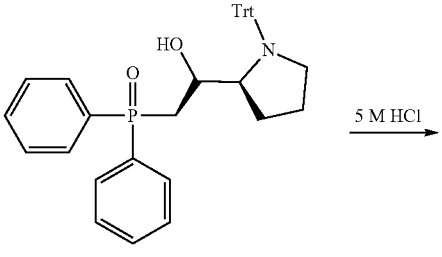

15

-continued

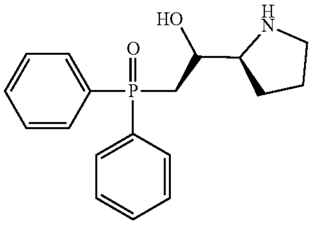

WV-CA-245

To a solution of compound 15 (72 g, 129.11 mmol) in THF (400 mL) was added HCl (5 M, 258.22 mL). The mixture was stirred at 25° C. for 1 hr. LC-MS showed compound 15 was consumed completely and one main peak with desired mass was detected. The reaction was extracted with TBME (100 mL×3), added aq. 5 N NaOH to pH=13, and then extracted with DCM (50 mL×3), and the combined organic phase was concentrated in vacuo. WV-CA-245 (38 g, 92.82% yield, 99.5% purity) was obtained as a white solid. $^{1}$H NMR (400 MHz, CHLOROFORM-d) δ=7.81-7.71 (m, 4H), 7.58-7.44 (m, 6H), 4.01-3.92 (m, 1H), 3.16-3.09 (m, 1H), 2.92-2.79 (m, 2H), 2.63-2.44 (m, 2H), 1.82-1.60 (m, 4H). $^{13}$C NMR (101 MHz, CHLOROFORM-d) δ=133.88, 132.89, 132.86, 131.95, 131.88, 130.73, 128.74, 68.98, 68.94, 63.79, 63.67, 47.03, 34.21, 33.49, 26.37, 25.88. LCMS $[M+H]^+$: 316.1. LCMS purity: 99.45%. SFC: SFC purity de=99.5%.

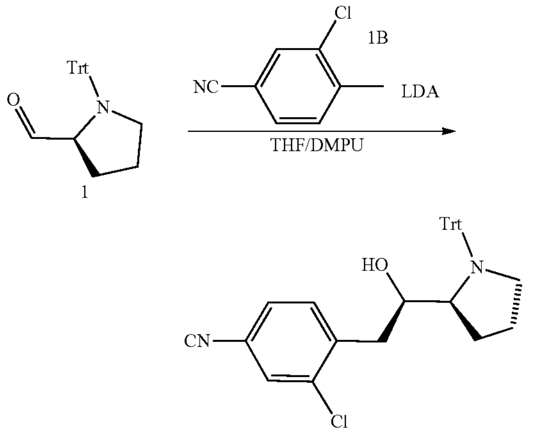

16

To a solution of compound 1B(13.32 g, 87.86 mmol) in THF (200 mL) was added KHMDS (1 M, 82.00 mL) at −70° C. under $N_2$, and then the mixture was stirred at −70° C. for 10 min, and then to the mixture was added compound 1 (20 g, 58.57 mmol) in THF (100 mL), the reaction was stirred at −70° C. for 30 min. TLC indicated compound 1 was consumed completely and one new spot formed. The reaction was clean according to TLC. The reaction mixture was quenched with sat. aq. $NH_4Cl$ (100 mL), and then extracted with EtOAc (50 mL×3). The combined organic layers were dried over anhydrous $Na_2SO_4$, filtered and concentrated. The residue was purified by column chromatography ($SiO_2$, Petroleum ether/Ethyl acetate=50:1, 20:1, 10:1, 1:1, 0:1). Compound 16 (12 g, crude) was obtained as a yellow solid.

Preparation of Compound WV-CA-249.

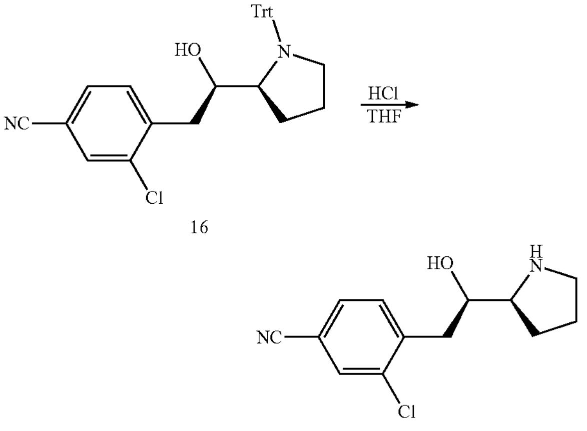

WV-CA-249

To a solution of compound 16 (12 g, 24.34 mmol) in THF (50 mL) was added aq. HCl (5 M, 48.68 mL). The mixture was stirred at 25° C. for 30 min. TLC indicated compound 16 was consumed completely and one new spot formed. The reaction was clean according to TLC. The reaction was extracted with TBME (100 mL×3), and then to the mixture was added 5N aq. NaOH to pH=13, extracted with DCM (100 mL×3), and then the organic phase was concentrated in vacuo. WV-CA-249 (5.36 g, 87.84% yield, 100.00% purity) was obtained as a yellow solid. $^{1}$H NMR (400 MHz, CHLOROFORM-d) δ=7.64 (s, 1H), 7.49 (d, J=0.9 Hz, 2H), 3.88 (td, J=3.6, 9.4 Hz, 1H), 3.24-3.16 (m, 1H), 3.02-2.89 (m, 3H), 2.78 (dd, J=9.4, 14.0 Hz, 1H), 1.84-1.70 (m, 4H). $^{13}$C NMR (101 MHz, CHLOROFORM-d) δ=143.11, 134.94, 132.60, 132.33, 130.12, 117.63, 111.52, 70.86, 62.02, 46.76, 37.90, 25.88, 24.21. LCMS $[M+H]^+$: 251.0. LCMS purity: 100.000%. SFC: SFC purity de=98.28%.

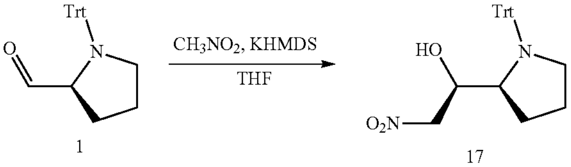

1

17

To a solution of nitromethane (30.59 g, 501.15 mmol) in THF (300 mL) was added KHMDS (1 M, 263.59 mL) at 20-25° C. and stirred for 1 hr. Compound 1 (30 g, 87.86 mmol) in THF (90 mL) was added to the mixture at 20-25° C. and stirred for 0.5 hr. TLC showed that the starting material was consumed mostly, and desired product was formed. The mixture was quenched by saturated aq. $NH_4Cl$ (300 mL) and extracted with ethyl acetate (100 mL×3). The organic phase was washed by saturated aq. NaCl (100 mL×3) and dried with anhydrous $Na_2SO_4$, then concentrated under reduced pressure to remove the solvent. The crude product was purified by MPLC ($SiO_2$, Ethyl acetate/Petroleum ether=0%→20%) to obtain compound 17 (26.55 g, 75.08% yield) as yellow solid. The product was detected by $^{1}$H NMR. $^{1}$H NMR (400 MHz, CHLOROFORM-d) δ=7.54-7.44 (m, 6H), 7.28-7.21 (m, 6H), 7.20-7.14 (m, 3H), 4.64 (td, J=3.0, 9.4 Hz, 1H), 4.53-4.06 (m, 3H), 3.60-3.40 (m, 1H), 3.24-2.96 (m, 3H), 1.52-1.41 (m, 1H), 1.40-1.28 (m, 1H), 1.17-0.94 (m, 1H), 0.67-0.50 (m, 1H), 0.23 (quin d, J=8.8, 11.6 Hz, 1H).

Preparation of Compound WV-CA-250.

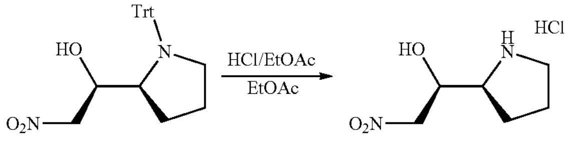

2

WV-CA-250

To a solution of compound 17 (7.5 g, 18.63 mmol) in EtOAc (35 mL) was added HCl/EtOAc (4 M, 50 mL) at 20-25° C. and stirred for 1 hr. TLC showed that the starting material was consumed completely. Poured the supernatant liquid of the mixture, the yellow gum on the bottle wall was concentrated under reduced pressure to remove the solvent. WV-CA-250 (2.10 g, 56.70% yield, 98.927% purity, HCl salt) was obtained as yellow gum. The product was detected by $^1H$ NMR, $^{13}C$ NMR and LCMS. $^1H$ NMR (400 MHz, DMSO-$d_6$) δ=9.89-9.54 (m, 1H), 9.03-8.75 (m, 1H), 8.94 (br s, 1H), 4.97-4.78 (m, 1H), 4.65-4.35 (m, 2H), 3.70-3.41 (m, 4H), 3.22-3.03 (m, 2H), 2.06-1.65 (m, 4H). $^{13}C$ NMR (101 MHz, DMSO-$d_6$) δ=79.42, 79.00, 67.89, 66.82, 61.53, 60.77, 45.44, 45.25, 26.93, 24.57, 23.95, 23.81. LCMS $[M+H]^+$: 161.1, purity: 98.92%.

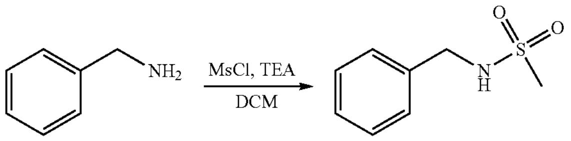

18A

To a solution of compound benzylamine (30 g, 279.97 mmol) and TEA (56.66 g, 559.95 mmol) in DCM (60 mL) was added MsCl (38.49 g, 335.97 mmol) in DCM (30 mL) at 0° C. The mixture was stirred at 0° C. for 2 hr. LC-MS showed compound 18A was consumed and many new peaks were detected. The reaction mixture was washed with HCl (1 M, 50 mL×3) and sat. $NaHCO_3$(aq. 50 mL x 3). The organic layer was washed with brine (50 mL), dried over $Na_2SO_4$, filtered and concentrated under reduced pressure to give a residue. TLC showed one main spot. The residue was purified by MPLC ($SiO_2$, Petroleum ether/Ethyl acetate=5/1 to 1:1). Compound 18A (35 g, 67.49% yield) was obtained as a light-yellow solid. $^1H$ NMR (400 MHz, CHLOROFORM-d) δ=7.44-7.24 (m, 5H), 4.82 (br s, 1H), 4.31 (d, J=6.2 Hz, 2H), 2.85 (s, 3H).

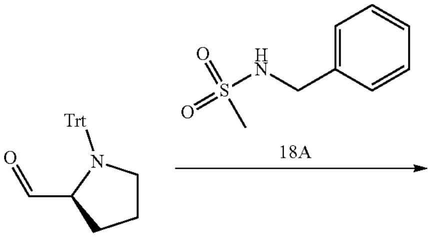

1

-continued

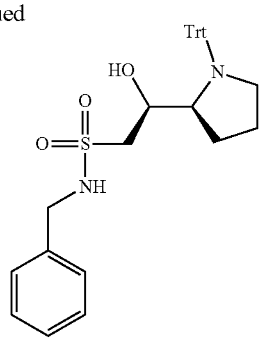

18

To a solution of compound 18A (16.28 g, 87.86 mmol) in THF (60 mL) was added with LDA (2 M, 87.86 mL) at 0° C. The mixture was stirred at 0-25° C. for 0.5 hr. And then compound 1 (15 g, 43.93 mmol) in THF (60 mL) was added to above solution at −70° C. The mixture was stirred at −70-25° C. for 4 hr. TLC indicated compound 1 was consumed completely and many new spots formed. The reaction mixture was added with sat. $NH_4Cl$ (aq. 50 mL) and extracted with EtOAc (100 mL×3). The combined organic layers were dried over $Na_2SO_4$, filtered and concentrated under reduced pressure to give a residue. The residue was purified by prep-TLC($SiO_2$, Petroleum ether/Ethyl acetate=5/1, 2% TEA). Compound 18 (22 g, 95.08% yield) was obtained as a yellow oil.

Preparation of Compound WV-CA-255.

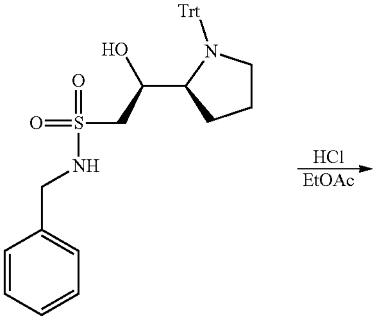

18

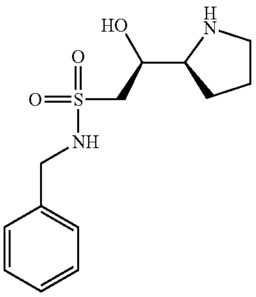

WV-CA-255

To a solution of compound 18 (22 g, 41.77 mmol) in EtOAc (15 mL) was added HCl (4 M in ethyl acetate, 31.33 mL) at 0° C. The mixture was stirred at 0-25° C. for 2 hr. And solid appeared in the reaction mixture. TLC indicated compound 18 was consumed completely and many new spots formed. The reaction mixture was filtered. The filter cake was dissolved in water (10 mL), washed with MTBE (40 mL×3). The water phase was added with $Na_2CO_3$ (powder) to pH=8~9 and extracted with DCM (50 mL×5). The combined organic layers were dried over $Na_2SO_4$, filtered and concentrated under reduced pressure to give a residue. WV-CA-255 (11 g, 92.60% yield) was obtained as a brown solid. $^1$H NMR (400 MHz, CHLOROFORM-d) δ=7.46-7.25 (m, 5H), 4.65-3.72 (m, 5H), 3.14-3.01 (m, 3H), 2.95-2.77 (m, 2H), 1.89-1.34 (m, 4H). $^{13}$C NMR (101 MHz, CHLOROFORM-d) δ=136.99, 128.71, 128.62, 128.19, 128.09, 127.85, 69.12, 67.58, 61.98, 61.70, 55.55, 55.36, 47.36, 47.30, 46.60, 46.28, 28.05, 26.16, 25.71, 24.92. LCMS [M+H]$^+$: 285.0, LCMS purity: 99.8%. SFC: dr (trans/cis)=32.36:67.64.

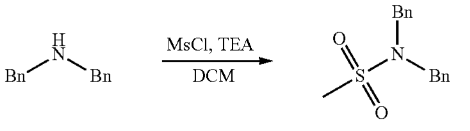

19A

To a solution of compound dibenzylamine (30 g, 152.07 mmol) in DCM (250 mL) was added TEA (15.39 g, 152.07 mmol). The mixture was cooled to 0° C., and to the mixture was added MsCl (17.42 g, 152.07 mmol) in DCM (50 mL), and then the mixture was stirred at 25° C. for 12 hours. LC-MS showed desired mass was detected. The reaction was quenched by $H_2O$ (100 mL) and the organic phase was extracted with $H_2O$ (100 mL×3), the organic phase was dried by $Na_2SO_4$, and then concentrated in vacuum. No need further purification. Compound 19A (39 g, crude) was obtained as a white solid. $^1$H NMR (400 MHz, CHLOROFORM-d) δ=7.41-7.29 (m, 9H), 4.36 (s, 4H), 2.82-2.75 (m, 3H). LCMS [M+H]$^+$: 298.0, purity: 86.6%.

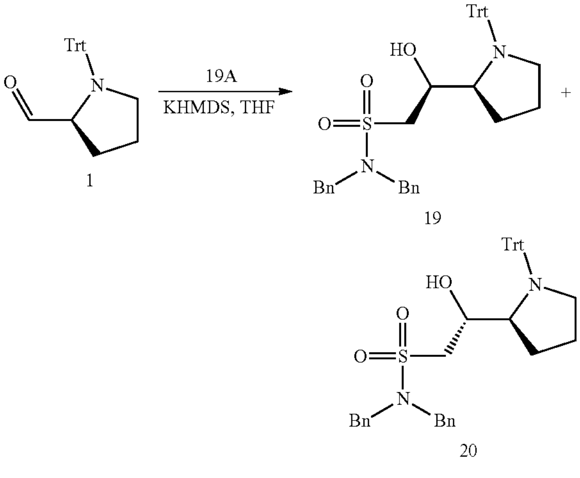

1

19

+

20

To a solution of compound 19A (19.36 g, 70.29 mmol) in THF (200 mL) was added KHMDS (1 M, 76.15 mL) dropwise at −78° C. to −70° C. under $N_2$. The mixture was warmed to −40° C. and stirred for 0.5 hr, then cooled to −78° C. To the mixture was added compound 1 (20 g, 58.57 mmol) in THF (100 mL) at −78° C. to −70° C. and stirred for 1 hr under $N_2$. TLC showed that the starting material was consumed completely. The mixture was quenched by saturated aq. $NH_4Cl$ (200 mL) and extracted with ethyl acetate (70 mL×3). The organic phase was washed by saturated aq. NaCl (70 mL×3) and dried with anhydrous $Na_2SO_4$, then concentrated under reduced pressure to remove the solvent to obtain the crude product as yellow gum. The crude product was re-dissolved with methanol (200 mL) and standing at 20-25° C. for 12 hours. Compound 19 (20.4 g, 99.99% yield) was crystallized from the solvent as white solid, then filtered and dried in vacuum. The filtrate was concentrated under reduced pressure to remove the solvent to give compound 20 (28.4 g, crude) as brown gum. $^1$H NMR (400 MHz, CHLOROFORM-d) δ=7.47-7.42 (m, 6H), 7.23-7.05 (m, 19H), 4.36 (td, J=3.0, 8.6 Hz, 1H), 4.23-4.12 (m, 4H), 3.29-3.19 (m, 1H), 3.29-3.19 (m, 1H), 3.11 (ddd, J=7.1, 9.5, 12.1 Hz, 1H), 2.97-2.82 (m, 2H), 2.59 (dd, J=3.1, 14.2 Hz, 1H), 1.37-1.27 (m, 1H), 1.24-1.14 (m, 1H), 1.00-0.92 (m, 1H), 0.16-0.02 (m, 1H).

Preparation of Compound WV-CA-263.

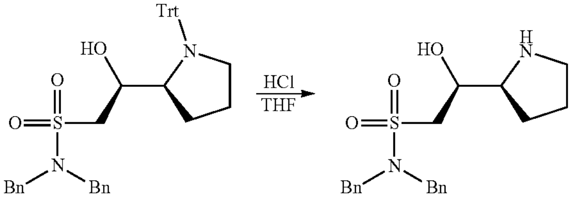

19 WV-CA-263

To a solution of compound 19 (20 g, 32.42 mmol) in THF (100 mL) was added HCl (5 M, 64.85 mL) at 20-25° C. and stirred for 0.5 hr. TLC showed that the starting material was consumed completely. The mixture was extracted with TBME (80 mL×3), then adjusted the pH of the mixture with aq. NaOH (65 mL, 5M) to 11-13 and extracted with DCM (100 mL×3). The organic phase was dried with anhydrous $Na_2SO_4$ and concentrated under reduced pressure to remove the solvent. The crude product was used for the next step without any purification. WV-CA-263 (10.04 g, 82.68% yield, 100% purity) was obtained as white solid. $^1$H NMR (400 MHz, CHLOROFORM-d) δ=7.38-7.28 (m, 10H), 4.38 (s, 4H), 4.01 (ddd, J=2.6, 5.6, 8.5 Hz, 1H), 3.20-3.13 (m, 2H), 3.10-3.02 (m, 1H), 2.91 (t, J=6.5 Hz, 2H), 1.89 (br d, J=8.6 Hz, 1H), 1.82-1.66 (m, 4H), 1.62-1.52 (m, 1H). $^{13}$C NMR (101 MHz, CHLOROFORM-d) δ=135.62, 128.77, 128.70, 127.98, 77.35, 76.87 (d, J-31.5 Hz, 1C), 68.84, 61.51, 57.03, 50.35, 46.96, 26.27, 25.88. LCMS [M+H]$^+$: 375.1, purity: 100.00%. SFC: dr=99.55:0.45.

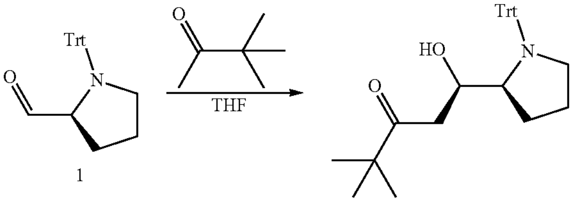

1

21

To a solution of 3,3-dimethylbutan-2-one (11.00 g, 109.83 mmol) in THF (125 mL) was added LDA (2 M, 54.91 mL) dropwise at −70° C., and it was stirred at −70° C. ~−60° C. for 1 hr. A solution of compound 1 (25 g, 73.22 mmol) in THF (125 mL) was added dropwise at −70° C.~−60° C. The mixture was stirred at −70° C. for 1.5 hr. TLC showed compound 1 was almost consumed. The reaction mixture was quenched with sat. $NH_4Cl$ (aq., 200 mL), and the separated aqueous layer was extracted with EtOAc (150 mL×3). The combined organic layers were dried over anhydrous $Na_2SO_4$, filtered and concentrated to afford a residue as a light-yellow solid. The crude was purified by column chromatography on silica gel (Petroleum ether+5% TEA; Petroleum ether: Ethyl acetate (20:1)+5% TEA). Compound 21 (17 g, 52.6% yield) was obtained as a white solid. $^1H$ NMR (400 MHz, CHLOROFORM-d) δ=7.37-7.25 (m, 6H), 7.03-6.95 (m, 6H), 6.94-6.84 (m, 3H), 4.22 (td, J=2.7, 9.2 Hz, 1H), 3.09 (td, J=4.1, 7.6 Hz, 1H), 3.04-2.92 (m, 2H), 2.75 (ddd, J=2.9, 8.5, 12.0 Hz, 1H), 2.26 (dd, J=9.3, 17.0 Hz, 1H), 2.04 (dd, J=3.4, 16.9 Hz, 1H), 1.43-1.24 (m, 2H), 1.14-1.01 (m, 1H), 0.84 (s, 9H), 0.81-0.71 (m, 1H), 0.09--0.07 (m, 1H).

Preparation of Compound WV-CA-289.

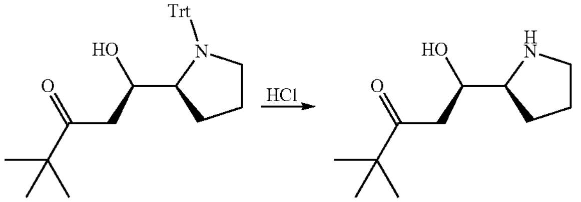

21 WV-CA-289

To a solution of compound 21 (16 g, 36.23 mmol) in EtOAc (25 mL) was added 4 M HCl/EtOAc (100 mL). The mixture was stirred at 25° C. for 0.5 hr. TLC showed the reaction was completed. The resulting mixture was filtered, and the solid was stirred in EtOAc (150 mL), filtered and re-triturated with EtOAc/MeOH (150 mL/5 mL), filtered and dried to afford compound WV-CA-289 (7.5 g, 87.8% yield, HCl salt) as a white solid. $^1H$ NMR (400 MHz, METHANOL-$d_4$) δ=4.43 (ddd, J=3.5, 4.6, 7.8 Hz, 1H), 3.71 (dt, J=3.5, 8.0 Hz, 1H), 3.42-3.22 (m, 2H), 2.92 (dd, J=7.6, 17.7 Hz, 1H), 2.73 (dd, J=4.9, 17.7 Hz, 1H), 2.23-1.90 (m, 4H), 1.28-1.05 (m, 9H). $[M+H]^+$: 200.1, purity: 100.00%.

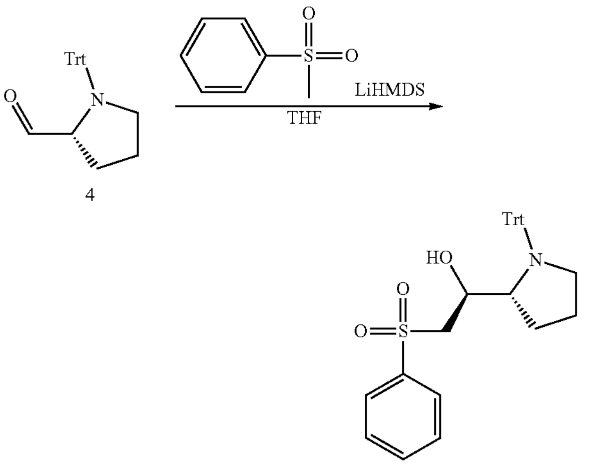

4

22

To a solution of methylsulfonylbenzene (13.72 g, 87.86 mmol) in THF (100 mL) was added LiHMDS (1 M, 87.86 mL) in 0.5 hr at −70° C.-0° C., then added compound 4 in THF (100 mL). The mixture was stirred at −70° C. in 2.5 hr. TLC indicated compound 4 was remained a little and two new spots formed. The reaction mixture was quenched by addition sat. $NH_4Cl$ aq. (300 mL) at 0° C., extracted with DCM (200 mL×3). Dried over $Na_2SO_4$, filtered and concentrated under reduced pressure to give a residue. The crude was added THF (100 mL) and MeOH (150 mL), concentrated under reduced pressure at 45° C. until about 100 mL residue remained, filtered the solid. Repeated 3 times. Got solid 20 g, the mother liquid was concentrated under reduced pressure to get compound 22 (20 g, crude) was obtained as a yellow oil. Compound (1R)-2-(benzenesulfonyl)-1-[(2R)-1-tritylpyrrolidin-2-yl]ethanol (20 g, 68.61% yield) was obtained as a white solid.

Preparation of Compound WV-CA-290.

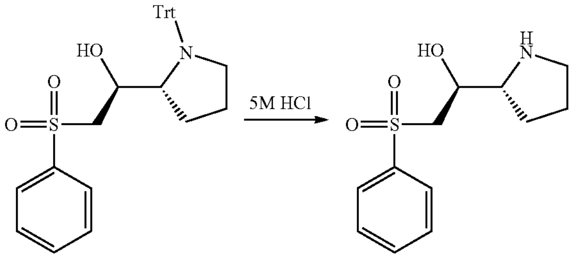

22 WV-CA-290

To a solution of compound 22 (20 g, 40.19 mmol) in THF (80 mL) was added HCl (5 M, 80.38 mL) at 0° C. The mixture was stirred at 25° C. for 2 hr. TLC showed the compound 22 was consumed and two new spots formed. The reaction mixture was washed with MTBE (50 mL×3), then the aqueous phase was basified by addition NaOH (5M) until pH=12 at 0° C., and then extracted with DCM (50 mL×3) to give a residue dried over $Na_2SO_4$, filtered and concentrated under reduced pressure to give a residue. The residue was purified by prep-HPLC(column: Phenomenex luna C18 250×50 mm×10 um; mobile phase: [water (0.1% TFA)-ACN]; B %: 0%-15%, 20 min). Compound WV-CA-290 (0.7 g, 6.78% yield, 99.39% purity) was obtained as a yellow solid. $^1H$ NMR (400 MHz, CHLOROFORM-d) δ=7.95-7.85 (m, 2H), 7.64-7.56 (m, 1H), 7.55-7.46 (m, 2H), 3.79 (ddd, J=3.2, 5.4, 8.4 Hz, 1H), 3.28-3.05 (m, 3H), 2.92-2.72 (m, 2H), 1.84-1.54 (m, 3H), 1.51-1.37 (m, 1H). $^{13}C$ NMR (101 MHz, CHLOROFORM-d) δ=139.81, 133.74, 129.19, 128.07, 68.15, 61.55, 60.97, 46.67, 28.03, 26.27. SFC: (AD_MeOH_IPAm_10_40_25_35_6 min), 100% purity. LCMS $[M+H]^+$: 256.1. LCMS purity: 99.39%.

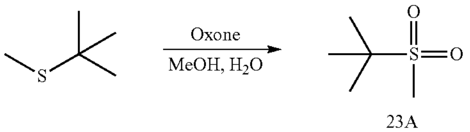

23A

Two batches in parallel: To a solution of compound tert-butyl(methyl) sulfane (25 g, 239.89 mmol) in MeOH (625 mL) was added Oxone (457.18 g, 743.67 mmol) in $H_2O$ (625 mL) at 0° C. The mixture was stirred at 15° C. for 12 hr. HNMR showed compound tert-butyl(methyl) sulfane was consumed completely and desired compound was detected. Combined two batches of the reaction mixture, filtered and concentrated under reduced pressure to evaporate the MeOH, and then extracted with EtOAc (400 mL×4).

The combined organic layers were dried over $Na_2SO_4$, filtered and concentrated under reduced pressure to give a residue. Compound 23A (55 g, crude) was obtained as a colorless oil, confirmed by HNMR. $^1$HNMR (400 MHz, CHLOROFORM-d) δ=7.26 (s, 1H), 5.30 (s, 8H), 2.81 (s, 3H), 1.43 (s, 9H).

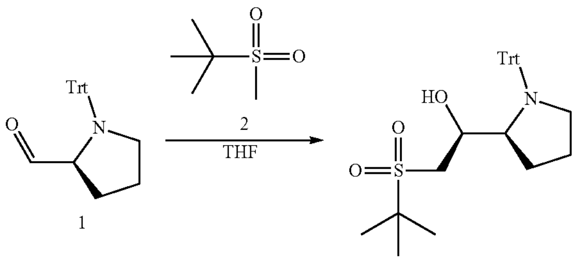

1 2 23

To a solution of compound 23A (50 g, 367.07 mmol) in THF (510 mL) was added KHMDS (1 M, 367.07 mL) dropwise at −70° C., and warm to −30° C. slowly over 30 min. The mixture was then cooled to −70° C. A solution of compound 1 (83.56 g, 244.72 mmol) in THF (340 mL) was added dropwise at −70° C. The mixture was stirred at −70° C. for 4 hr. TLC showed compound 1 was remained a little, and one major new spot with larger polarity was detected. The reaction mixture was quenched by added to the sat. $NH_4Cl$ (aq. 800 mL), and then extracted with EtOAc (500 mL×3). The combined organic layers were dried over $Na_2SO_4$, filtered and concentrated under reduced pressure to give brown oil. The crude was dissolved with THF (300 mL) then concentrated under reduced pressure (40° C.) to give 150 mL clarified solution. Then added to 300 mL MeOH and concentrated under reduced pressure to give 200 mL solution, then filtered to give a residue and washed with MeOH (10 mL). The mother solution was concentrated under reduced pressure to give 100 mL solution then filtered to give a residue and washed with MeOH (10 mL). Combined all the residue, repeated two times to give 60 g residue. Compound 23 (60 g, crude) was obtained as a white solid. $^1$HNMR (400 MHz, CHLOROFORM-d) δ=7.56 (d, J=7.5 Hz, 6H), 7.32-7.23 (m, 6H), 7.21-7.14 (m, 3H), 4.85-4.68 (m, 1H), 3.41 (td, J=3.8, 8.1 Hz, 1H), 3.28 (td, J=8.5, 11.9 Hz, 1H), 3.09-2.91 (m, 2H), 2.78 (dd, J=2.6, 13.6 Hz, 1H), 1.65-1.50 (m, 1H), 1.37 (s, 9H), 1.16-0.98 (m, 2H), 0.39-0.21 (m, 1H).

Preparation of Compound WV-CA-240.

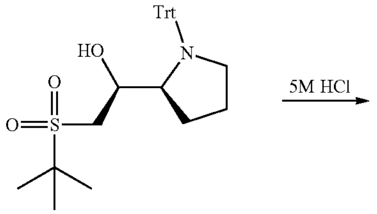

23

-continued

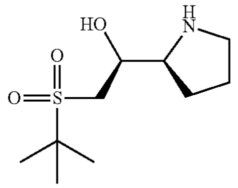

WV-CA-240

To a solution of compound 23 (59 g, 123.52 mmol) in THF (500 mL) was added HCl (5 M, 247.04 mL). The mixture was stirred at 20° C. for 3 hr. TLC indicated compound 23 was consumed completely and one major new spot with larger polarity was detected. The resulting mixture was washed with MTBE (500 mL×3). The combined aqueous layer was adjusted to pH 12 with 5 M NaOH aq. and extracted with DCM (200 mL×3). The combined organic layers were dried over anhydrous $Na_2SO_4$, filtered and concentrated to afford a white solid. WV-CA-240 (23.6 g, 81.14% yield, 99.95% purity) was obtained as a white solid. $^1$HNMR (400 MHz, CHLOROFORM-d) δ=4.18 (ddd, J=2.8, 5.8, 8.2 Hz, 1H), 3.29-3.21 (m, 1H), 3.19 (d, J=2.6 Hz, 1H), 3.16-3.08 (m, 1H), 2.92 (t, J=6.6 Hz, 2H), 2.74 (br s, 2H), 1.92-1.81 (m, 1H), 1.81-1.61 (m, 3H), 1.42 (s, 9H). $^{13}$CNMR (101 MHz, CHLOROFORM-d) δ=68.01, 62.00, 59.73, 49.79, 46.96, 26.77, 25.80, 23.22. LCMS $[M+H]^+$: 236.1. LCMS purity 99.95%.

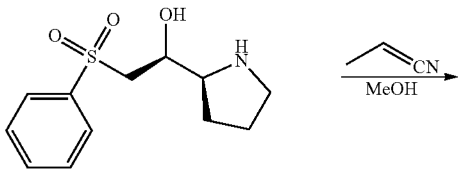

WV-CA-108

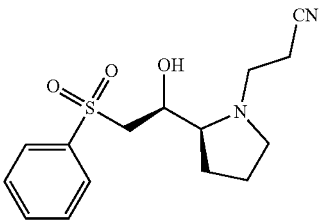

24

To a solution of WV-CA-108 (37 g, 144.91 mmol, 1 eq.) in MeOH (370 mL) was added prop-2-enenitrile (7.69 g, 144.91 mmol, 9.61 mL, 1 eq.). The mixture was stirred at 20° C. for 3 hr., (TLC, Petroleum ether: Ethyl acetate=1:3, Rf=0.31) showed WV-CA-108 was consumed completely and in LCMS one main peak with desired MS was detected. The reaction mixture was filtered and concentrated under reduced pressure to give a residue. Compound 24 (44 g, crude) was obtained as a white solid. LCMS $[M+H]^+$: 308.9. Preparation of Compound WV-CA-291.

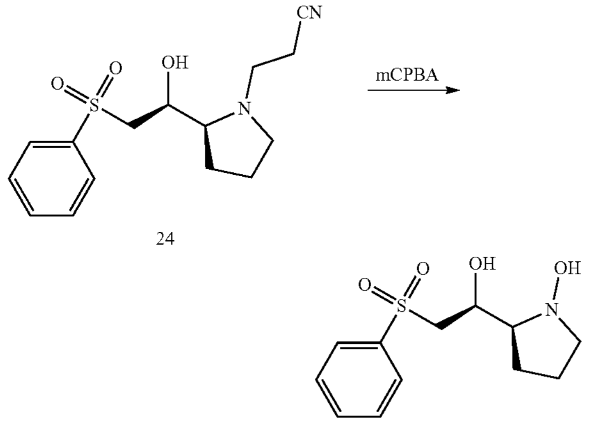

24

WV-CA-291

A solution of compound 24 (44 g, 142.67 mmol, 1 eq.) in DCM (220 mL) and MeOH (220 mL) was cooled to −78° C. Then mCPBA (36.93 g, 214.01 mmol, 1.5 eq.) and $K_2CO_3$ (29.58 g, 214.01 mmol, 1.5 eq.) was added. After addition, the mixture was stirred at −78° C. for 3 hr. And the resulting mixture was stirred at 20° C. for 12 hr. LC-MS showed compound 24 was consumed completely and one main peak with desired MS was detected. The reaction mixture was filtered and concentrated under reduced pressure to give a residue. The residue was purified by flash silica gel chromatography. The residue was purified by flash silica gel chromatography (ISCOR; 220 g SepaFlash® Silica Flash Column, Eluent of 0~30% Ethyl acetate/Petroleum ether gradient at 100 mL/min). WV-CA-291 (12 g, 42.05 mmol, 29.47% yield, 95.08% purity) was obtained as a yellow solid. $^1$H NMR (400 MHz, CHLOROFORM-d) δ=7.98-7.92 (m, 2H), 7.65 (d, J=7.5 Hz, 1H), 7.61-7.53 (m, 2H), 4.50-4.39 (m, 1H), 3.33-3.15 (m, 3H), 2.97-2.78 (m, 2H), 1.89-1.64 (m, 4H). $^{13}$CNMR (101 MHz, CHLOROFORM-d) δ=139.61, 133.90, 129.31, 128.02, 71.21, 64.96, 60.05, 58.12, 21.23, 20.29. LCMS $[M+H]^+$: 272.0. LCMS purity 95.08%.

Example 4E. Example Technologies for Chirally Controlled Oligonucleotide Preparation—Example Useful Phosphoramidites Among other things, the present disclosure provides phosphoramidites useful for oligonucleotide synthesis. In some embodiments, provided phosphoramidites are particularly useful for preparation of chirally controlled internucleotidic linkages. In some embodiments, provided phosphoramidites are particularly useful for preparing chirally controlled internucleotidic linkages, e.g., non-negatively charged internucleotidic linkages or neutral internucleotidic linkages, etc., that comprise P—N═. In some embodiments, the linkage phosphorus is trivalent. In some embodiments, the linkage phosphorus is pentavalent. In some embodiments, such internucleotidic linkages have the structure of formula I-n-1, I-n-2, I-n-3, I-n-4, II, II-a-1, II-a-2, II-b-1, II-b-2, II-c-1, II-c-2, II-d-1, II-d-2, or a salt form thereof.

General Procedure I for Chloroderivative: In some embodiments, in an example procedure, a chiral auxiliary (174.54 mmol) was dried by azeotropic evaporation with anhydrous toluene (80 mL×3) at 35° C. in a rota-evaporator and dried under high vacuum for overnight. A solution of this dried chiral auxiliary (174.54 mmol) and 4-methylmorpholine (366.54 mmol) dissolved in anhydrous THF (200 mL) was added to an ice-cooled (isopropyl alcohol-dry ice bath) solution of trichlorophosphine (37.07 g, 16.0 mL, 183.27 mmol) in anhydrous THF (150 mL) placed in three neck round bottomed flask through cannula under Argon (start Temp: −10.0° C., Max: temp 0° C., 28 min addition) and the reaction mixture was warmed at 15° C. for 1 hr. After that the precipitated white solid was filtered by vacuum under argon using airfree filter tube (Chemglass: Filter Tube, 24/40 Inner Joints, 80 mm OD Medium Frit, Airfree, Schlenk). The solvent was removed with rota-evaporator under argon at low temperature (25° C.) and the crude semi-solid obtained was dried under vacuum overnight (~15 h) and was used for the next step directly.

General Procedure I for Chloroderivative: In some embodiments, in an example procedure, a chiral auxiliary (174.54 mmol) was dried by azeotropic evaporation with anhydrous toluene (80 mL×3) at 35° C. in a rota-evaporator and dried under high vacuum for overnight. A solution of this dried chiral auxiliary (174.54 mmol) and 4-methylmorpholine (366.54 mmol) dissolved in anhydrous THF (200 mL) was added to an ice-cooled (isopropyl alcohol-dry ice bath) solution of trichlorophosphine (37.07 g, 16.0 mL, 183.27 mmol) in anhydrous THF (150 mL) placed in three neck round bottomed flask through cannula under Argon (start Temp: −10.0° C., Max: temp 0° C., 28 min addition) and the reaction mixture was warmed at 15° C. for 1 hr. After that the precipitated white solid was filtered by vacuum under argon using airfree filter tube (Chemglass: Filter Tube, 24/40 Inner Joints, 80 mm OD Medium Frit, Airfree, Schlenk). The solvent was removed with rota-evaporator under argon at low temperature (25° C.) and the crude semi-solid obtained was dried under vacuum overnight (~15 h) and was used for the next step directly.

General Procedure III for Coupling: In some embodiments, in an example procedure, a nucleoside (9.11 mmol) was dried by co-evaporation with 60 mL of anhydrous toluene (60 mL×2) at 35° C. and dried under high vacuum for overnight. The dried nucleoside was dissolved in dry THF (78 mL), followed by the addition of triethylamine (63.80 mmol) and then cooled to −5° C. under Argon (for 2'F-dG/2'OMe-dG case 0.95 eq of TMS-Cl used). The THF solution of the crude (made from general procedure I (or) II, 14.57 mmol), was added through cannula over 3 min then gradually warmed to room temperature. After 1 hr at room temperature, TLC indicated conversion of SM to product (total reaction time 1 h), the reaction mixture was then quenched with $H_2O$ (4.55 mmol) at 0° C., and anhydrous $MgSO_4$ (9.11 mmol) was added and stirred for 10 min. Then the reaction mixture was filtered under argon using airfree filter tube, washed with THE, and dried under rotary evaporation at 26° C. to afford white crude solid product, which was dried under high vacuum overnight. The crude product was purified by ISCO-Combiflash system (rediSep high performance silica column pre-equilibrated with Acetonitrile) using Ethyl acetate/Hexane with 1% TEA as a solvent (compound eluted at 100% EtOAc/Hexanes/1% $Et_3N$) (for 2'F-dG case Acetonitrile/Ethyl acetate with 1% TEA used). After evaporation of column fractions pooled together, the residue was dried under high vacuum to afford the product as a white solid.

Preparation of Amidites (1030-1039).

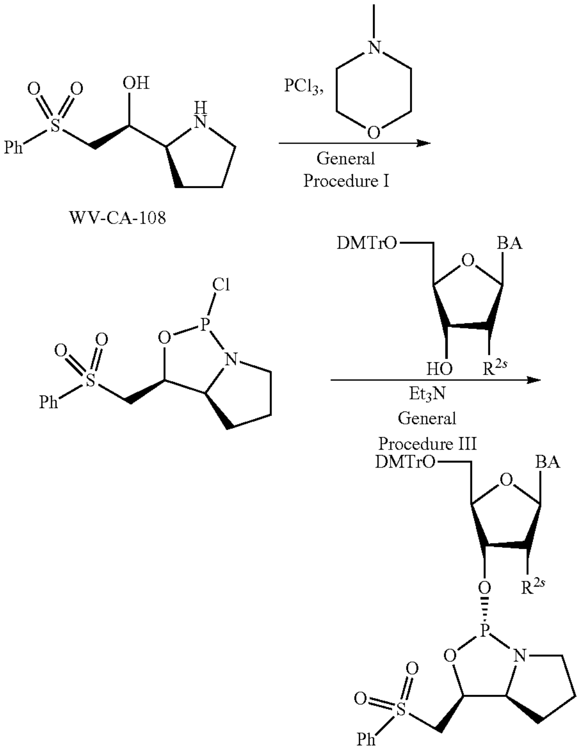

WV-CA-108

1030: $R^{2s}$ = F, BA = $G^{IBu}$
1031: $R^{2s}$ = F, BA = U
1032: $R^{2s}$ = F, BA = $C^{Ac}$
1033: $R^{2s}$ = F, BA = $A^{Bz}$
1034: $R^{2s}$ = OMe, BA = $A^{Bz}$
1035: $R^{2s}$ = MOE, BA = $A^{Bz}$
1036: $R^{2s}$ = MOE, BA = $G^{iBu}$
1037: $R^{2s}$ = MOE, BA = T
1038: $R^{2s}$ = OMOE, BA = 5-Methyl-$C^{Bz}$
1039: $R^{2s}$ = H, B = $C^{Ac}$ Preparation of 1030: General Procedure I followed by General Procedure III used. Off-white foamy solid. Yield: (73%). $^{31}$P NMR (162 MHz, $CDCl_3$) δ 153.32. (ES) m/z Calculated for $C_{47}H_{50}FN_6O_{10}PS$: 940.98 $[M]^+$, Observed: 941.78 $[M+H]^+$.

Preparation of 1031: General Procedure I followed by General Procedure III used. Off-white foamy solid. Yield: (78%). $^{31}$P NMR (162 MHz, $CDCl_3$) δ 153.62. (ES) m/z Calculated for $C_{42}H_{43}FN_3O_{10}PS$: 831.85 $[M]^+$, Observed: 870.58 $[M+K]^+$.

Preparation of 1032: General Procedure I followed by General Procedure III used. Off-white foamy solid. Yield: (68%). $^{31}$P NMR (162 MHz, $CDCl_3$) δ 153.95. (ES) m/z Calculated for $C_{44}H_{46}FN_4O_{10}PS$: 872.26 $[M]^+$, Observed: 873.62 $[M+H]^+$.

Preparation of 1033: General Procedure I followed by General Procedure III used. white foamy solid. Yield: (87%). $^{31}$P NMR (162 MHz, $CDCl_3$) δ 151.70. (ES) m/z Calculated for $C_{50}H_{48}$ $FN_6O_9PS$: 958.29 $[M]^+$, Observed: 959.79, 960.83 $[M+H]^+$.

Preparation of 1034: General Procedure I followed by General Procedure III used. Off-white foamy solid. Yield: (65%). $^{31}$P NMR (162 MHz, $CDCl_3$) δ 154.80. (ES) m/z Calculated for $C_{51}H_{51}N_6O_{10}PS$: 971.31 $[M]^+$, Observed: 971.81 $[M+H]^+$.

Preparation of 1035: General Procedure I followed by General Procedure III used. Off-white foamy solid. Yield: (76%). $^{31}$P NMR (162 MHz, $CDCl_3$) δ 156.50. (ES) m/z Calculated for $C_{53}H_{55}N_6O_{11}PS$: 1014.33 $[M]^+$, Observed: 1015.81 $[M+H]^+$.

Preparation of 1036: General Procedure I followed by General Procedure III used. Off-white foamy solid. Yield: (78%). $^{31}$P NMR (162 MHz, $CDCl_3$) δ 156.40. (ES) m/z Calculated for $C_{50}H_{57}N_6O_{12}PS$: 996.34 $[M]^+$, Observed: 997.90 $[M+H]^+$.

Preparation of 1037: General Procedure I followed by General Procedure III used. Off-white foamy solid. Yield: (73%). $^{31}$P NMR (162 MHz, $CDCl_3$) δ 154.87. (ES) m/z Calculated for $C_{46}H_{52}N_3O_{12}PS$: 901.30 $[M]^+$, Observed: 940.83 $[M+K]^+$.

Preparation of 1038: General Procedure I followed by General Procedure III used. Off-white foamy solid. Yield: (75%). $^{31}$P NMR (162 MHz, $CDCl_3$) δ 154.94. (ES) m/z Calculated for $C_{53}H_{57}N_4O_{12}PS$: 1004.34 $[M]^+$, Observed: 1005.86 $[M+H]^+$.

Preparation of 1039: General Procedure I followed by General Procedure III used. Off-white foamy solid. Yield: (80%). $^{31}$P NMR (162 MHz, $CDCl_3$) δ 153.52. (ES) m/z Calculated for $C_{44}H_{47}N_4O_{10}PS$: 854.28 $[M]^+$, Observed: 855.41 $[M+H]^+$.

Preparation of Amidites (1040-1049).

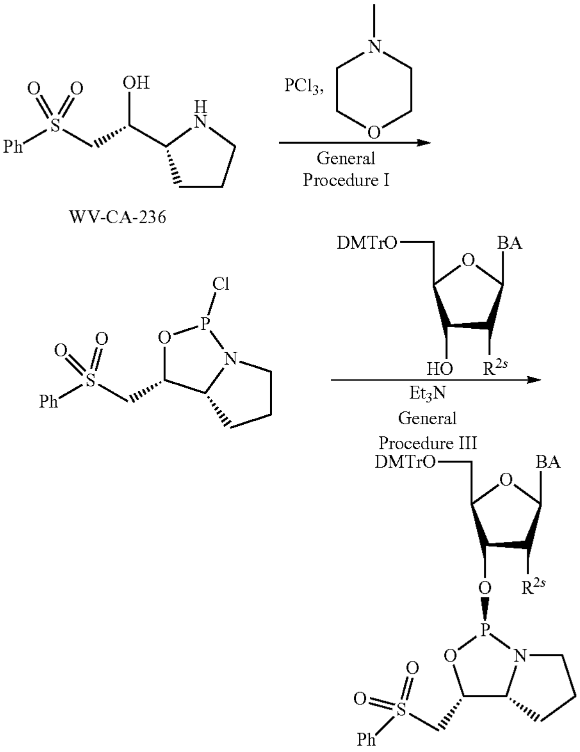

WV-CA-236

1040: $R^{2s}$ = F, BA = $G^{IBu}$
1041: $R^{2s}$ = F, BA = U
1042: $R^{2s}$ = F, BA = $C^{Ac}$
1043: $R^{2s}$ = F, BA = $A^{Bz}$
1044: $R^{2s}$ = OMe, BA = $A^{Bz}$
1045: $R^{2s}$ = OMOE, BA = $A^{Bz}$
1046: $R^{2s}$ = OMOE, BA = $G^{iBu}$
1047: $R^{2s}$ = OMOE, BA = T
1048: $R^{2s}$ = OMOE, BA = 5-Methyl-$C^{Bz}$
1049: $R^{2s}$ = H, B = $C^{Ac}$ Preparation of 1040: General Procedure I followed by General Procedure III used. Off-white foamy solid. Yield: (78%). $^{31}$P NMR (162 MHz, $CDCl_3$) δ 157.80. (ES) m/z Calculated for $C_{47}H_{50}FN_6O_{10}PS$: 940.98 $[M]^+$, Observed: 941.68 $[M+H]^+$.

Preparation of 1041: General Procedure I followed by General Procedure III used. Off-white foamy solid. Yield: (78%). $^{31}$P NMR (162 MHz, $CDCl_3$) δ 157.79. (ES) m/z Calculated for $C_{42}H_{43}FN_3O_{10}PS$: 831.85 $[M]^+$, Observed: 870.68 $[M+K]^+$.

Preparation of 1042: General Procedure I followed by General Procedure III used. Off-white foamy solid. Yield: (78%). $^{31}$P NMR (162 MHz, $CDCl_3$) δ 158.07. (ES) m/z Calculated for $C_{44}H_{46}FN_4O_{10}PS$: 872.26 $[M]^+$, Observed: 873.62 $[M+H]^+$.

Preparation of 1043: General Procedure I followed by General Procedure III used. white foamy solid. Yield: (86%). $^{31}$P NMR (162 MHz, $CDCl_3$) δ 156.48. (ES) m/z Calculated for $C_{50}H_{48}FN_6O_9PS$: 958.29 $[M]^+$, Observed: 959.79, 960.83 $[M+H]^+$.

Preparation of 1044: General Procedure I followed by General Procedure III used. Off-white foamy solid. Yield: (65%). $^{31}$P NMR (162 MHz, $CDCl_3$) δ 154.80. (ES) m/z Calculated for $C_{51}H_{51}N_6O_{10}PS$: 971.31 $[M]^+$, Observed: 971.81 $[M+H]^+$.

Preparation of 1045: General Procedure I followed by General Procedure III used. Off-white foamy solid. Yield: (77%). $^{31}$P NMR (162 MHz, $CDCl_3$) δ 154.74. (ES) m/z Calculated for $C_{53}H_{55}N_6O_{11}PS$: 1014.33 $[M]^+$, Observed: 1015.81 $[M+H]^+$.

Preparation of 1046: General Procedure I followed by General Procedure III used. Off-white foamy solid. Yield: (76%). $^{31}$P NMR (162 MHz, $CDCl_3$) δ 155.05. (ES) m/z Calculated for $C_{50}H_{57}N_6O_{12}PS$: 996.34 $[M]^+$, Observed: 997.90 $[M+H]^+$.

Preparation of 1047: General Procedure I followed by General Procedure III used. Off-white foamy solid. Yield: (75%). $^{31}$P NMR (162 MHz, $CDCl_3$) δ 155.44. (ES) m/z Calculated for $C_{46}H_{52}N_3O_{12}PS$: 901.30 $[M]^+$, Observed: 940.83 $[M+K]^+$.

Preparation of 1048: General Procedure I followed by General Procedure III used. Off-white foamy solid. Yield: (73%). $^{31}$P NMR (162 MHz, $CDCl_3$) δ 155.96. (ES) m/z Calculated for $C_{53}H_{57}N_4O_{12}PS$: 1004.34 $[M]^+$, Observed: 1005.86 $[M+H]^+$.

Preparation of 1049: General Procedure I followed by General Procedure III used. Off-white foamy solid. Yield: (80%). $^{31}$P NMR (162 MHz, $CDCl_3$) δ 156.37. (ES) m/z Calculated for $C_{44}H_{47}N_4O_{10}PS$: 854.28 $[M]^+$, Observed: 855.31 $[M+H]^+$.

Preparation of Amidites (1051).

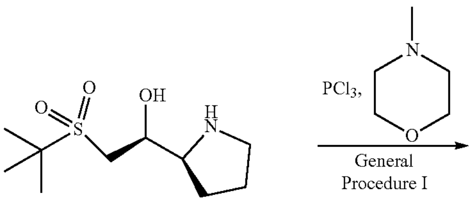

WV-CA-240

-continued

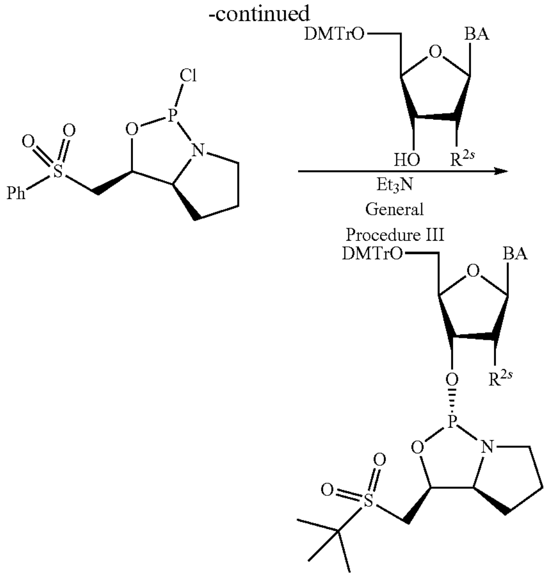

1051: $R^{2s}$=F, BA = $C^{4c}$

Preparation of 1051: General Procedure II followed by General Procedure III used. Off-white foamy solid. Yield: (72%). $^{31}$P NMR (162 MHz, $CDCl_3$) δ 154.26. (ES) m/z Calculated for $C_{42}H_{50}FN_4O_{10}PS$: 852.29 $[M]^+$, Observed: 853.52 $[M+H]^+$.

Preparation of Amidites (1052).

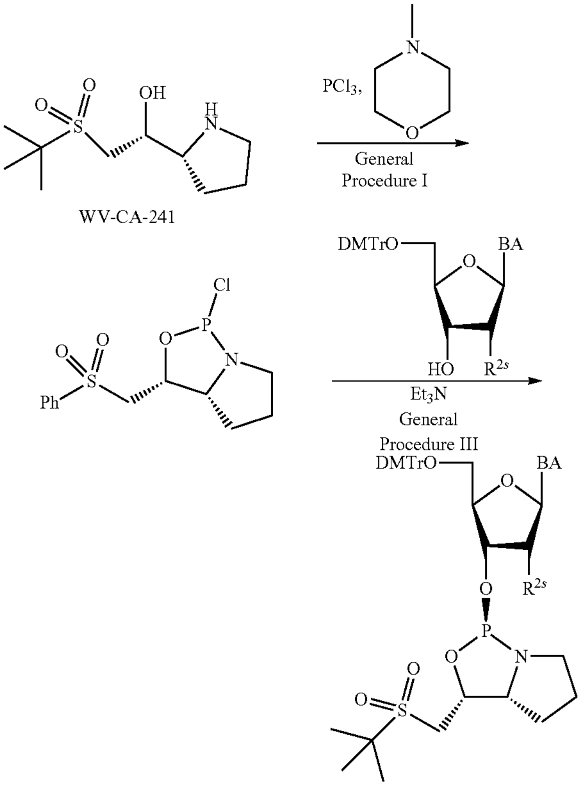

1052: $R^{2s}$=F, BA = $C^{4c}$

Preparation of 1052: General Procedure II followed by General Procedure III used. Off-white foamy solid. Yield:

(76%). $^{31}$P NMR (162 MHz, $CDCl_3$) δ 156.37. (ES) m/z Calculated for $C_{42}H_{50}FN_4O_{10}PS$: 852.29 $[M]^+$, Observed: 853.52 $[M+H]^+$.

Preparation of Amidites (1053, 1054).

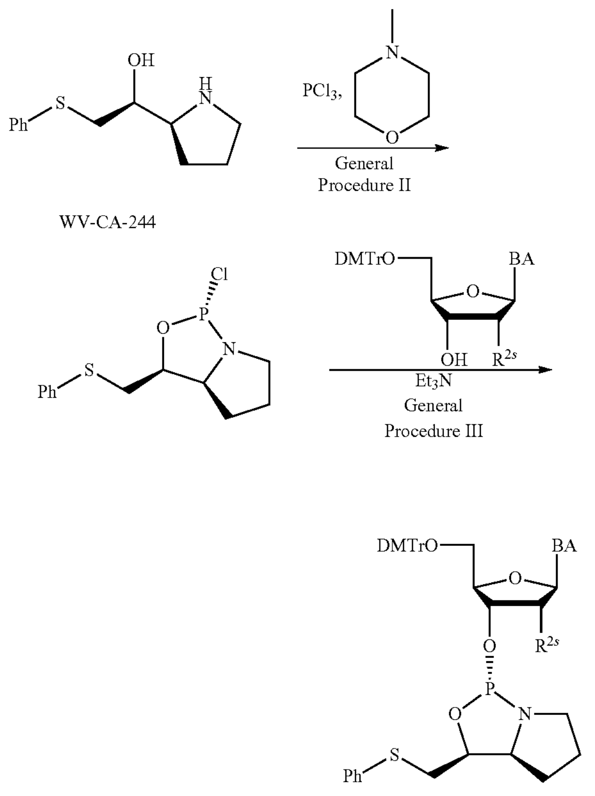

1053: $R^{2s}$ = F, BA = $G^{iBu}$
1054: $R^{2s}$ = F, BA = $C^{Ac}$

Preparation of 1053: General Procedure II followed by General Procedure III used. Off-white foamy solid. Yield: (80%). $^{31}$P NMR (162 MHz, $CDCl_3$) δ 156.62. (ES) m/z Calculated for $C_{47}H_{50}FN_6O_9PS$: 908.98 $[M]^+$, Observed: 909.36 $[M+H]^+$.

Preparation of 1054: General Procedure II followed by General Procedure III used. Off-white foamy solid. Yield: (79%). $^{31}$P NMR (162 MHz, $CDCl_3$) δ 157.62. (ES) m/z Calculated for $C_{44}H_{46}FN_4O_9PS$: 840.90 $[M]^+$, Observed: 841.67 $[M+H]^+$.

Preparation of Amidites (1055).

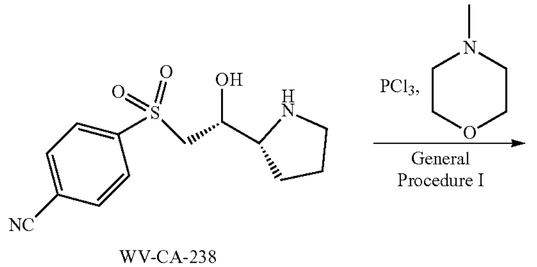

WV-CA-238

-continued

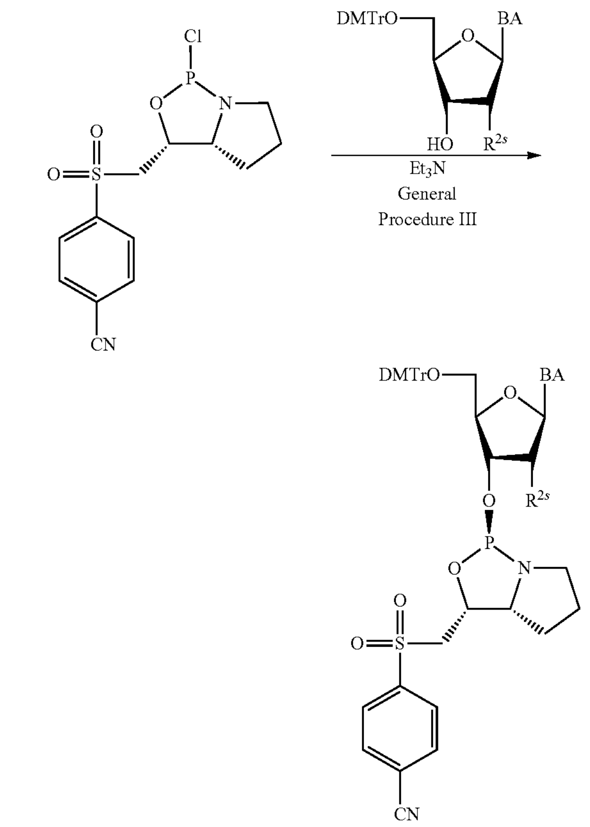

1055: $R^{2s}$ = F, BA = $C^{Ac}$

Preparation of 1055: General Procedure II followed by General Procedure III used. White foamy solid. Yield: (77%). $^{31}$P NMR (162 MHz, $CDCl_3$) δ 160.00. (ES) m/z Calculated for $C_{45}H_{45}FN_5O_{10}PS$: 897.26 $[M]^+$, Observed: 898.74 $[M+H]^+$.

Preparation of Amidites (1056).

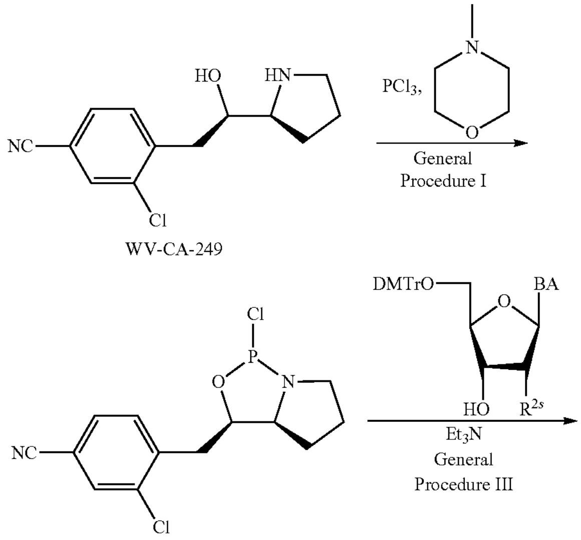

-continued

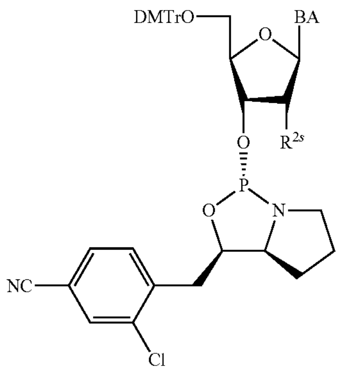

1056: $R^{2s}$ = F, BA = $C^{4c}$

Preparation of 1056: General Procedure II followed by General Procedure III used. Off-white foamy solid. Yield: (84%). $^{31}P$ NMR (162 MHz, $CDCl_3$) δ 154.80. (ES) m/z Calculated for $C_{45}H_{44}ClFN_5O_9P$: 867.26 $[M]^+$, Observed: 868.69 $[M+H]^+$.

Preparation of Amidites (1057).

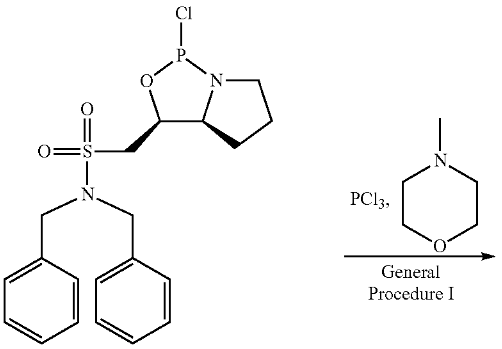

WV-CA-263

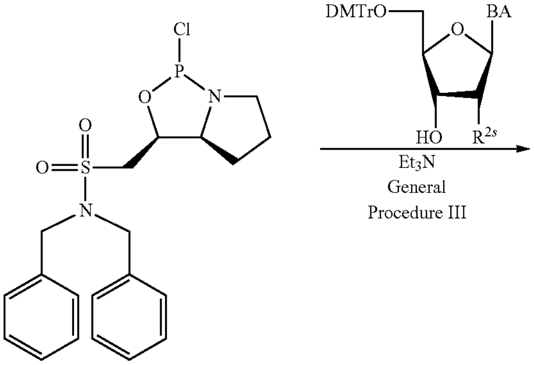

-continued

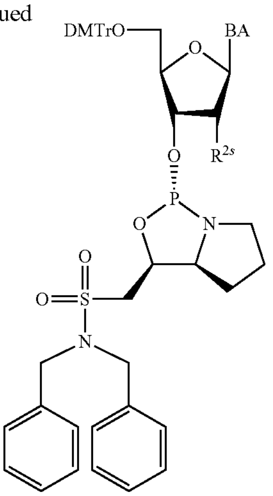

1057: $R^{2s}$ = F, BA = $C^{4c}$

Preparation of 1057: General Procedure II followed by General Procedure III used. white foamy solid. Yield: (91%). $^{31}P$ NMR (162 MHz, $CDCl_3$) δ 154.48. (ES) m/z Calculated for $C_{52}H_{55}FN_5O_{10}PS$: 991.34 $[M]^+$, Observed: 992.87 $[M+H]^+$.

Example 4F. Example Technologies for Chirally Controlled Oligonucleotide Preparation—Example Cycles, Conditions and Reagents for Oligonucleotide Synthesis In some embodiments, the present disclosure provides technologies (e.g., reagents, solvents, conditions, cycle parameters, cleavage methods, deprotection methods, purification methods, etc.) that are particularly useful for preparing chirally controlled internucleotidic linkages. In some embodiments, such internucleotidic linkages, e.g., non-negatively charged internucleotidic linkages or neutral internucleotidic linkages, etc., comprise P—N=, wherein P is the linkage phosphorus. In some embodiments, the linkage phosphorus is trivalent. In some embodiments, the linkage phosphorus is pentavalent. In some embodiments, such internucleotidic linkages have the structure of formula I-n-1, I-n-2, I-n-3, I-n-4, II, II-a-1, II-a-2, II-b-1, II-b-2, II-c-1, II-c-2, II-d-1, II-d-2, or a salt form thereof. As demonstrated herein, technologies of the present disclosure can provide mild reaction conditions, high functional group compatibility, alternative deprotection and/or cleavage conditions, high crude and/or purified yields, high crude purity, high product purity, and/or high stereoselectivity.

In some embodiments, a cycle for preparing natural phosphate linkages comprises or consists of deprotection (e.g., detritylation), coupling, oxidation (e.g., using $I_2$/Pyr/Water or other suitable methods available in the art) and capping (e.g., cap 2 described herein or other suitable methods available in the art). An example cycle is depicted below, wherein B1 and B2 are independently nucleobases. As appreciated by those skilled in the art, various modifications, e.g., sugar modifications, base modifications, etc. are compatible and may be included.

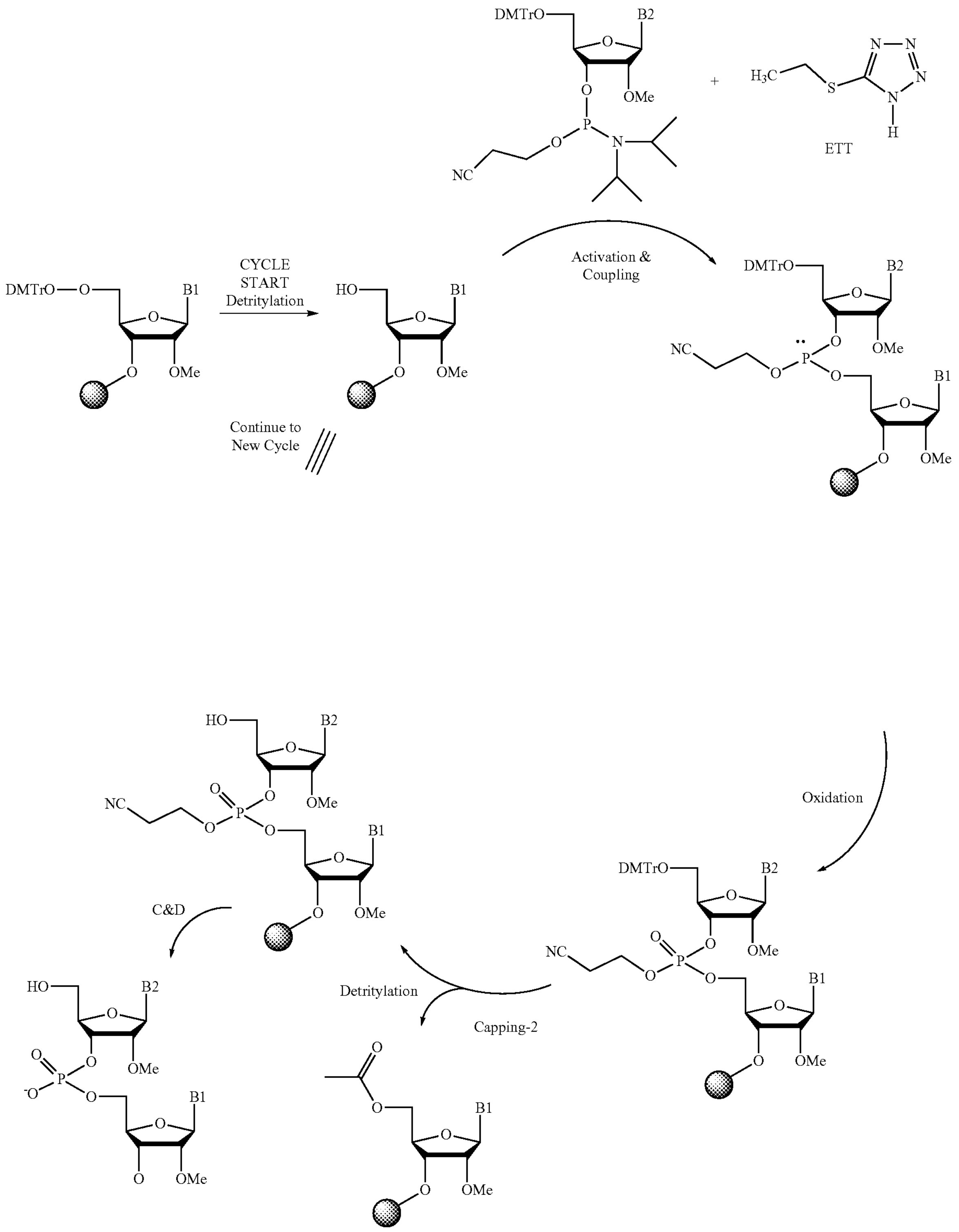

In some embodiments, a cycle for preparing non-natural phosphate linkages (e.g., phosphorothioate internucleotidic linkages) comprises or consists of deprotection (e.g., detritylation), coupling, a first capping (e.g., capping-1 as described herein), modification (e.g., thiolation using XH or other suitable methods available in the art), and a second capping (e.g., capping-2 as described herein or other suitable methods available in the art). An example cycle is depicted below, wherein B1 and B2 are independently nucleobases. As appreciated by those skilled in the art, various modifications, e.g., sugar modifications, base modifications, etc. are compatible and may be included. In some embodiments, a cycle using a DPSE chiral auxiliary is referred to as a DPSE cycle or DPSE amidite cycle.

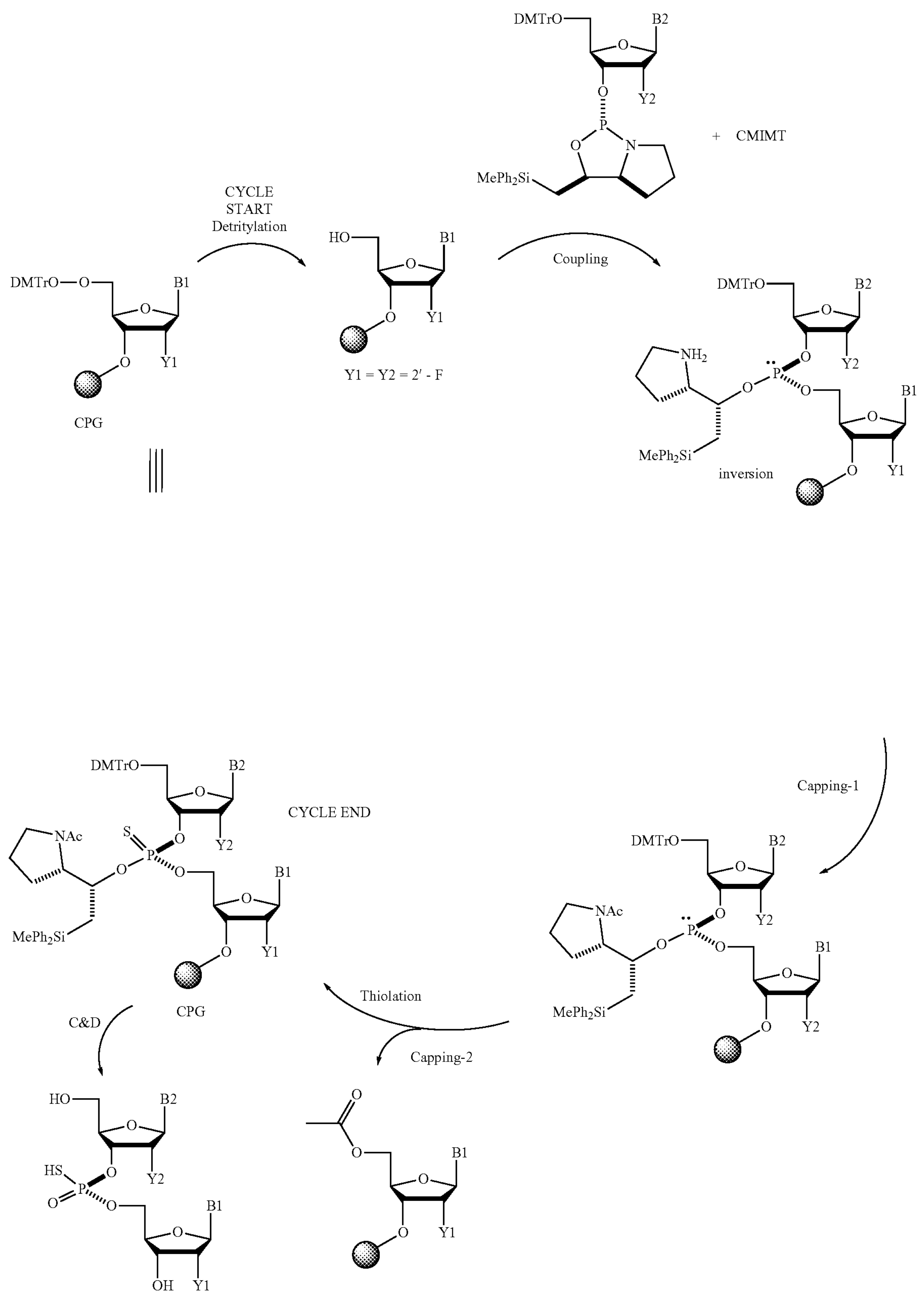
+ CMIMT
CYCLE START
Detritylation
Coupling
Y1 = Y2 = 2' - F
inversion
Capping-1
CYCLE END
Thiolation
Capping-2
C&D In some embodiments, a cycle for preparing non-natural phosphate linkages (e.g., certain non-negatively charged internucleotidic linkages, neutral internucleotidic linkages, etc.), particularly those comprising P—N=, wherein P is the linkage phosphorus and/or those have the structure of formula I-n-1, I-n-2, I-n-3, I-n-4, II, II-a-1, II-a-2, II-b-1, II-b-2, II-c-1, II-c-2, II-d-1, II-d-2, III, or a salt form thereof, comprises or consists of deprotection (e.g., detritylation), coupling, a first capping (e.g., capping-1 as described herein), modification (e.g., using ADIH

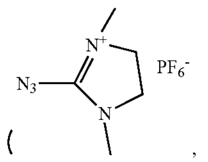

2-azido-1,3-dimethyl-4,5-dihydro-1H-imidazol-3-ium hexafluorophosphate (V)) or other suitable methods available in the art), and a second capping (e.g., capping-2 as described herein or other suitable methods available in the art). An example cycle is depicted below, wherein B1 and B2 are independently nucleobases. In some embodiments, a chiral auxiliary utilized in such a cycle for preparing a chirally controlled internucleotidic linkage comprises an electron-withdrawing group as described herein, e.g., various chiral auxiliaries having a $G^2$ comprising an electron-withdrawing group. In some embodiments, $G^2$ comprises a $—SO_2R$ group as described herein (e.g., in some embodiments, R is optionally substituted phenyl; in some embodiments, R is optionally substituted alkyl (e.g., t-butyl); in some embodiments, it was observed that R being alkyl (e.g., R being t-butyl (e.g., WV-CA-240)) can provide comparable results to R being optionally substituted phenyl(e.g., R being phenyl(PSM))). As appreciated by those skilled in the art, various modifications, e.g., sugar modifications, base modifications, etc. are compatible and may be included. In some embodiments, a cycle using a PSM chiral auxiliary is referred to as a PSM cycle or PSM amidite cycle.

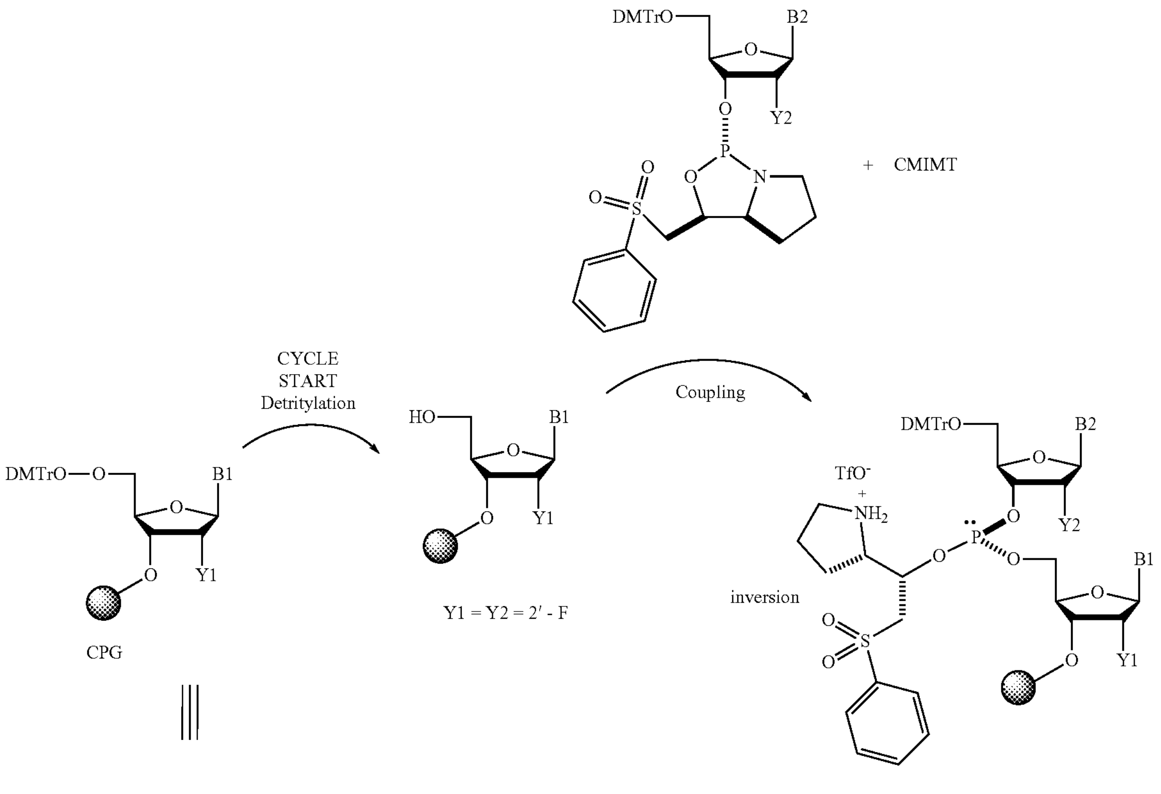

-continued

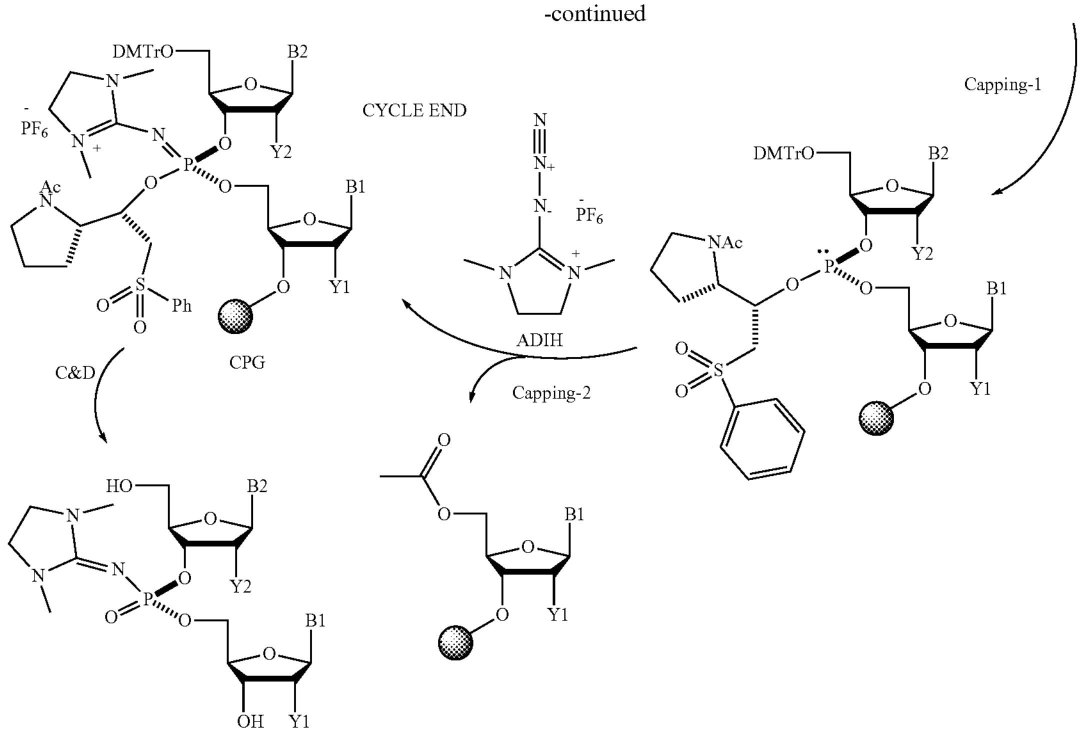

Various cleavage and deprotection methods may be utilized in accordance with the present disclosure. In some embodiments, as appreciated by those skilled in the art, parameters of cleavage and deprotection (e.g., bases, solvents, temperatures, equivalents, time, etc.) can be adjusted in view of, e.g., structures of oligonucleotides to be prepared (e.g., nucleobases, sugars, internucleotidic linkages, and modifications/protections thereof), solid supports, reaction scales, etc. In some embodiments, cleavage and deprotection comprise one, or two or more, individual steps. For example, in some embodiments, a two-step cleavage and deprotection is utilized. In some embodiments, a cleavage and deprotection step comprises a fluoride-containing reagent (e.g., TEA-HF, optionally buffered with additional bases such as TEA) in a suitable solvent (e.g., DMSO/$H_2O$) at a suitable amount (e.g., about 100 or more (e.g., 100±5) mL/mmol) and is performed at a suitable temperature (e.g., about 0-100, 0-80, 0-50, 0-40, 0-30, 0, 10, 20, 30, 40, 50, 60, 70, 80, 90 or 100° C. (e.g., in one example, 27±2° C.)) for a suitable period of time (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more hours (e.g., in one example, 6±0.5 h)). In some embodiments, a cleavage and deprotection step comprises a suitable base (e.g., $NR_3$) in a suitable solvent (e.g., water) (e.g., conc. $NH_4OH$) at a suitable amount (e.g., about 200 or more (e.g., 200±5) mL/mmol) and is performed at a suitable temperature (e.g., about 0-100, 0-80, 0-50, 0-40, 0-30, 0, 10, 20, 30, 40, 50, 60, 70, 80, 90 or 100° C. (e.g., in one example, 37±2° C.)) for a suitable period of time (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more hours (e.g., in one example, 24±1 h)). In some embodiments, cleavage and deprotection comprises or consists of two steps, wherein one step (e.g., step 1) is 1×TEA-HF in DMSO/$H_2O$, 100±5 mL/mmol, 27±2° C. and 6±0.5 h, and the other step (e.g., step 2) is conc. $NH_4OH$, 200±5 mL/mmol, 37±2° C. and 24±1 h. Certain examples of cleavage and deprotection processes are described here.

As appreciated by those skilled in the art, oligonucleotide synthesis is often performed on solid support. Many types of solid support are commercially available and/or can be otherwise prepared/obtained and can be utilized in accordance with the present disclosure. In some embodiments, a solid support is CPG. In some embodiments, a solid support is NittoPhase HL. Types and sizes of solid support can be selected based on desired applications, and in some cases, for a specific use one type of solid support may perform better than the other. In some embodiments, it was observed that for certain preparations CPG can deliver higher crude yields and/or purities compared to certain polymer solid supports such as NittoPhase HL.

Amidites are typically dissolved in solvents at suitable concentrations. In some embodiments, amidites are dissolved in ACN. In some embodiments, amidites are dissolved in a mixture of two or more solvents. In some embodiments, amidites are dissolved in a mixture of ACN and IBN (e.g., 20% ACN/80% IBN). Various concentrations of amidites may be utilized, and may be adjusted in view of specific conditions (e.g., solid support, oligonucleotides to be prepared, reaction times, scales, etc.). In some embodiments, a concentration of about 0.01-0.5, 0.05-0.5, 0.1-0.5, 0.05, 0.1, 0.15, 0.2, 0.25, 0.3, 0.35, 0.4, 0.45 or 0.5 M is utilized. In some embodiments, a concentration of about 0.2 M is utilized. In many embodiments, amidite solutions are dried. In some embodiments, 3 Å molecular sieves are utilized to dry amidite solutions (or keep amidite solutions dry). In some embodiments, molecular sieves are utilized at about 15-20% v/v.

Various equivalents of amidites may be useful for oligonucleotide synthesis. As those skilled in the art will appreciate, equivalents of amidites can be adjusted in view of specific conditions (e.g., solid support, oligonucleotides to be prepared, reaction times, scales, etc.), and the same or different equivalents may be utilized during synthesis. In some embodiments, equivalents of amidites are about 1, 1.5, 2, 2.5, 3, 3.5, 4, 4.5, 5 or more. In some embodiments, a suitable equivalent is about 2. In some embodiments, a suitable equivalent is about 2.5. In some embodiments, a suitable equivalent is about 3. In some embodiments, a suitable equivalent is about 3.5. In some embodiments, a suitable equivalent is about 4.

A number of activators are available in the art and may be utilized in accordance with the present disclosure. In some embodiments, an activator is ETT. In some embodiments, an activator is CMIMT. In some embodiments, CMIMT is utilized for chirally controlled synthesis. As appreciated by those skilled in the art, the same or different activators may be utilized for different amidites, and may be utilized at different amounts. In some embodiments, activators are utilized at about 40-100%, e.g., 40%, 50%, 60%, 70%, 80% or 90% delivery. In some embodiments, a delivery is about 60% (e.g., for ETT). In some embodiments, a delivery is about 70% (e.g., for CMIMT). In some embodiments, molar ratio of activator/amidite is about 1, 2, 3, 4, 5, 6, 7, 8, 9, 10 or more. In some embodiments, a molar ratio is about 3-6. In some embodiments, a molar ratio is about 1. In some embodiments, a molar ratio is about 2. In some embodiments, a molar ratio is about 3. In some embodiments, a molar ratio is about 4. In some embodiments, a molar ratio is about 5. In some embodiments, a molar ratio is about 6. In some embodiments, a molar ratio is about 7. In some embodiments, a molar ratio is about 8. In some embodiments, a molar ratio is about 9. In some embodiments, a molar ratio is about 10. In some embodiments, a molar ratio is about 2-5, 2-4 or 3-4 (e.g., for ETT). In some embodiments, a molar ratio is about 3.7 (e.g., for ETT). In some embodiments, a molar ratio is about 3-8, 4-8, 4-7, 4-6, 5-7, 5-8 or 5-6 (e.g., for CMIMT). In some embodiments, a molar ratio is about 5.8 (e.g., for CMIMT).

As appreciated by those skilled in the art, various suitable flowrates and reaction times may be utilized for oligonucleotide synthesis, and may be adjusted according to oligonucleotides to be prepared, scales, synthetic setups, etc. In some embodiments, a recycle flow rate utilized for synthesis is about 200 cm/h. In some embodiments, a recycle time is about 1-10 minutes. In some embodiments, a recycle time is about 8 minutes. In some embodiments, a recycle time is about 10 minutes.

Many technologies are available to modify P(III) linkages, e.g., after coupling. For example, various methods are available to convert a P(III) linkage to a P(V) P(=O)-type linkage, e.g., via oxidation. In some embodiments, $I_2$/Pyr/$H_2O$ is utilized. Similarly, many methods are available to convert a P(III) linkage to a P(V) P(=S)-type linkage, e.g., via sulfurization. In some embodiments, as illustrated herein, XH is utilized as a thiolation reagent. Technologies for converting P(III) linkages to P(V) P(=N—)-type linkages are also widely available and can be utilized in accordance with the present disclosure. In some embodiments, as illustrated herein ADIH is employed. Suitable reaction parameters are described herein. In some embodiments, ADIH is used at a concentration of about 0.01-0.5, 0.05-0.5, 0.1-0.5, 0.05, 0.1, 0.15, 0.2, 0.25, 0.3, 0.35, 0.4, 0.45 or 0.5 M. In some embodiments, concentration of ADIH is about 0.25 M. In some embodiments, concentration of ADIH is about 0.3 M. In some embodiments, ADIH is utilized at about 1-50, 1-40, 1-30, 1-25, 1-20, 1-10, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45 or 50 or more equivalent. In some embodiments, equivalent of ADIH is about 7.5. In some embodiments, equivalent of ADIH is about 10. In some embodiments, equivalent of ADIH is about 15. In some embodiments, equivalent of ADIH is about 20. In some embodiments, equivalent of ADIH is about 23. In some embodiments, equivalent of ADIH is about 25. In some embodiments, equivalent of ADIH is about 30. In some embodiments, equivalent of ADIH is about 35. In some embodiments, one experiment, ADIH was utilized at 15.2 equivalent, and 15 min contact time. In some embodiments, depending on amidites, concentrations, equivalents, contact times, etc. of reagents, e.g., ADIH, may be adjusted.

Technologies of the present disclosure are suitable for preparation at various scales. In some embodiments, synthesis is performed at hundreds of umol or more. In some embodiments, a scale is about 200 umol. In some embodiments, a scale is about 300 umol. In some embodiments, a scale is about 400 umol. In some embodiments, a scale is about 500 umol. In some embodiments, a scale is about 550 umol. In some embodiments, a scale is about 600 umol. In some embodiments, a scale is about 650 umol. In some embodiments, a scale is about 700 umol. In some embodiments, a scale is about 750 umol. In some embodiments, a scale is about 800 umol. In some embodiments, a scale is about 850 umol. In some embodiments, a scale is about 900 umol. In some embodiments, a scale is about 950 umol. In some embodiments, a scale is about 1, 2, 3, 4, 5, 6, 7, 8, 9, 10, 11, 12, 13, 14, 15, 16, 17, 18, 19, 20, 21, 22, 23, 24, or 25, or more mmol. In some embodiments, a scale is about 1 mmol or more. In some embodiments, a scale is about 2 mmol or more. In some embodiments, a scale is about 5 mmol or more. In some embodiments, a scale is about 10 mmol or more. In some embodiments, a scale is about 15 mmol or more. In some embodiments, a scale is about 20 mmol or more. In some embodiments, a scale is about 25 mmol or more.

In some embodiments, observed yields were 85-90 OD/umol (e.g., 85,000 OD/mmol for a 10.2 mmol synthesis, with 58.4% crude purity (% FLP)).

Technologies of the present disclosure, among other things, can provide various advantages when utilized for preparing oligonucleotides comprising chirally controlled internucleotidic linkages, e.g., those comprising P—N= wherein P is a linkage phosphorus (e.g., internucleotidic linkages of I-n-1, I-n-2, I-n-3, I-n-4, II, II-a-1, II-a-2, II-b-1, II-b-2, II-c-1, II-c-2, II-d-1, II-d-2, or a salt form thereof, etc.). For example, as demonstrated herein, technologies of the present disclosure can provide high crude purities and yields (e.g., in many embodiments, about 55-60% full-length product for a 20-mer oligonucleotide) with minimal amount of shorter oligonucleotides (e.g., from incomplete coupling, decomposition, etc.). Such high crude yields and/or purities, among other things, can significantly reduce downstream purification and can significantly reduce production cost and cost of goods, and in some embodiments, greatly facilitate or make possible large scale commercial production, clinical trials and/or commercial sales.

Example Procedure for Preparing Chirally Controlled Oligonucleotide Compositions—WV-13864.

Described below are example procedures for preparing WV-13864 using controlled pore glass (CPG) low bulk density solid support (e.g., 2'-fC (acetyl) via CNA linker CPG (600 Å LBD)). Useful phosphoramidites include 5'-ODMTr-2'-F-dA(N6-Bz)-(L)-DPSE phosphoramidite, 5'-ODMTr-2'-F-dC(N4-Ac)-(L)-DPSE phosphoramidite, 5'-ODMTr-2'-F-dG(N2-iBu)-(L)-DPSE phosphoramidite, 5'-ODMTr-2'-F-dU-(L)-DPSE phosphoramidite, 5'-ODMTr-2'-OMe-G($N^2$-iBu)-(L)-DPSE phosphoramidite, 5'-ODMTr-2'-F-dC(N4-Ac)-(L)-PSM phosphoramidite, 5'-ODMTr-2'-F-dG(N2-iBu)-(L)-PSM phosphoramidite, 5'-DMT-2'-OMe-A(Bz)-β-Cyanoethyl phosphoramidite, and 5'-DMT-2'-OMe-C(Ac)-β-Cyanoethyl phosphoramidite.

0.1 M Xanthane hydride solution (XH) was used for thiolation. Neutral PN linkages were formed utilizing 0.3 M of 2-azido-1,3-dimethyl-imidazolinium hexafluorophosphate (ADIH) in acetonitrile. Oxidation solution was 0.04-0.06 M iodine in pyridine/water, 90/10, v/v. Cap A was N-Methylimidazole in acetonitrile, 20/80, v/v. Cap B was acetic anhydride/2,6-Lutidine/Acetonitrile, 20/30/50, v/v/v. Deblocking was performed using 3% dichloroacetic acid in toluene. $NH_4OH$ used was 28-30% concentrated ammonium hydroxide.

Detritylation.

To initiate the synthesis, the 5'-ODMTr-2'-F-dC(N4-Ac)-CPG solid support was subjected to acid catalyzed removal of the DMTr protecting group from the 5'-hydroxyl by treatment with 3% (DCA) in toluene. The DMTr removal step was usually visualized with strong red or orange color and can be monitored by UV watch command at the wavelength of 436 nm.

DMTr removal can be repeated at the beginning of a synthesis cycle. In every case, following detritylation, the support-bound material was washed with acetonitrile in preparation for the next step of the synthesis.

Coupling.

Amidites were dissolved either in acetonitrile (ACN) or in 20% isobutyronitrile (IBN)/80% ACN at a concentration of 0.2M without density correction. The solutions were dried over molecular sieves (3 Å) not less than 4 h before use (15-20%, v/v).

Thiolation for DPSE Cycles.

Following Cap-1, phosphite intermediates, P(III), were modified with sulfurizing reagent. In an example preparation, 1.2 CV (6-7 equivalent) of sulfurizing reagent (0.1 M XH/pyridine-ACN, 1:1, v/v) was delivered through the synthetic column via flow through mode over 6 min contact time to form P(V).

Azide Reaction for PSM Cycles.

After Cap-1, a suitable reagent (e.g., comprising $—N_3$ such as ADIH), in ACN was used to form neutral internucleotidic linkages (PN linkages). In an example preparation, 10.3 eq. of 0.25 M ADIH over 10 min contact time for fG-L-PSM and 25.8 eq. of 0.3 M ADIH over 15 min contact time for fC-L-PSM were utilized in the respective cycles.

Oxidation for Standard Nucleotide Cycles.

Cap-1 step was not necessary for standard amidite cycle. After coupling of a standard amidite onto the solid support, the phosphite intermediate, P(III), was oxidized with 0.05 M of iodine/water/pyridine solution to form P(V). In an example preparation, 3.5 eq. of oxidation solution delivered to the column by a flow through mode over 2 min contact time for efficient oxidation.

Cap-2 (Capping-2, a Second Capping).

Coupling efficiency on the solid phase oligonucleotide synthesis for each cycle was approx. 97-100% and monitored by, e.g., release of DMTr cation. Residual uncoupled 5'-hydroxyl groups, typically 1-3% by detrit monitoring, on the solid support were blocked with Cap A (20% N-Methylimidazole in acetonitrile (NMI/ACN=20/80, v/v)) and Cap B(20%: 30%: 50%=$Ac_2O$: 2,6-Lutidine: ACN(v/v/v)) reagents (e.g., 1:1). Both reagents (e.g., 0.4 CV) were delivered to the column by flow through mode over 0.8 min contact time to prevent formation of failure sequences. Uncapped amine groups may also be protected in this step.

| Amidite | Solvent | Concentration | MS3Å |
|---|---|---|---|
| 5'-ODMTr-2'-OMe-A(N6-Bz)-CE | ACN | 0.2M | 15-20%, v/v |
| 5'-ODMTr-2'-OMe-C(N4-Ac)-CE | ACN | 0.2M | 15-20%, v/v |
| 5'-ODMTr-2'-F-dA(N6-Bz)-(L)-DPSE | ACN | 0.2M | 15-20%, v/v |
| 5'-ODMTr-2'-F-dC(N4-Ac)-(L)-DPSE | ACN | 0.2M | 15-20%, v/v |
| 5'-ODMTr-2'-F-dU-(L)-DPSE | 20% IBN/80% ACN | 0.2M | 15-20%, v/v |
| 5'-ODMTr-2'-F-dG(N2-iBu)-(L)-DPSE | ACN | 0.2M | 15-20%, v/v |
| 5'-ODMTr-2'-OMe-G(N2-iBu)-(L)-DPSE | 20% IBN/80% ACN | 0.2M | 15-20%, v/v |
| 5'-ODMTr-2'-F-dC(N4-Ac)-(L)-PSM | ACN | 0.2M | 15-20%, v/v |
| 5'-ODMTr-2'-F-dG(N2-iBu)-(L)-PSM | ACN | 0.2M | 15-20%, v/v |

Dual activators (CMIMT and ETT) coupling approach were utilized. Both activators were dissolved in ACN at a concentration of 0.5M. CMIMT has been used for chirally controlled coupling with CMIMT to amidite molar ratio of 5.833/l. ETT was used for the coupling of standard amidites (for natural phosphate linkages) with ETT to amidite molar ratio of 3.752/l. Recycle time for all DPSE and PSM amidites was 10 min except mG-L-DPSE which was 8 min. All standard amidites were coupled for 8 min.

Cap-1 (Capping-1, First Capping).

Cap B($Ac_2O$/2,6-lutidine/MeCN (2:3:5, v/v/v)) was used. In some embodiments, Cap-1 capped secondary amine groups, e.g., on the chrial auxiliaries. In some embodiments, incomplete protection of secondary amines may lead side reaction resulting in a failed coupling or formation of one or more by-products. In some embodiments, Cap-1 may not be an efficient condition for esterification (e.g., a condition less efficient than Cap-2 (the second capping) for capping unreacted 5'-OH).

As illustrated herein, in some embodiments, a DPSE amidite or DPSE cycle is Detritylation→Coupling→Cap-1 (Capping-1, first capping)→Thiolation→Cap-2 (Capping-1, Post-capping, second capping); in some embodiments, a PSM amidite or PSM cycle is Detritylation→Coupling→Cap-1 (Capping-1, first capping)→Azide reaction→Cap-2 (Capping-1, Post-capping, second capping); in some embodiments, a standard amidite or standard cycle (traditional, non-chirally controlled) is Detritylation→Coupling→Oxidation→Cap-2 (Capping-1, Post-capping, second capping).

Synthetic cycles were selected and repeated until the desired length was achieved.

Amine Wash.

In some embodiments, provided technologies are particularly effective for preparing oligonucleotides comprising internucleotidic linkages that comprise P—N═, wherein P is the linkage phosphorus. In some embodiments, provided technologies comprise contacting an oligonucleotide intermediate with a base. In some embodiments, a contact is performed after desired oligonucleotide lengths have been achieved. In some embodiments, such a contact provides an oligonucleotide comprising internucleotidic linkages that comprise P—N=, wherein P is the linkage phosphorus (e.g., those of formula I-n-1, I-n-2, I-n-3, I-n-4, II, II-a-1, II-a-2, II-b-1, II-b-2, II-c-1, II-c-2, II-d-1, II-d-2, or a salt form thereof). In some embodiments, a contact removes a chiral auxiliary (e.g., those with a $G^2$ that is connected to the rest of the molecule through a carbon atom, and the carbon atom is connected to at least one electron-withdrawing group (e.g., WV-CA-231, WV-CA-236, WV-CA-240, etc.)). In some embodiments, a contact is performed utilizing a base or a solution of a base which is substantially free of $OH^-$ or water (anhydrous). In some embodiments, a base is an amine (e.g., $N(R)_3$). In some embodiments, an amine has the structure of $NH(R)_2$, wherein each R is independently optionally substituted C1-6 aliphatic; in some embodiments, each R is independently optionally substituted C1-6 alkyl. In some embodiments, a base is N, N-diethylamine (DEA). In some embodiments, a base solution is 20% DEA/ACN. In some embodiments, such a contact with a base lowers levels of by-products which, at one or more locations of internucleotidic linkages that comprise P—N=, have instead natural phosphate linkages.

In an example preparation, an on-column amine wash was performed after completion of oligonucleotide nucleotide synthesis cycles, by five column volume of 20% DEA in acetonitrile over 15 min contact time.

In some embodiments, contact with a base may also remove 2-cyanoethyl group used for construction of standard natural phosphate linkage. In some embodiments, contact with a base provide a natural phosphate linkage (e.g., in a salt form in which the cation is the corresponding ammonium salt of the amine base).

Cleavage and Deprotection.

After contact with a base, oligonucleotides are exposed to further cleavage and deprotection. In an example preparation, auxiliary removal (e.g., DPSE), cleavage & deprotection was a two steps process. In step 1, CPG solid support with oligonucleotides was treated with 1×TEA-HF solution (DMSO: Water: TEA·3HF: TEA=43:8.6:2.8:1=v/v/v/v, 100±5 uL/umol) for 6=0.5 h at 27±2° C. The bulk slurry was then treated with concentrated ammonium hydroxide (28-30%, 200±10 mL/mmol) for 24±1 h at 37±2° C. (step 2) to release oligonucleotide from the solid support. Crude product was collected by filtration. Filtrates were combined with washes (e.g., water) of the solid support. In some embodiments, observed yields were about 80-90 OD/umole.

Example Procedure for Preparing Chirally Controlled Oligonucleotide Compositions—WV-13835.

In an example preparation, WV-13835 was prepared at a 1.2 mmol scale starting from CPG 2'-F-U. DPSE was utilized as chiral auxiliary for chirally controlled internucleotidic linkages. The preparation comprised multiple cycles comprising a de-blocking step (detritylation under an acidic condition), a coupling step (with a DPSE phosphoramidite), a pre-modification capping step (e.g., Cap B), a modification step (e.g., thiolation using 0.1M XH in Pyr/CAN), a post-modification capping step (e.g., under a cap 2 condition (1:1 Cap A+Cap B). In some embodiments, a cycle comprises a modification step which is or comprises oxidation with $I_2$/Pyr/$H_2O$. Cleavage and deprotection included two steps, wherein step one utilized TEA-HF at 100 mL/mmol and 27±2.5° C., and step 2 utilized conc. $NH_4OH$ at 200 mL/mmol and 37±2.5° C. Total crude yield was 91800 OD (76500 OD/mmol). Neat % FLP was 53.6% and NAP(after de-salting) % FLP was 58.3%. % FLP in crude was 1.71 g.

Example Procedure for Preparing Chirally Controlled Oligonucleotide Compositions—WV-14791.

In an example preparation, WV-14791 was prepared at a 402 umol scale starting from CPG 2'-F-U. DPSE was utilized as chiral auxiliary for chirally controlled phosphorothioate internucleotidic linkages, and PSM for chirally controlled n001. The preparation comprised multiple cycles comprising a de-blocking step (detritylation under an acidic condition), a coupling step (with a DPSE (for a chirally controlled phosphorothioate internucleotidic linkage) or PSM phosphoramidites (for a chirally controlled n001 internucleotidic linkage)), a pre-modification capping step (e.g., Cap B), a modification step (e.g., thiolation using 0.1M XH in Pyr/CAN for phosphorothioate internucleotidic linkages, 2-azido-1,3-dimethyl-imidazolinium hexafluorophosphate in CAN for n001), a post-modification capping step (e.g., under a cap 2 condition (1:1 Cap A+Cap B). In some embodiments, a cycle comprises a modification step which is or comprises oxidation with $I_2$/Pyr/$H_2O$. Total crude yield was 27000 OD (67.1 OD/umol). Neat % FLP was 45.7% and NAP(after de-salting) % FLP was 51.8%. % FLP in crude was 445 mg.

Example Procedure for Preparing Chirally Controlled Oligonucleotide Compositions—WV-14344.

In an example preparation, WV-14344 was prepared at a 400 umol scale starting from CPG 2'-F-C. DPSE was utilized as chiral auxiliary for chirally controlled phosphorothioate internucleotidic linkages, and PSM for chirally controlled n001. The preparation comprised multiple cycles comprising a de-blocking step (detritylation under an acidic condition), a coupling step (with a DPSE (for a chirally controlled phosphorothioate internucleotidic linkage) or PSM phosphoramidites (for a chirally controlled n001 internucleotidic linkage)), a pre-modification capping step (e.g., Cap B), a modification step (e.g., thiolation using 0.1M XH in Pyr/CAN for phosphorothioate internucleotidic linkages, 2-azido-1,3-dimethyl-imidazolinium hexafluorophosphate in CAN for n001), a post-modification capping step (e.g., under a cap 2 condition (1:1 Cap A+Cap B). In some embodiments, a cycle comprises a modification step which is or comprises oxidation with $I_2$/Pyr/$H_2O$. Total crude yield was 32000 OD (80 OD/umol). Neat % FLP was 48.8% and NAP(after de-salting) % FLP was 59.2%. % FLP in crude was 571 mg.

Example Preparation of Additional Chirally Controlled Oligonucleotide Compositions.

Various oligonucleotide compositions including chirally controlled oligonucleotide composition were prepared utilizing technologies described herein. In some embodiments, oligonucleotide compositions were prepared using automated solid-phase synthesis. Certain preparations were performed at 25 umol using TWIST™ columns 10 um/15 um column (GlenResearch, catalog #20-0040) filled with 325 mg of CNA linked nucleosides-CPG. Example cycles and azide modification reagents for chirally controlled internucleotidic linkages at 25 umol were shown below.

| Step | Operation | Reagents | Volume | Waiting time |
|---|---|---|---|---|
| 1 | Deblocking (detritylation) | 3% DCA/DCM | 10 mL | 1 min |
| 2 | Coupling | 0.2M monomer/MeCN | 0.5 mL | 8 min |
| | | 0.6M CMIMT/MeCN | 1 mL | |
| 3 | Pre-modification capping (cap-1) | Cap-B | 2 mL | 2 min |
| 4 | Modification | 0.2M XH/pyridine or | 2 mL | 6 min |
| | (sulfurization or azide reaction) | 0.5M azide reagent/MeCN | 2 mL | 10 min |
| 5 | Post-modification capping (cap-2) | Cap-A + Cap-B | 2 mL | 45 s |

| Final linkage | Azide Reagent |
|---|---|
| n001 | 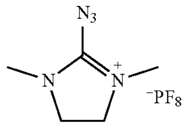 |
| n003 | 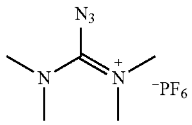 |
| n004 | 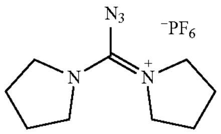 |
| n006 | 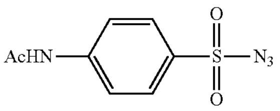 [SMILES: CC(=O)Nc1ccc(S(=O)(=O)N=[N+]=[N-])cc1] |
| n008 | 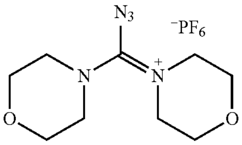 |

After cycles were completed, the CPG support was treated with 20% DEA in MeCN for 12 min, washed with dry MeCN and dried under argon and vacuum. The dried CPG support was transferred into a 15 mL plastic tube, treated with 1× solution (1M HF-TEA in $H_2O$-DMSO(1:5, v/v), 100 uL/umol) for 6 h at 28° C., then added conc. $NH_3$ (200 uL/umol) and reacted for 24 h at 37° C. The mixture was cooled to room temperature and the CPG was removed by membrane filtration, and the product was analyzed by LTQ and RP-UPLC with a linear gradient of MeCN (1-15%/15 min) in (10 mM TEA, 100 mM HFIP in water) at 55° C. at a rate of 0.8 mL/min. Crude oligonucleotides were purified by AEX-HPLC eluting with 20 mM NaOH to 2.5M NaCl, and desalted to obtain the target oligonucleotide compositions.

Example preparations were listed below, with crude UPLC purity ranging from about 9% to about 58% percent. Higher crude HPLC purities were observed for preparation of the same and/or other oligonucleotides.

| Oligonucleotide | Scale (umol) | Observed Mass |
|---|---|---|
| WV-16006 | 70 | 6912.3 |
| WV-16007 | 70 | 7068.9 |
| WV-24092 | 24 | 7282 |

-continued

| Oligonucleotide | Scale (umol) | Observed Mass |
|---|---|---|
| WV-24098 | 24 | 7237.1 |
| WV-24104 | 24 | 7399.1 |
| WV-24109 | 24 | 7355.1 |
| WV-25536 | 24 | 6729.1 |
| WV-25537 | 24 | 6705.2 |
| WV-25538 | 24 | 6739.1 |
| WV-25539 | 24 | 6702 |
| WV-25540 | 24 | 6726.9 |
| WV-25541 | 25 | 7012.6 |
| WV-25542 | 25 | 7014.1 |
| WV-25543 | 25 | 6989.9 |
| WV-25544 | 25 | 7024.2 |

Among other things, provided technologies provided high crude purities and/or yields. In many preparations (various scales, reagents concentrations, reaction times, etc.), about 55-60% crude purities (% FLP) were obtained, with minimal amount of shorter oligonucleotides (e.g., from incomplete coupling, decomposition, side-reactions, etc.). In many embodiments, amounts of the most significant shorter oligonucleotide are no more than about 2-10%, often no more than 2-4% (e.g., in some embodiments, as low as about 2% (the most significant shorter oligonucleotide being N-3)).

Various technologies are available for oligonucleotide purification and can be utilized in accordance with the present disclosure. In some embodiments, crude products were further purified (e.g., over 90% purity) using, e.g., AEX purification, and/or UF/DF.

Using technologies described herein, various oligonucleotides comprising diverse base sequences, modifications (e.g., nucleobase, sugar, and internucleotidic linkage modifications) and/or patterns thereof, linkage phosphorus stereochemistry and/or patterns thereof, etc. were prepared at various scales from umol to mmol. Such oligonucleotides have various targets and may function through various mechanisms. Certain such oligonucleotides were presented in the Tables of the present disclosure.

As appreciated by those skilled in the art, examples described herein are for illustration only. Those skilled in the art will appreciate that various conditions, parameters, etc. may be adjusted according to, e.g., instrumentation, scales, reagents, reactants, desired outcomes, etc. Certain results may be further improved using various technologies in accordance with the present disclosure. Among other things, provided oligonucleotides and compositions thereof can provide significantly improved properties and/or activities, e.g., in various assays and in vivo models, and may be particularly useful for preventing and/or treating various conditions, disorders or diseases. Certain data are provided in Examples herein.

Example 4G. Synthesis of Certain Reagents for Incorporation of Mod

As described in the present disclosure, oligonucleotide of the present disclosure may comprise various additional chemical moieties (e.g., various Mods) in addition to the oligonucleotide chain moiety. In some embodiments, the present disclosure provides oligonucleotide comprising a Mod described herein. In some embodiments, such additional moieties provide improved properties, activities, deliveries, etc. In some embodiments, the present disclosure provides useful additional chemical moieties, and technologies for preparing and incorporating such additional chemical moieties. Certain examples are described below. Those skilled in the art appreciates and various technologies related to additional chemical moieties (e.g., structures, preparations, incorporation, uses, etc.), e.g., those described in U.S. Pat. Nos. 9,394,333, 9,744,183, 9,605,019, 9,598,458, US 2015/0211006, US 2017/0037399, WO 2017/015555, WO 2017/192664, WO 2017/015575, WO 2017/062862, WO 2017/160741, WO 2017/192679, WO 2017/210647, WO 2018/223056, WO 2018/237194, WO 2019/055951, etc., such technologies of each of which are independently incorporated by reference, may be utilized in accordance with the present disclosure.

Synthesis of 5-((1,19-bis((1,3-dimethylimidazolidin-2-ylidene)amino)-10-((3-((3-((1,3-dimethylimidazolidin-2-ylidene)amino)propyl)amino)-3-oxopropoxy)methyl)-5,15-dioxo-8,12-dioxa-4,16-diazanonadecan-10-yl)amino)-5-oxopentanoic acid.

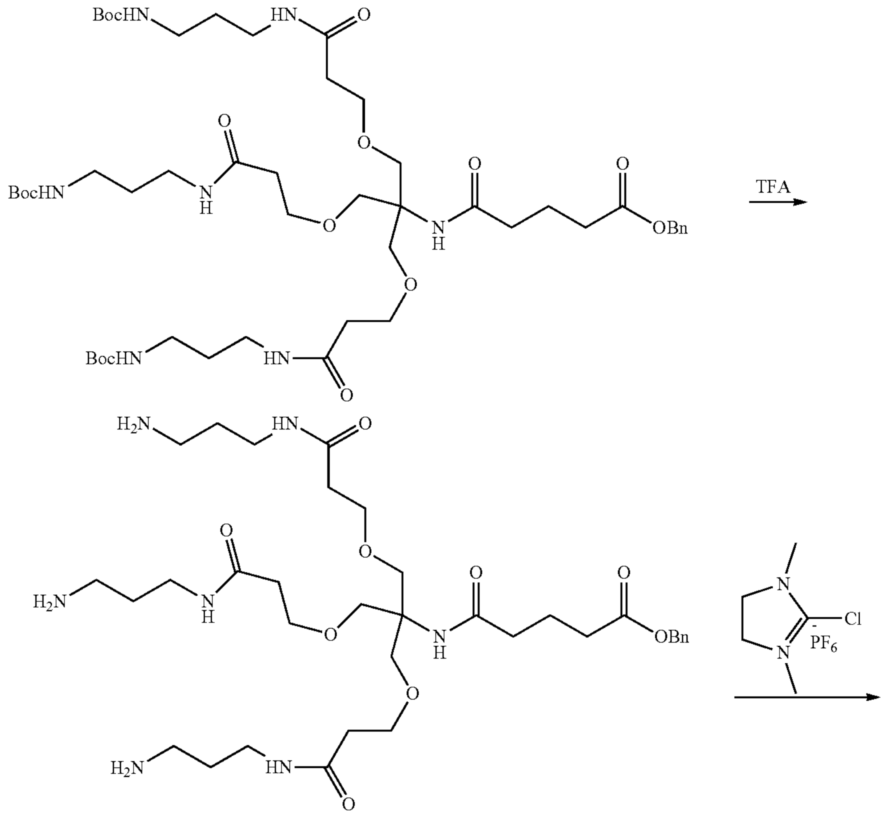

-continued

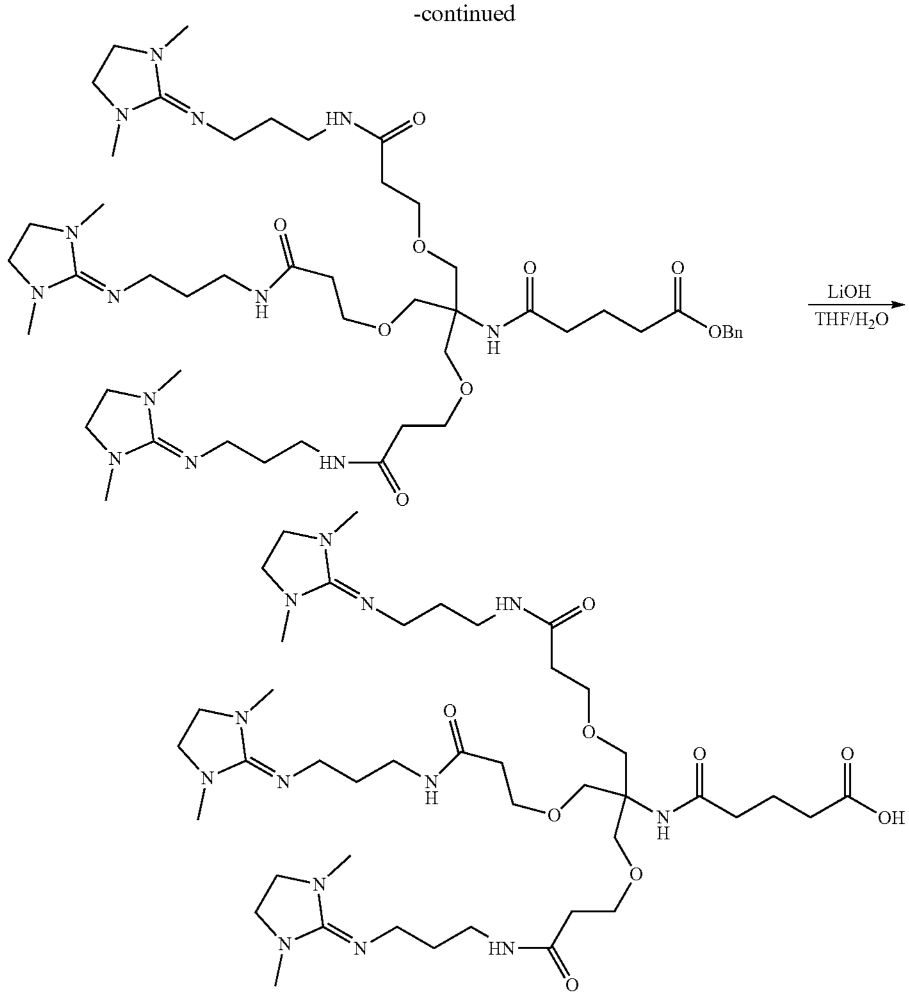

Step 1. To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (5 g, 4.95 mmol, 1 eq.) in DCM (50 mL) was added TFA (16.93 g, 148.48 mmol, 10.99 mL, 30 eq.) at 0° C. The mixture was stirred at 0-25° C. for 2 hr. The reaction mixture was concentrated under reduced pressure to remove solvent. Then added ACN(5 mL), and MTBE (40 mL), filtered the viscous liquid. The crude benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (5.21 g, crude, 3TFA) was obtained as a yellowish oil. LCMS: $(M+H^+)$: 710.6; $(M+Na^+)$: 732.7.

Step 2. To a solution of benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (5.21 g, crude, 3TFA) in DCM (35 mL) was added DIEA (6.39 g, 49.45 mmol, 8.61 mL, 10 eq.) and 2-chloro-1,3-dimethyl-4,5-dihydroimidazol-1-ium; hexafluorophosphate (4.55 g, 16.32 mmol, 3.3 eq.). The mixture was stirred at 25° C. for 15 hr. The reaction mixture was concentrated under reduced pressure to remove solvent. The crude was purified by RP-MPLC(Spec: C18, 330 g, 20~35 micron, 100 Å). The product benzyl 5-((1,19-bis((1,3-dimethylimidazolidin-2-ylidene)amino)-10-((3-((3-((1,3-dimethylimidazolidin-2-ylidene)amino)propyl)amino)-3-oxopropoxy)methyl)-5,15-dioxo-8,12-dioxa-4,16-diazanonadecan-10-yl)amino)-5-oxopentanoate (4.94 g, crude) was obtained as a yellow oil. $^1H$ NMR (400 MHz, METHANOL-$d_4$) δ=7.39-7.29 (m, 5H), 3.70-3.62 (m, 28H), 3.45 (q, J=6.6 Hz, 7H), 3.30-3.26 (m, 6H), 3.08-2.99 (m, 21H), 2.47-2.39 (m, 9H), 2.23 (t, J=7.4 Hz, 2H), 1.92-1.78 (m, 10H).

Step 3. To a solution of benzyl 5-((1,19-bis((1,3-dimethylimidazolidin-2-ylidene)amino)-10-((3-((3-((1,3-dimethylimidazolidin-2-ylidene)amino)propyl)amino)-3-oxopropoxy)methyl)-5,15-dioxo-8,12-dioxa-4,16-diazanonadecan-10-yl)amino)-5-oxopentanoate (2 g, 2.00 mmol, 1 eq.) in THF (10 mL) and $H_2O$ (2 mL) was added LiOH·$H_2O$ (588.51 mg, 14.02 mmol, 7 eq.). The mixture was stirred at 25° C. for 3 hr. The reaction mixture was concentrated under reduced pressure to remove solvent. The residue was purified by prep-HPLC(column: Phenomenex luna C18 250*50 mm*10 um; mobile phase: [water (0.1% TFA)-ACN]; B %: 0%-25%,20 min). 5-((1,19-bis((1,3-dimethylimidazolidin-2-ylidene)amino)-10-((3-((3-((1,3-dimethylimidazolidin-2-ylidene)amino)propyl)amino)-3-oxopropoxy)methyl)-5,15-dioxo-8,12-dioxa-4,16-diazanonadecan-10-yl)amino)-5-oxopentanoic acid (0.6 g, 651.84 umol, 32.54% yield, 98.66% purity) was obtained as a yellow gum. $^1H$ NMR (400 MHz, DMSO-$d_6$) δ=8.03 (br t, J=5.6 Hz, 3H), 7.75 (br t, J=5.6 Hz, 3H), 7.08 (s, 1H), 3.62-3.54 (m, 24H), 3.34 (q, J=6.6 Hz, 7H), 3.12 (q, J=6.2 Hz, 5H), 2.96 (s, 18H), 2.30 (br t, J=6.4 Hz, 6H), 2.23-2.03 (m, 4H), 1.79-1.59 (m, 8H); LCMS: $(M/2+H^+)$: 454.9; LCMS purity: 98.66%.

Synthesis of (E)-2-methyl-14,14-bis((E)-2-methyl-3-morpholino-9-oxo-12-oxa-2,4,8-triazatridec-3-en-13-yl)-3-morpholino-9,16-dioxo-12-oxa-2,4,8,15-tetraazaicos-3-en-20-oic acid.
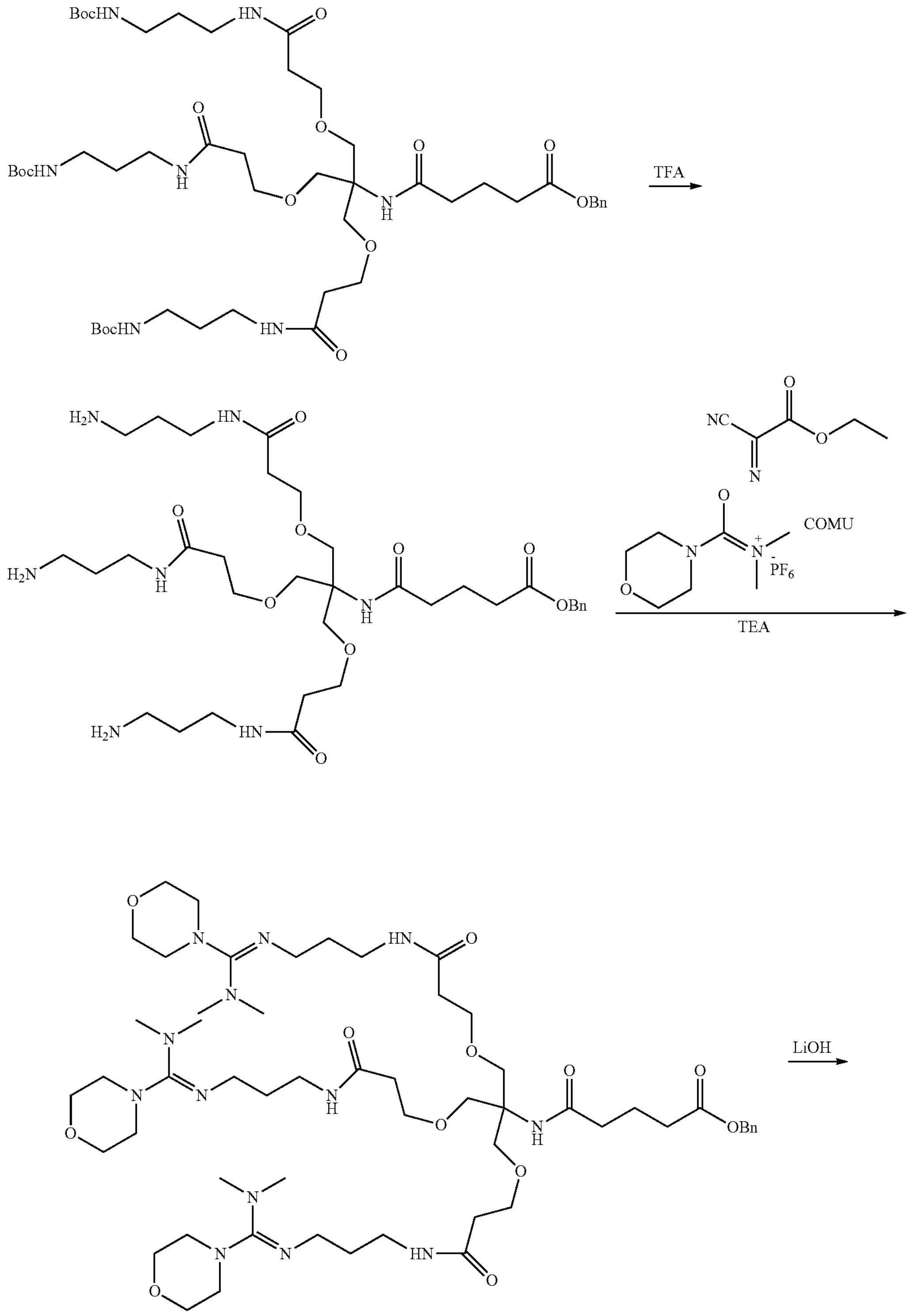

-continued

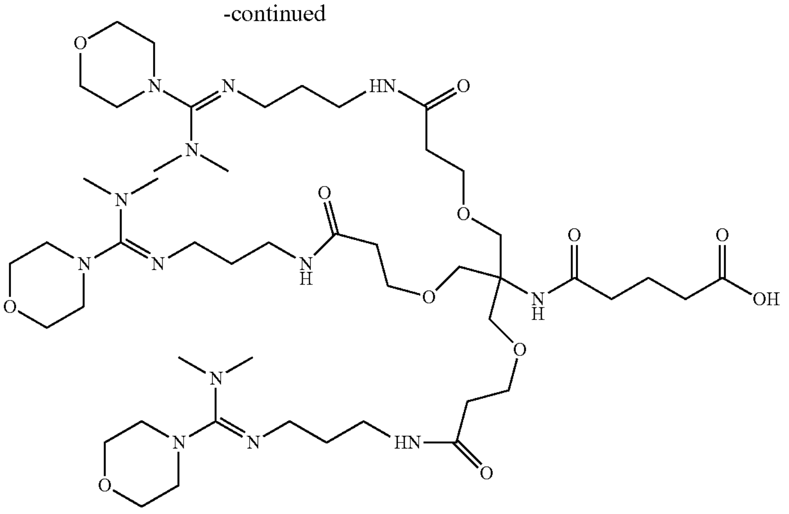

Step 1. To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (5 g, 4.95 mmol, 1 eq.) in DCM (50 mL) was added TFA (16.93 g, 148.48 mmol, 10.99 mL, 30 eq.). The mixture was stirred at 0-25° C. for 2 hr. The reaction mixture was concentrated under reduced pressure to remove solvent, then added ACN(50 mL), and MTBE (500 mL), filtered the viscous liquid. The crude benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (5.21 g, crude, 3TFA) was obtained as a yellow oil. LCMS: $(M+H^+)$: 710.6; $(M+Na^+)$: 732.5.

Step 2. To a solution of benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (3.86 g, 3.67 mmol, 1 eq., 3TFA) in DCM (35.1 mL) was added DIEA (4.73 g, 36.63 mmol, 6.38 mL, 10 eq.) and [[(Z)-(1-cyano-2-ethoxy-2-oxo-ethylidene)amino]oxy-morpholino-methylene]-dimethylammonium; hexafluorophosphate (5.18 g, 12.09 mmol, 3.3 eq.). The mixture was stirred at 25° C. for 15 hr. The reaction mixture was concentrated under reduced pressure to remove solvent. The crude was dissolved by ACN(15 mL) then input it into the reversed-phase column. The crude product was purified by reversed-phase HPLC(0.75% TFA in water, and acetonitrile). The crude compound benzyl (E)-2-methyl-14,14-bis((E)-2-methyl-3-morpholino-9-oxo-12-oxa-2,4,8-triazatridec-3-en-13-yl)-3-morpholino-9,16-dioxo-12-oxa-2,4,8,15-tetraazaicos-3-en-20-oate (4.14 g, crude) was obtained as a yellow oil. $^1H$ NMR (400 MHz, METHANOL-$d_4$) δ=7.43-7.24 (m, 5H), 3.78 (br s, 13H), 3.72-3.64 (m, 12H), 3.50-3.36 (m, 13H), 3.27 (br d, J=8.6 Hz, 11H), 3.11-2.97 (m, 18H), 2.50-2.42 (m, 8H), 2.26 (t, J=7.4 Hz, 2H), 1.93-1.78 (m, 8H).

Step 3. To a solution of benzyl (E)-2-methyl-14,14-bis((E)-2-methyl-3-morpholino-9-oxo-12-oxa-2,4,8-triazatridec-3-en-13-yl)-3-morpholino-9,16-dioxo-12-oxa-2,4,8,15-tetraazaicos-3-en-20-oate (2 g, 1.77 mmol, 1 eq.) in THF (1 mL) and $H_2O$ (0.2 mL) was added $LiOH \cdot H_2O$ (519.71 mg, 12.38 mmol, 7 eq.). The mixture was stirred at 25° C. for 3 hr. The reaction mixture was concentrated under reduced pressure to remove solvent. The residue was purified by prep-HPLC(Phenomenex luna C18 250*50 mm *10 um; mobile phase: [water (0.1% TFA)-ACN]; B %: 0%-20%, 20 min). The compound (E)-2-methyl-14,14-bis((E)-2-methyl-3-morpholino-9-oxo-12-oxa-2,4,8-triazatridec-3-en-13-yl)-3-morpholino-9,16-dioxo-12-oxa-2,4,8,15-tetraazaicos-3-en-20-oic acid (1.2 g, 1.14 mmol, 64.65% yield, 99.16% purity) was obtained as a yellow gum. $^1H$ NMR (400 MHz, DMSO-$d_6$) δ=7.99 (br s, 3H), 7.84 (br s, 3H), 7.06 (s, 1H), 3.67 (br s, 12H), 3.59-3.49 (m, 12H), 3.44-3.25 (m, 12H), 3.11 (br s, 12H), 3.02-2.81 (m, 17H), 2.31 (br t, J=6.1 Hz, 6H), 2.23-2.04 (m, 4H), 1.79-1.60 (m, 8H). LCMS: $(M/2+H^+)$: 521.0; LCMS purity: 99.16%.

Synthesis of(S)-3-(dimethylamino)-26-(3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-amido)-14,14-bis(3-(dimethylamino)-2-methyl-9-oxo-12-oxa-2,4,8-triazatridec-3-en-13-yl)-2-methyl-9,16,20,27-tetraoxo-12-oxa-2,4,8,15,21,28-hexaazatetratriacont-3-en-34-oic acid.

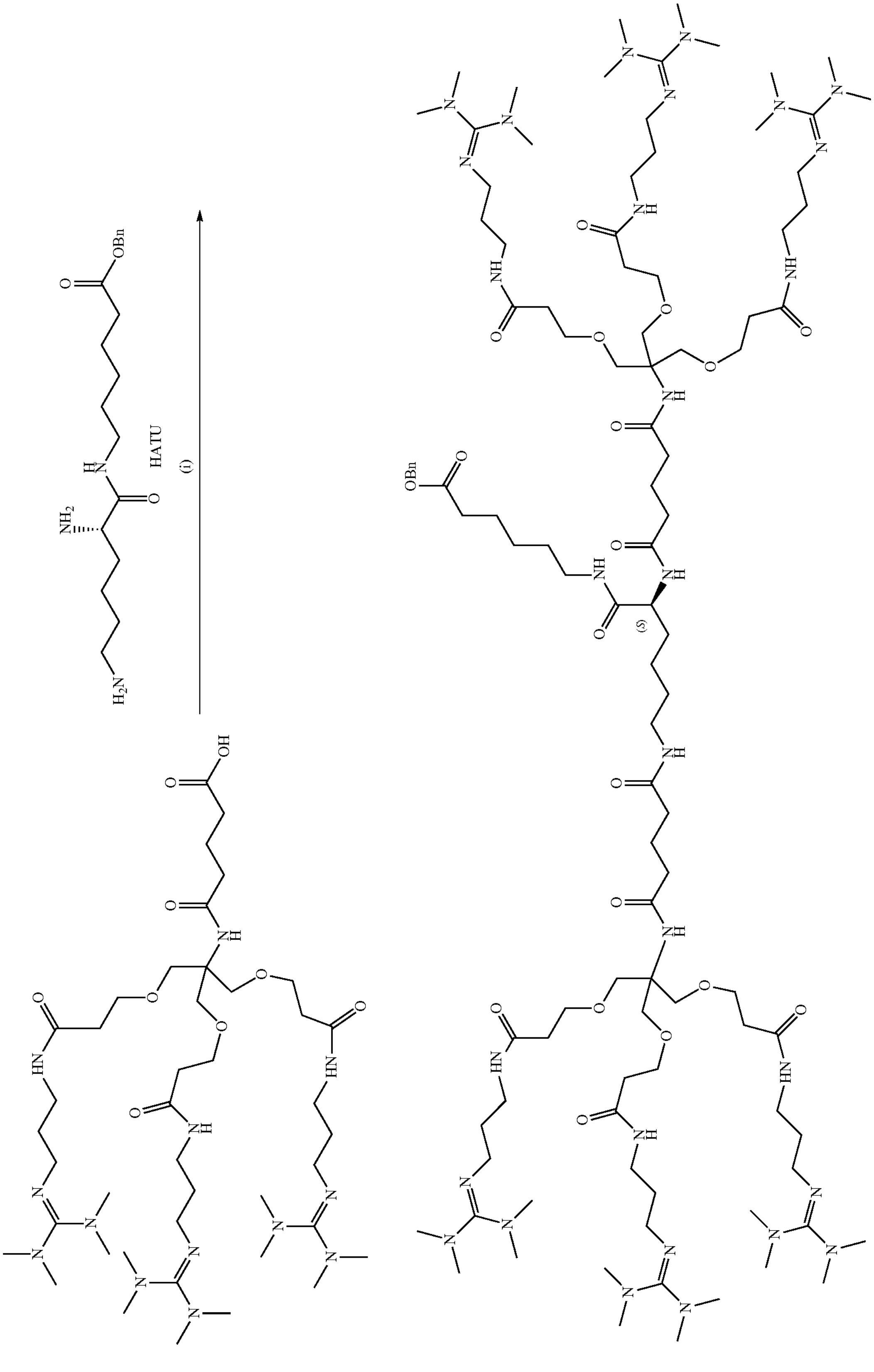
HATU
(i)

-continued
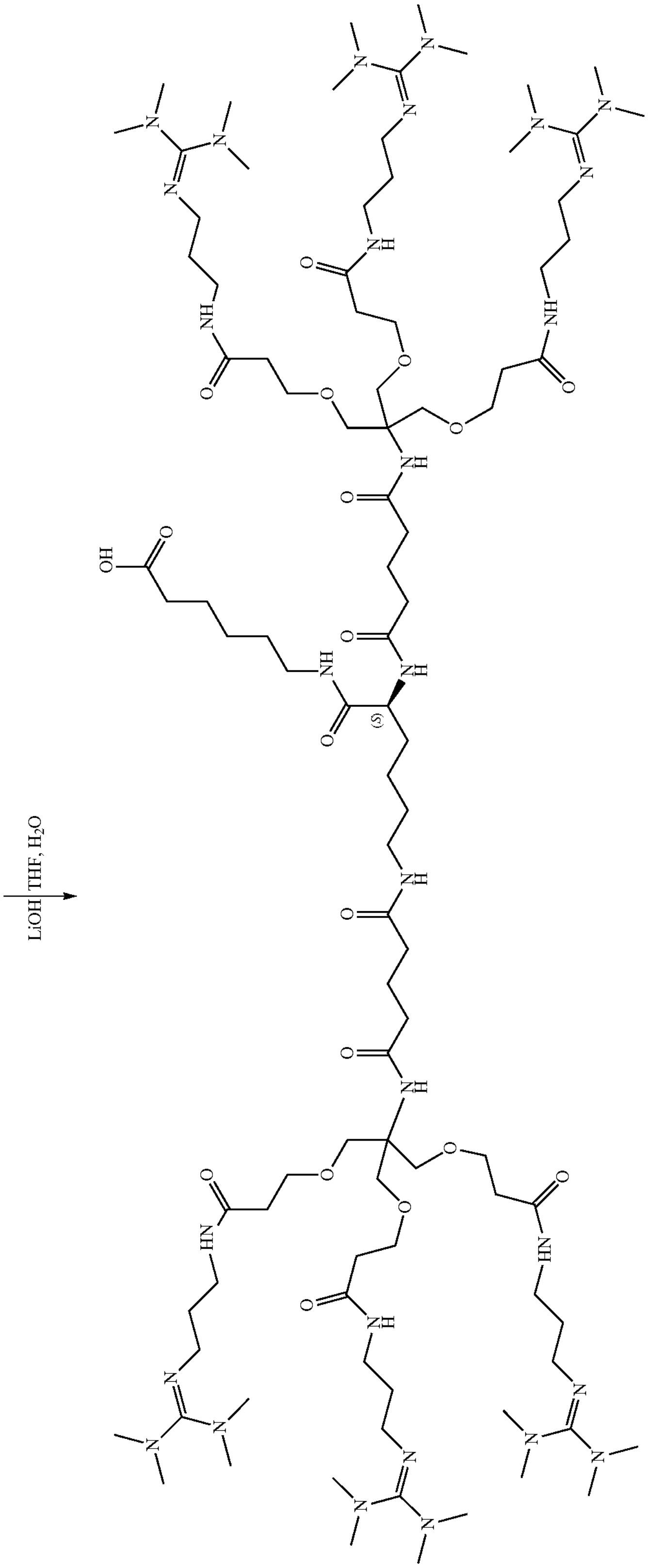

Step 1. To a solution of 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oic acid (10 g, 10.94 mmol, 5 eq.) in DMF (100 mL) was added DIPEA (2.83 g, 21.88 mmol, 3.81 mL, 10 eq.) and followed by benzyl(S)-6-(2,6-diaminohexanamido) hexanoate (924.07 mg, 2.19 mmol, 1 eq., 2HCl) and then to the mixture was dropwise added HATU (1.91 g, 5.03 mmol, 2.3 eq.) in DMF (10 mL) at 0° C. The reaction mixture was stirred at 25° C. for 12 hr. The mixture was concentrated in vacuo. The residue was purified by prep-HPLC(TFA condition). Column: Phenomenex luna C 18 250*50 mm *10 um; mobile phase: [water (0.1% TFA)-ACN]; B % $CH_3CN$: 10%-35%, 20 min. Benzyl(S)-3-(dimethylamino)-26-(3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-amido)-14,14-bis(3-(dimethylamino)-2-methyl-9-oxo-12-oxa-2,4,8-triazatridec-3-en-13-yl)-2-methyl-9,16,20,27-tetraoxo-12-oxa-2,4,8,15,21,28-hexaazatetratriacont-3-en-34-oate (3.7 g, crude) was obtained as a yellow oil. $^1$H NMR (400 MHz, CHLOROFORM-d) δ=8.01-7.77 (m, 10H), 7.63 (br t, J=4.9 Hz, 6H), 7.40-7.29 (m, 5H), 7.07 (br d, J=16.5 Hz, 2H), 5.08 (s, 2H), 4.18-4.07 (m, 1H), 3.63-3.46 (m, 24H), 3.10 (br dd, J-3.2, 5.1 Hz, 25H), 3.00-2.78 (m, 79H), 2.39-2.23 (m, 18H), 2.15-1.98 (m, 20H), 1.72-1.13 (m, 31H). LCMS: $M/4+H^+$ =536.5.

Step 2. To a solution of compound benzyl(S)-3-(dimethylamino)-26-(3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-amido)-14,14-bis(3-(dimethylamino)-2-methyl-9-oxo-12-oxa-2,4,8-triazatridec-3-en-13-yl)-2-methyl-9,16,20,27-tetraoxo-12-oxa-2,4,8,15,21,28-hexaazatetratriacont-3-en-34-oate (4.4 g, 2.05 mmol, 1 eq.) in THF (40 mL) and $H_2O$ (8 mL) was added $LiOH{\cdot}H_2O$ (603.45 mg, 14.38 mmol, 7 eq.). The mixture was stirred at 25° C. for 2 hr. The mixture was concentrated in vacuo. The residue was purified by prep-HPLC(TFA condition). Column: Phenomenex luna C 18 250*50 mm*10 um; mobile phase: [water (0.1% TFA)-ACN]; B %: 2%-30%, 20 min. Compound(S)-3-(dimethylamino)-26-(3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-amido)-14,14-bis(3-(dimethylamino)-2-methyl-9-oxo-12-oxa-2,4,8-triazatridec-3-en-13-yl)-2-methyl-9,16,20,27-tetraoxo-12-oxa-2,4,8,15,21,28-hexaazatetratriacont-3-en-34-oic acid (1.4 g, 678.84 umol, 33.04% yield, 99.483% purity) was obtained as a yellow oil. $^1$H NMR (400 MHz, DMSO-$d_6$) δ=8.00 (br t, J=5.5 Hz, 6H), 7.91 (br t, J=5.6 Hz, 1H), 7.87-7.79 (m, 2H), 7.67 (br t, J=4.8 Hz, 5H), 7.15-7.01 (m, 2H), 4.17-4.10 (m, 1H), 3.70-3.43 (m, 24H), 3.16-3.06 (m, 24H), 3.05-2.75 (m, 76H), 2.30 (br t, J=6.4 Hz, 12H), 2.18 (t, J=7.4 Hz, 2H), 2.15-1.98 (m, 8H), 1.66 (quin, J=6.6 Hz, 17H), 1.48 (quin, J=7.4 Hz, 3H), 1.41-1.31 (m, 4H), 1.28-1.17 (m, 4H). $^{13}$C NMR (101 MHz, DMSO-$d_6$) δ=174.85, 172.67, 172.61, 172.40, 172.19, 170.87, 161.50, 158.77 (q, J=35.2 Hz, 1C), 118.06, 115.15, 68.72, 67.84, 60.03, 53.08, 42.36, 38.87, 38.78, 36.40, 35.95, 35.88, 35.81, 35.25, 34.91, 34.08, 29.85, 29.40, 29.19, 26.34, 24.63, 23.47, 22.14. LCMS: $M/3+H^+$=684.7, purity: 99.48%.

Synthesis of (S)-6-(4-(4-(N-((2-amino-4-oxo-3,4-dihydropteridin-6-yl)methyl)-2,2,2-trifluoroacetamido)benzamido)-5-methoxy-5-oxopentanamido) hexanoic acid

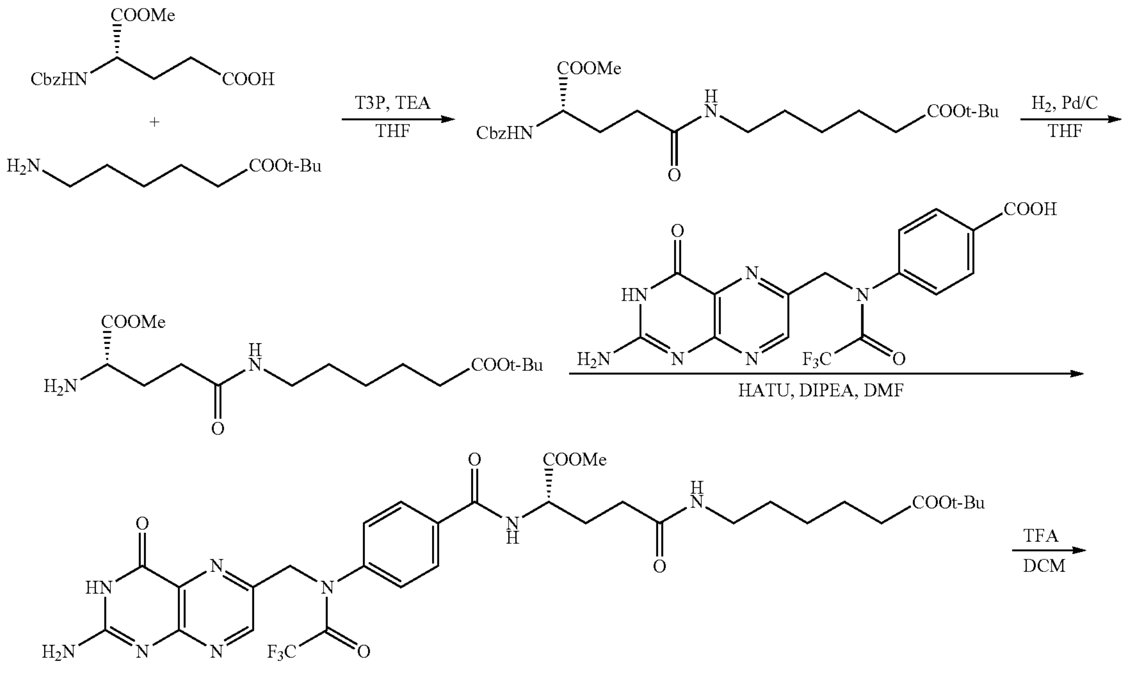

-continued

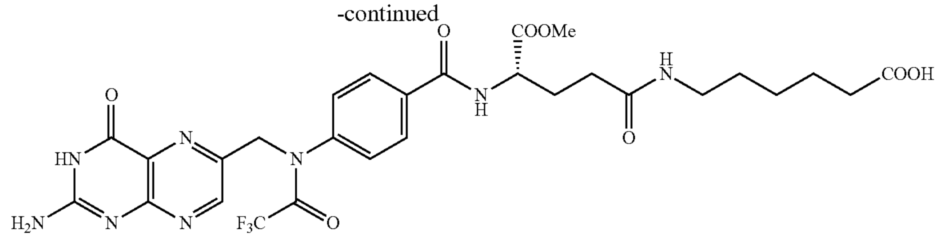

Step 1. To a solution of (S)-4-(((benzyloxy)carbonyl)amino)-5-methoxy-5-oxopentanoic acid (14 g, 47.41 mmol, 1 eq.) in THF (150 mL) was added TEA (14.39 g, 142.23 mmol, 19.80 mL, 3 eq.), followed by tert-butyl 6-aminohexanoate 6-aminohexanoate (11.54 g, 61.63 mmol, 1.3 eq.) at 0-5° C. and stirred for 0.5 hour. T3P(60.34 g, 94.82 mmol, 56.39 mL, 50% purity, 2 eq.) was added to the mixture at 0-5° C. and stirred at 20-25° C. for 12 hours. TLC(Petroleum ether/Ethyl acetate=1:1, $R_f$=0.35) showed that the starting material was consumed completely. The mixture was concentrated under reduced pressure to remove the solvent, and then re-dissolved with ethyl acetate (100 mL). The organic phase was washed by saturated aq. $NaHCO_3$ (50 mL×3) and dried over anhydrous $Na_2SO_4$. The crude product was purified by MPLC ($SiO_2$, Petroleum ether/Ethyl acetate=1:1) to obtain tert-butyl (S)-6-(4-(((benzyloxy)carbonyl)amino)-5-methoxy-5-oxopentanamido)hexanoate (19.7 g, crude) as yellow oil.

Step 2. A mixture of tert-butyl (S)-6-(4-(((benzyloxy)carbonyl)amino)-5-methoxy-5-oxopentanamido)hexanoate (15 g, 32.29 mmol, 1 eq.) and Pd/C(10 g, 10% purity) in THF (300 mL) was evacuated in vacuo and backfilled with $H_2$ (15 Psi) three times, then stirred at 20-25° C. for 6 hours. TLC(Petroleum ether/Ethyl acetate=1:1, $R_f$=0) showed that the starting material was consumed completely. The mixture was filtered and concentrated under reduced pressure to remove the most solvent. The crude product was used for the next step without any purification. tert-butyl (S)-6-(4-amino-5-methoxy-5-oxopentanamido)hexanoate (10.67 g, 31.42 mmol, 97.31% yield, 97.303% purity) was obtained as colorless liquid (in solvent). LCMS: M+H$^+$=331.2, purity: 97.70%.

Step 3. To a mixture of 4-(N-((2-Amino-4-oxo-3,4-dihydropteridin-6-yl)-methyl)-2,2,2-trifluoroacetamido) benzoic acid (8.28 g, 25.06 mmol, 1.1 eq.) and DIPEA (8.83 g, 68.33 mmol, 11.90 mL, 3 eq.) in DMSO (20 mL) was added HATU (8.66 g, 22.78 mmol, 1 eq.) and tert-butyl (S)-6-(4-amino-5-methoxy-5-oxopentanamido)hexanoate at 20-25° C. and stirred for 12 hours. The mixture was diluted with $H_2O$ (20 mL) and extracted with ethyl acetate (20 mL×3). The organic phase was concentrated under reduced pressure to remove the solvent. The crude product was purified by MPLC ($SiO_2$, Methanol/Ethyl acetate=2:5) to obtain tert-butyl (S)-6-(4-(4-(N-((2-amino-4-oxo-3,4-dihydropteridin-6-yl)methyl)-2,2,2-trifluoroacetamido)benzamido)-5-methoxy-5-oxopentanamido)hexanoate (26.2 g, crude) as brown gum. LCMS: M+H$^+$=721.2.

Step 4. To a solution of tert-butyl (S)-6-(4-(4-(N-((2-amino-4-oxo-3,4-dihydropteridin-6-yl)methyl)-2,2,2-trifluoroacetamido)benzamido)-5-methoxy-5-oxopentanamido)hexanoate (13.1 g, 11.39 mmol, 1 eq.) in DCM (100 mL) was added TFA (7.79 g, 68.35 mmol, 5.06 mL, 6 eq.) at 0-5° C. and the mixture was stirred at 35-40° C. for 12 hours. The mixture was concentrated under reduced pressure to remove the solvent. The crude product was detected by HPLC and purified by prep-HPLC(column: Phenomenex luna C18 250*50 mm*10 um; mobile phase: [water (0.05% HCl)-ACN]; B %: 15%-35%, 20 min) to obtain (S)-6-(4-(4-(N-((2-amino-4-oxo-3,4-dihydropteridin-6-yl)methyl)-2,2,2-trifluoroacetamido)benzamido)-5-methoxy-5-oxopentanamido) hexanoic acid (1.51 g, 1.88 mmol, 32.96% yield, 82.627% purity). $^1$H NMR (400 MHz, DMSO-$d_6$) δ=8.92 (br d, J-7.1 Hz, 1H), 8.74 (s, 1H), 7.93 (br d, J=8.4 Hz, 3H), 7.83 (br t, J=5.5 Hz, 1H), 7.66 (br d, J=8.3 Hz, 2H), 5.18 (s, 2H), 5.06-4.52 (m, 3H), 4.45-4.32 (m, 1H), 3.63 (s, 2H), 3.00 (q, J=6.2 Hz, 2H), 2.25-2.13 (m, 4H), 2.12-2.03 (m, 1H), 1.99-1.87 (m, 1H), 1.46 (quin, J=7.5 Hz, 2H), 1.35 (td, J=7.4, 14.9 Hz, 2H), 1.27-1.15 (m, 2H). $^{13}$C NMR (101 MHz, DMSO-$d_6$) δ=174.91, 172.83, 171.50, 166.02, 159.47, 153.27, 149.15, 142.22, 134.71, 129.15, 128.99, 128.64, 54.27, 52.97, 52.38, 38.79, 34.05, 32.16, 29.29, 26.76, 26.40, 24.66. LCMS: M+H$^+$=665.2.

Example 5. Synthesis of N6-stearoyl-N2-(4-sulfamoylbenzoyl)-L-lysine

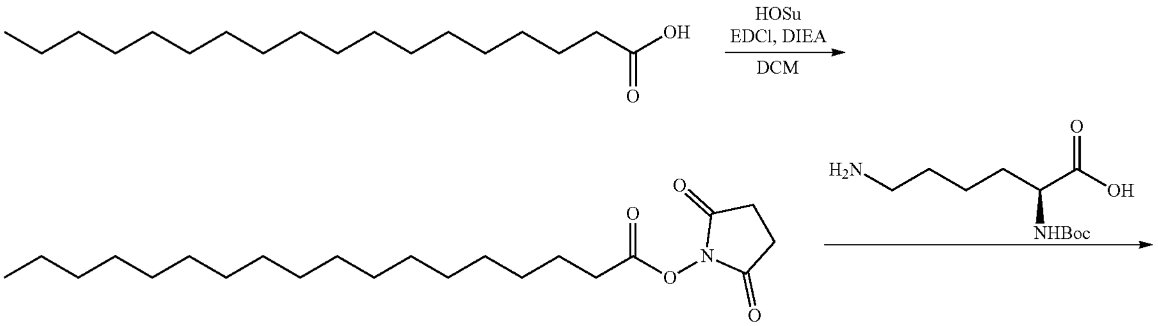

-continued

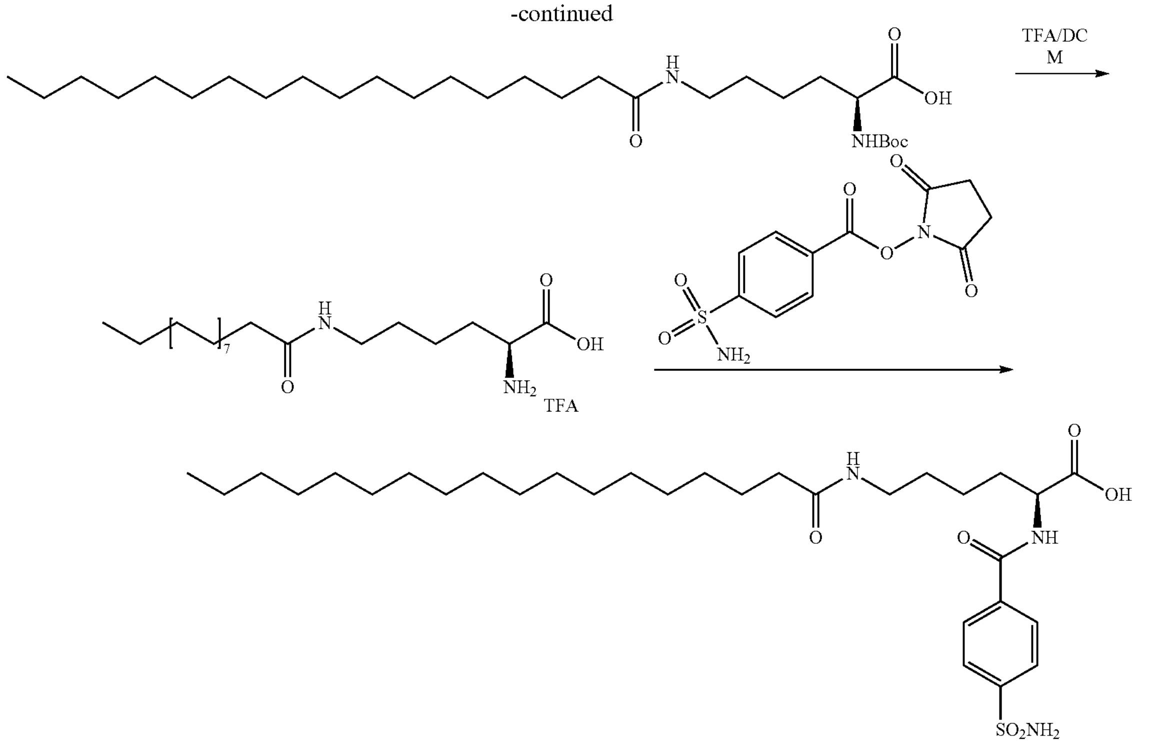

Step 1. To a solution of stearic acid (8.00 g, 28.12 mmol) in DCM (210 mL) was added 1-hydroxypyrrolidine-2,5-dione (3.24 g, 28.12 mmol) followed by EDCI (5.39 g, 28.12 mmol) at 15° C. The mixture was stirred at 15° C. for 21 hr. TLC showed part of stearic acid remained. Additionally added 1-hydroxypyrrolidine-2,5-dione (0.32 g) and EDCI (1.07 g). Stirring was continued at 15° C. for 8 hr. TLC showed the reaction was completed. The solvent was evaporated under reduced pressure. The residue was dissolved in DCM (300 mL) and the solution washed with water (200 mL); the aqueous phase was then back-extracted with DCM (2*100 mL). The combined organic phase was dried ($MgSO_4$) and the solvent evaporated under reduced pressure to yield 2,5-dioxopyrrolidin-1-yl stearate as a white solid. No further purification. The crude product 2,5-dioxopyrrolidin-1-yl stearate (10.70 g, crude) was used into the next step without further purification. TLC(Petroleum ether: Ethyl acetate=1:1)$R_f$=0.79.

Step 2. To a solution of (tert-butoxycarbonyl)-L-lysine (4.49 g, 18.24 mmol) and 2,5-dioxopyrrolidin-1-yl stearate (5.80 g, 15.20 mmol) in DMF (20 mL) was added DIPEA (5.89 g, 45.60 mmol, 7.96 mL). The mixture was stirred at 20° C. for 20 hour. TLC and LCMS showed the reaction was completed. The resulting mixture was concentrated to dry under reduced pressure. The residue was combined with 9 g crude compound, partitioned between water (200 mL) and EtOAc (300 mL) and DCM (80 mL). The separated aqueous layer was extracted with EtOAc (300 mL*3). The combined organic layers were washed with water (100 mL*2), dried over anhydrous $MgSO_4$, filtered and concentrated to afford the product as a white solid (14.5 g). The crude product compound $N^2$-(tert-butoxycarbonyl)-$N^6$-stearoyl-L-lysine (7.70 g, crude) was used into the next step without further purification. $^1H$ NMR (400 MHz, CHLOROFORM-d) δ=11.29 (br s, 1H), 7.97 (s, 1H), 5.88 (br s, 1H), 5.24 (br d, J=7.3 Hz, 1H), 4.21 (br d, J=5.1 Hz, 1H), 3.17 (q, J=6.5 Hz, 2H), 2.11 (t, J=7.6 Hz, 2H), 1.79 (br s, 1H), 1.64 (dt, J=7.9, 14.0 Hz, 1H), 1.58-1.42 (m, 4H), 1.41-1.28 (m, 11H), 1.18 (br s, 29H), 0.81 (t, J=6.7 Hz, 3H); LCMS: (M+$Na^+$): 535.3; TLC(Petroleum ether: Ethyl acetate=1:1)$R_f$=0.01.

Step 3. To a solution of $N^2$-(tert-butoxycarbonyl)-$N^6$-stearoyl-L-lysine (12.50 g, 24.38 mmol) in DCM (120 mL) was added TFA (46.20 g, 405.20 mmol, 30 mL). The mixture was stirred at 15° C. for 4.5 hr. LCMS showed the reaction was almost completed. The resulting mixture was concentrated under reduced pressure on a rotary evaporator with water pump to give a gray crude solid. The crude product compound $N^6$-stearoyl-L-lysine (12.80 g, crude, TFA salt) was used into the next step without further purification. $^1H$ NMR (400 MHz, DMSO-$d_6$) δ=8.19 (br s, 3H), 7.77-7.65 (m, 1H), 3.88 (br d, J=4.9 Hz, 1H), 3.02 (br d, J=5.5 Hz, 2H), 2.03 (br t, J=7.3 Hz, 2H), 1.75 (br s, 2H), 1.56-1.34 (m, 6H), 1.24 (s, 28H), 0.86 (br t, J=6.4 Hz, 3H); LCMS: (M+$H^+$): 413.3.

Step 4. To a solution of compound $N^6$-stearoyl-L-lysine (5.00 g, 9.49 mmol, TFA salt) in DMF (150 mL) was added compound 2,5-dioxopyrrolidin-1-yl 4-sulfamoylbenzoate (3.98 g, 13.34 mmol) followed by DIPEA (9.40 g, 72.73 mmol, 12.70 mL). The mixture was stirred at 80° C. for 18 hr. LCMS showed the reaction was completed. The resulting mixture was concentrated under reduced pressure until 20 mL residue mixture left. To the residue was added DCM (80 mL) and petroleum ether (50 mL). After stood for 36 hr at 15° C., the precipitated solid was filtered and dried to give the product as a light yellow solid (1.9 g). The filtrate was concentrated to dry and triturated with ACN(100 mL), filtered and the filter cake was dried to give a crude (2.4 g). The filtrate was concentrated to give an oil messy crude. No further purification. $N^6$-stearoyl-N2-(4-sulfamoylbenzoyl)-L-lysine (1.90 g, 33.60% yield) was obtained as a light yellow solid. $^1H$ NMR (400 MHz, DMSO-$d_6$) δ 13.19-11.82 (m, 1H), 8.74 (br d, J=5.7 Hz, 1H), 8.04 (br d, J=6.6 Hz, 2H), 7.91 (br d, J=7.1 Hz, 2H), 7.74 (br s, 1H), 7.49 (br s, 2H), 4.35 (br s, 1H), 3.02 (br s, 2H), 2.02 (br s, 2H), 1.80 (br s, 2H), 1.23 (br s, 31H), 0.86 (br s, 3H); $^{13}C$ NMR (101 MHz, DMSO-$d_6$) δ 174.06, 172.39, 165.94, 146.85, 137.28, 128.54, 125.99, 53.24, 38.55, 35.88, 31.76, 30.69, 29.50, 29.41, 29.24, 29.18, 25.78, 23.72, 22.55, 14.39; LCMS: (M+$H^+$): 596.4, purity: 89.89%.

Example 6. Synthesis of 18-oxo-18-((4-sulfamoylphenethyl)amino)octadecanoic acid

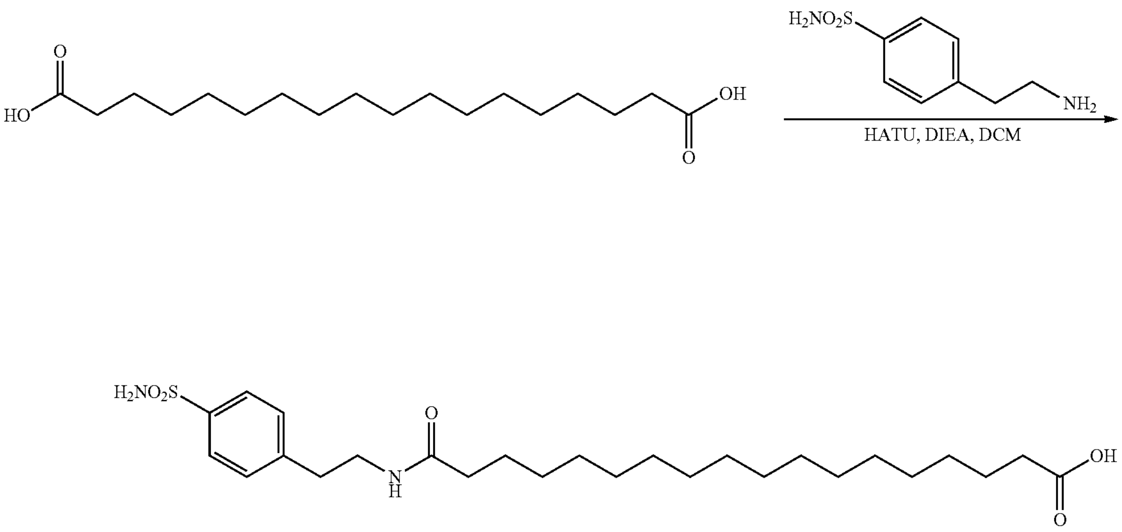

To a solution of octadecanedioic acid (4.90 g, 15.58 mmol) and 4-(2-aminoethyl)benzenesulfonamide (3.12 g, 15.58 mmol) in DCM (50 mL) was added HATU (7.11 g, 18.70 mmol) and DIPEA (6.04 g, 46.74 mmol, 8.16 mL). The mixture was stirred at 10° C. for 16 hours. The resulting mixture was concentrated under reduced pressure to give a residue. The residue was washed by $CH_3CN$(100 mL*2) to give the crude product (11 g) as white solid. 1 g crude was dissolved by DMSO/DMF (V/V=3:1, 20 mL) purified by prep-HPLC(column: Phenomenex luna C18 250*50 mm*10 um; mobile phase: [water (0.1% TFA)-ACN]; B %: 45%-75%,20 min) to give 40 mg product as a white solid. 10 g crude was added $CH_3CN/H_2O$ (V/V=4:1, 100 mL) and stayed at ultrasonic instrument for 30 min, then filtered to give filter cake, filter cake was washed by petroleum ether (20 mL) and acetone (20 mL). Filter cake was concentrated under reduced pressure to give 6 g product as a yellow solid. Compound 18-oxo-18-((4-sulfamoylphenethyl)amino) octadecanoic acid (6.00 g, 77.53% yield) was obtained as a yellow solid. $^1H$ NMR (400 MHz, DMSO-$d_6$) δ=7.86 (br t, J-5.3 Hz, 1H), 7.71 (d, J=8.2 Hz, 2H), 7.35 (d, J=7.9 Hz, 2H), 7.27 (s, 2H), 3.26 (q, J=6.6 Hz, 3H), 2.75 (br t, J=7.2 Hz, 2H), 2.15 (t, J=7.3 Hz, 1H), 2.00 (br t, J=7.3 Hz, 2H), 1.44 (br d, J=6.6 Hz, 4H), 1.21 (s, 23H), 1.06 (d, J=6.6 Hz, 3H). LCMS: (M+$H^+$): 497.3, purity 67.72%.

Example 7. Synthesis of 1,7,14-trioxo-12,12-bis((3-oxo-3-((3-(4-sulfamoylbenzamido)propyl)amino) propoxy)methyl)-1-(4-sulfamoylphenyl)-10-oxa-2,6,13-triazaoctadecan-18-oic acid

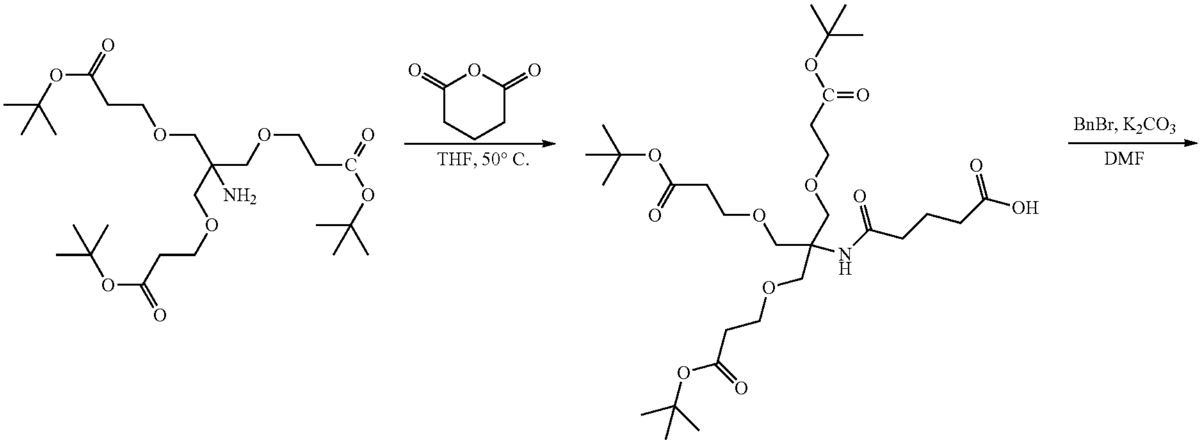

-continued
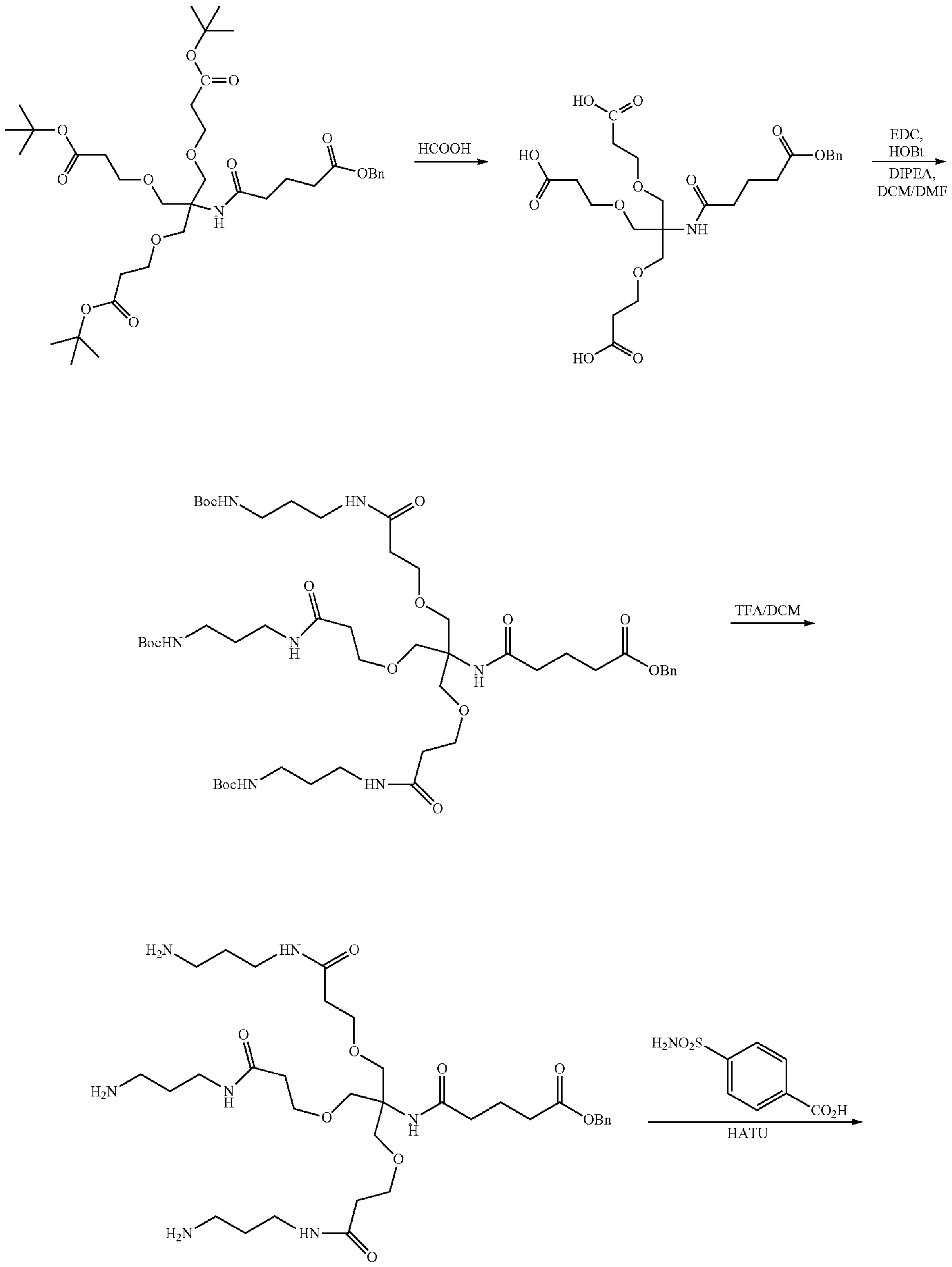

-continued

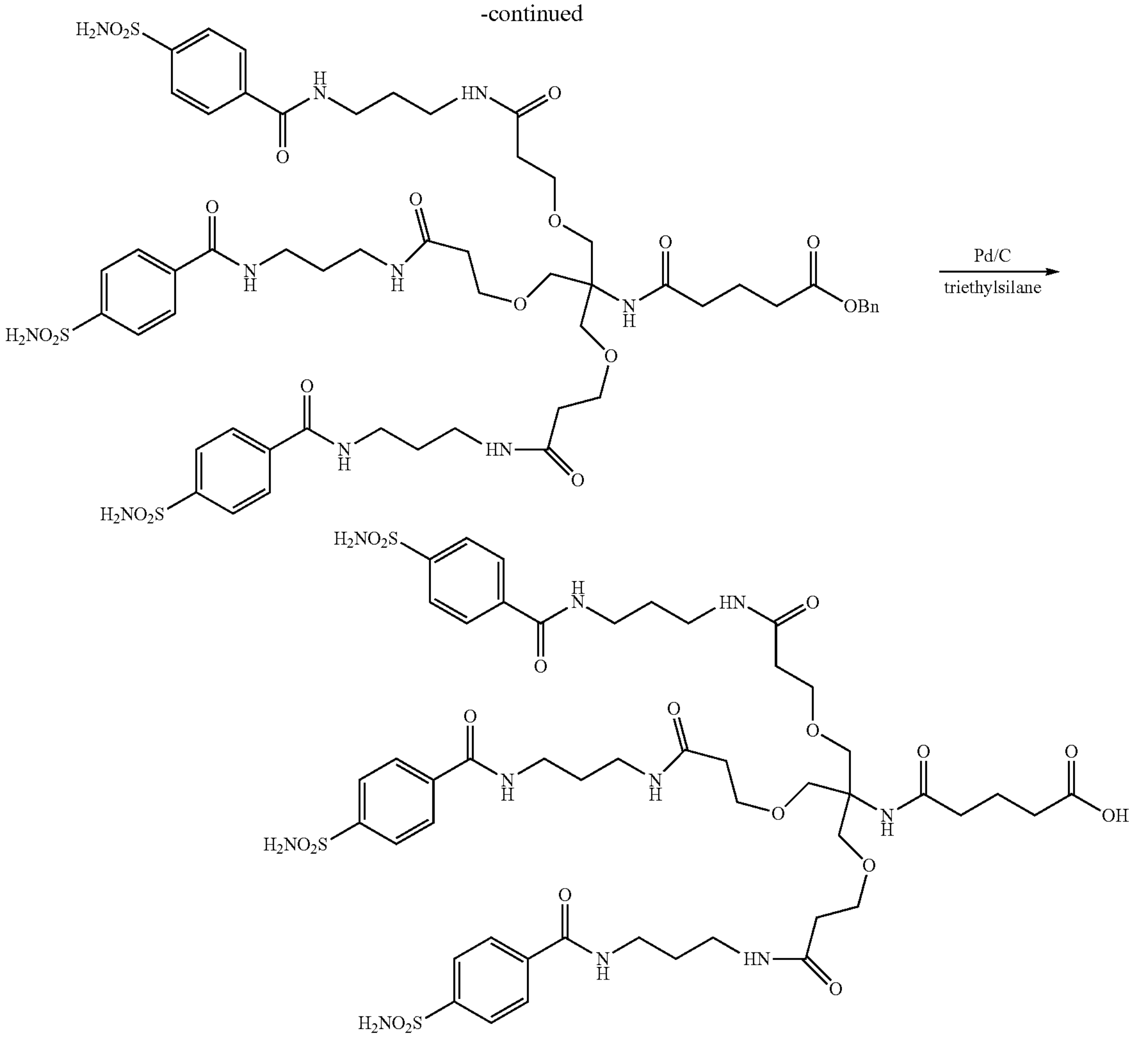

Step 1. A solution of di-tert-butyl 3,3'-((2-amino-2-((3-(tert-butoxy)-3-oxopropoxy)methyl)propane-1,3-diyl)bis(oxy))dipropanoate (4.0 g, 7.91 mmol) and dihydro-2H-pyran-2,6(3H)-dione (0.903 g, 7.91 mmol) in THF (40 mL) was stirred at 50° C. for 3 hrs and at rt for 3 hrs. LC-MS showed desired product. Solvent was evaporated to give 5-((9-((3-(tert-butoxy)-3-oxopropoxy)methyl)-2,2,16,16-tetramethyl-4,14-dioxo-3,7,11,15-tetraoxaheptadecan-9-yl)amino)-5-oxopentanoic acid, which was directly used for next step without purification.

Step 2. To a solution of 5-((9-((3-(tert-butoxy)-3-oxopropoxy)methyl)-2,2,16,16-tetramethyl-4,14-dioxo-3,7,11,15-tetraoxaheptadecan-9-yl)amino)-5-oxopentanoic acid (4.90 g, 7.91 mmol) and (bromomethyl)benzene (1.623 g, 9.49 mmol) in DMF was added anhydrous $K_2CO_3$ (3.27 g, 23.73 mmol). The mixture was stirred at 40° C. for 4 hrs and at room temperature for overnight. Solvent was evaporated under reduced pressure. The reaction mixture was diluted with EtOAc, washed with water, dried over anhydrous sodium sulfate, concentrated under reduced pressure to give a residue, which was purified by ISCO eluting with 10% EtOAc in hexane to 50% EtOAc in hexane to give di-tert-butyl 3,3'-((2-(5-(benzyloxy)-5-oxopentanamido)-2-((3-(tert-butoxy)-3-oxopropoxy)methyl)propane-1,3-diyl)bis(oxy))dipropanoate (5.43 g, 7.65 mmol, 97% yield) as a colorless oil. $^1$H NMR (400 MHz, Chloroform-d) δ 7.41-7.28 (m, 5H), 6.10 (s, 1H), 5.12 (s, 2H), 3.72-3.60 (m, 12H), 2.50-2.38 (m, 8H), 2.22 (t, J=7.3 Hz, 2H), 1.95 (p, J=7.4 Hz, 2H), 1.45 (s, 27H); MS (ESI), 710.5 $(M+H)^+$.

Step 3. A solution of di-tert-butyl 3,3'-((2-(5-(benzyloxy)-5-oxopentanamido)-2-((3-(tert-butoxy)-3-oxopropoxy)methyl)propane-1,3-diyl)bis(oxy))dipropanoate (5.43 g, 7.65 mmol) in formic acid (50 mL) was stirred at room temperature for 48 hrs. LC-MS showed the reaction was not complete. Solvent was evaporated under reduced pressure. The crude product was re-dissolved in formic acid (50 mL) and was stirred at room temperature for 6 hrs. LC-MS showed the reaction was complete. Solvent was evaporated under reduced pressure, co-evaporated with toluene (3×) under reduced pressure, and dried under vacuum to give 3,3'-((2-(5-(benzyloxy)-5-oxopentanamido)-2-((2-carboxyethoxy)methyl)propane-1,3-diyl)bis(oxy))dipropanoic acid (4.22 g, 7.79 mmol, 100% yield) as a white solid. $^1$H NMR (500 MHz, DMSO-$d_6$) δ 12.11 (s, 3H), 7.41-7.27 (m, 5H), 6.97 (s, 1H), 5.07 (s, 2H), 3.55 (d, J=6.4 Hz, 6H), 2.40 (t, J=6.3 Hz, 6H), 2.37-2.26 (m, 2H), 2.08 (t, J=7.3 Hz, 2H), 1.70 (p, J=7.4 Hz, 2H); MS (ESI), 542.3 $(M+H)^+$.

Step 4. A solution of 3,3'-((2-(5-(benzyloxy)-5-oxopentanamido)-2-((2-carboxyethoxy)methyl)propane-1,3-diyl)bis(oxy))dipropanoic acid (4.10 g, 7.57 mmol) and HOBt (4.60 g, 34.1 mmol) in DCM (60 mL) and DMF (15 mL) at 0° C. was added tert-butyl (3-aminopropyl) carbamate (5.94 g, 34.1 mmol), EDAC HCl salt (6.53 g, 34.1 mmol) and DIPEA (10.55 ml, 60.6 mmol). The reaction mixture was stirred at 0° C. for 15 minutes and at room temperature for 20 hrs. LC-MS showed the reaction was not complete. EDAC HCl salt (2.0 g) and tert-butyl (3-aminopropyl) carbamate (1.0 g) was added into the reaction mixture. The reaction mixture was stirred at room temperature for 4 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold catridge) eluting with DCM to 30% MeOH in DCM to give benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate 5 (6.99 g, 6.92 mmol, 91% yield) as a white solid. $^1$H NMR (500 MHz, Chloroform-d) δ 7.35 (t, J=4.7 Hz, 5H), 6.89 (s, 3H), 6.44 (s, 1H), 5.22 (d, J=6.6 Hz, 3H), 5.12 (s, 2H), 3.71-3.62 (m, 12H), 3.29 (q, J=6.2 Hz, 6H), 3.14 (q, J=6.5 Hz, 6H), 2.43 (dt, J=27.0, 6.7 Hz, 8H), 2.24 (t, J=7.2 Hz, 2H), 1.96 (p, J=7.5 Hz, 2H), 1.69-1.59 (m, 6H), 1.43 (d, J=5.8 Hz, 27H); MS (ESI): 1011.5 $(M+H)^+$.

Step 5. A solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (1.84 g, 1.821 mmol) in DCM (40 mL) was added 2,2,2-trifluoroacetic acid (7.02 ml, 91 mmol). The reaction mixture was stirred at room temperature for overnight. Solvent was evaporated to give benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate as a colorless oil. MS (ESI), 710.6 $(M+H)^+$.

Step 6. To a solution of 4-sulfamoylbenzoic acid (1.466 g, 7.28 mmol) and HATU (2.77 g, 7.28 mmol) in DCM (40 mL) followed by benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (1.293 g, 1.821 mmol) in DMF (4.0 mL). The mixture was stirred at room temperature for 5 hrs. Solvent was evaporated under reduced pressure to give a residue, which was purified by ISCO (40 g gold column) eluting with DCM to 50% MeOH in DCM to give benzyl 1,7,14-trioxo-12,12-bis((3-oxo-3-((3-(4-sulfamoylbenzamido)propyl)amino)propoxy)methyl)-1-(4-sulfamoylphenyl)-10-oxa-2,6,13-triazaoctadecan-18-oate (0.36 g, 0.286 mmol, 16% yield). $^1$H NMR (400 MHz, DMSO-$d_6$) δ 8.60 (t, J=5.6 Hz, 3H), 7.96-7.81 (m, 15H), 7.44 (s, 6H), 7.35-7.23 (m, 5H), 7.04 (s, 1H), 5.02 (s, 2H), 3.50 (t, J=6.9 Hz, 6H), 3.48 (s, 6H), 3.23 (q, J=6.6 Hz, 6H), 3.06 (q, J=6.6 Hz, 6H), 2.29 (t, J=7.4 Hz, 2H), 2.24 (t, J=6.5 Hz, 6H), 2.06 (t, J=7.4 Hz, 2H), 1.69-1.57 (m, 8H).

Step 7. To a round bottom flask flushed with Ar was added 10% Pd/C (80 mg, 0.286 mmol) and EtOAc (15 mL). A solution of benzyl 1,7,14-trioxo-12,12-bis((3-oxo-3-((3-(4-sulfamoylbenzamido)propyl)amino)propoxy)methyl)-1-(4-sulfamoylphenyl)-10-oxa-2,6,13-triazaoctadecan-18-oate (360 mg) in methanol (15 mL) was added followed by diethyl(methyl)silane (0.585 g, 5.72 mmol) dropwise. The mixture was stirred at room temperature for 3 hrs. LC-MS showed the reaction was complete, diluted with EtOAc, and filtered through celite, washed with 20% MeOH in EtOAc, concentrated under reduced pressure to give 1,7,14-trioxo-12,12-bis((3-oxo-3-((3-(4-sulfamoylbenzamido)propyl)amino)propoxy)methyl)-1-(4-sulfamoylphenyl)-10-oxa-2,6,13-triazaoctadecan-18-oic acid (360 mg, 100% yield) as a white solid. $^1$H NMR (400 MHz, DMSO-$d_6$) δ 8.60 (t, J=5.6 Hz, 3H), 7.94-7.81 (m, 15H), 7.44 (s, 6H), 7.04 (s, 1H), 3.50 (t, J=6.9 Hz, 6H), 3.48 (s, 6H), 3.23 (q, J=6.6 Hz, 6H), 3.06 (q, J=6.6 Hz, 6H), 2.24 (t, J=6.4 Hz, 6H), 2.14 (t, J=7.5 Hz, 2H), 2.05 (t, J=7.4 Hz, 2H), 1.66-1.57 (m, 8H); MS (ESI), 1170.4 $(M+H)^+$.

Example 8. Synthesis of 2,5-dioxopyrrolidin-1-yl 4-oxo-4-((4-sulfamoylphenethyl)amino)butanoate

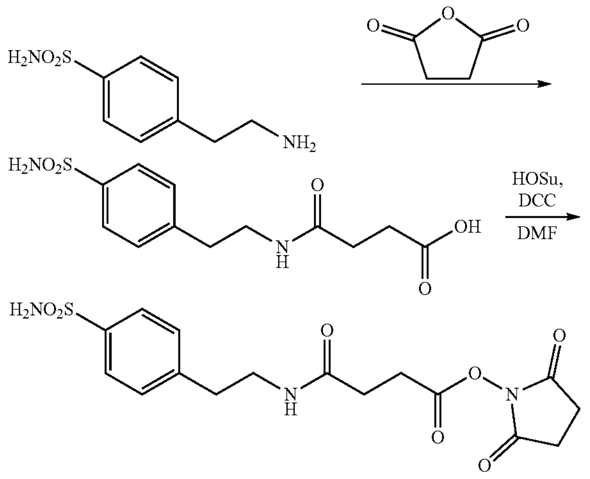

Step 1. A solution of 4-(2-aminoethyl)benzenesulfonamide (20 g, 99.87 mmol), tetrahydrofuran-2,5-dione (9.99 g, 99.87 mmol) in THF (200 mL) was stirred at 60° C. for 16 hr. The reaction mixture was diluted with HCl (aq., 1 M, 100 mL) and extracted with EtOAc (200 mL*3). The combined organic layers were washed with brine (100 mL*2), dried over $Na_2SO_4$, filtered and concentrated under reduced pressure to give 4-oxo-4-((4-sulfamoylphenethyl)amino)butanoic acid (17 g, 55.60 mmol, 55.67% yield, 98.228% purity) was obtained as a white solid. $^1$H NMR (400 MHz, DMSO-$d_6$) δ=7.94 (t, J=5.7 Hz, 1H), 7.72 (d, J=7.9 Hz, 2H), 7.37 (d, J=8.3 Hz, 2H), 3.30-3.20 (m, 2H), 2.75 (t, J=7.2 Hz, 2H), 2.53-2.44 (m, 4H), 2.44-2.35 (m, 3H), 2.32-2.23 (m, 2H). LCMS: $(M+H^+)$: 301.1.

Step 2. To a solution of 4-oxo-4-((4-sulfamoylphenethyl)amino)butanoic acid (17 g, 56.60 mmol) and HOSu (10.42 g, 90.57 mmol) in DMF (200 mL) was added DCC(18.69 g, 90.57 mmol, 18.32 mL) at 0° C.-5° C. The mixture was stirred at 0-5° C. for 16 hr. LCMS showed the reaction was not complete. The mixture was stirred at 15° C. for 16 hr. LCMS showed the reaction was complete and one main peak with desired MS was detected. The white suspension of N,N'-dicyclohexylurea (DCU) was filtered and removed white solid. The filtrate was concentrated to an oil. This crude product was washed with hot 2-propanol (60 mL*3), affording an off-white solid. The crude product was added THF (100 mL), and Petroleum ether (50 mL) and stirred for 30 min, then filtered to give 2,5-dioxopyrrolidin-1-yl 4-oxo-4-((4-sulfamoylphenethyl)amino)butanoate (8 g, 16.58 mmol, 29.29% yield, 82.36% purity) as a white solid. $^1$H NMR (400 MHz, DMSO-$d_6$) δ=8.12-7.96 (m, 1H), 7.71 (br d, J=7.9 Hz, 2H), 7.37 (br d, J=8.2 Hz, 2H), 3.58 (br t, J=6.7 Hz, 1H), 3.30-3.21 (m, 2H), 2.89-2.70 (m, 8H), 2.58 (s, 1H), 2.42 (br t, J=6.7 Hz, 2H); LCMS: $(M+H^+))$: 398.0, LCMS purity: 82.36%.

Example 9. Synthesis of 4-oxo-4-((4-sulfamoylphenyl)amino)butanoic acid

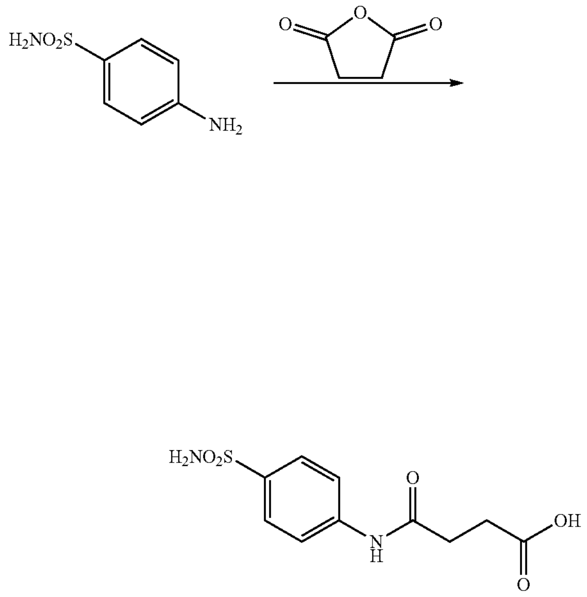

To a solid reagent of 4-aminobenezensulfonamide (2.0 g, 11.61 mmol) and tetrahydofuran-2,5-dione (1.16 g, 11.61 mmol) was added THF (30 mL). The reaction mixture was stirred at 60° C. for 4 hrs, and white solid precipitated out. The reaction mixture was cooled to room temperature, and filtered to give a white solid. The white solid was dried under vacuum to give 4-oxo-4-(4-sulfamoylanilino)butanoic acid (2.115 g, 67% yield). $^{1}$H NMR (400 MHz, DMSO-$d_6$) δ 10.31 (s, 1H), 7.74 (s, 4H), 7.23 (s, 2H), 2.65-2.51 (m, 4H).

Example 10. Synthesis of 3-(((4-nitrophenoxy)carbonyl)oxy)propyl stearate

Step 1. A mixture of propane-1,3-diol (9.80 g, 128.75 mmol, 9.33 mL), Pyridine (2.61 g, 33.01 mmol, 2.66 mL) in $CHCl_3$ (50 mL) was degassed and purged with $N_2$ for 3 times, and then the mixture was dropwised stearoyl chloride (10 g, 33.01 mmol) in $CHCl_3$ (50 mL) at 0° C. and stirred at 20° C. for 20 hr under $N_2$ atmosphere. The mixture was extracted with EtOAc (50 mL*2), and the combined organic layers were washed with 1N HCl (50 mL*2), aq. $NaHCO_3$ (50 mL*2), $H_2O$ (50 mL), dried over $Na_2SO_4$, filtered and concentrated under reduced pressure to give a residue. The residue was purified by column chromatography ($SiO_2$, Ethyl acetate/Petroleum ether=2%, 12.5%) to afford 3-hydroxypropyl stearate (9 g) as a white gum. $^{1}$H NMR (400 MHz, DMSO-$d_6$) δ=4.24 (t, J=6.06 Hz, 2H), 3.69 (t, J=5.95 Hz, 2H), 2.31 (t, J=7.50 Hz, 2H), 1.87 (q, J=6.06 Hz, 2H), 1.56-1.68 (m, 2H), 1.22-1.31 (m, 24H), 0.88 (t, J=6.73 Hz, 3H); TLC(Petroleum ether: Ethyl acetate=3:1) $R_f$=0.54.

Step 2. A mixture of 3-hydroxypropyl stearate (9 g, 26.27 mmol), TEA (3.99 g, 39.41 mmol, 5.49 mL) in DCM (160 mL) was dropwised the solution of 4-nitrophenyl carbonochloridate (6.35 g, 31.53 mmol) in DCM (20 mL), then degassed and purged with $N_2$ for 3 times at 0° C., and then the mixture was stirred at 20° C. for 16 hr under $N_2$ atmosphere. TLC indicated compound was consumed completely and many new spots formed. The reaction was clean according to TLC. The reaction mixture was concentrated under reduced pressure to remove solvent. The residue was purified by column chromatography ($SiO_2$, Ethyl acetate/Petroleum ether=0%, 5%) to afford 3-(((4-nitrophenoxy)carbonyl)oxy)propyl stearate (5.73 g, 11.29 mmol, 42.96% yield) as an off-white solid. $^{1}$H NMR (400 MHz, CHLOROFORM-d) δ=8.29 (d, J=9.21 Hz, 2H), 7.39 (d, J=9.21 Hz, 2H), 4.39 (t, J=6.36 Hz, 2H), 4.24 (t, J=6.14 Hz, 2H), 2.32 (t, J=7.45 Hz, 2H), 2.11 (t, J=6.36 Hz, 2H), 1.57-1.68 (m, 2H), 1.21-1.32 (m, 28H), 0.88 (t, J=6.80 Hz, 3H); $^{13}$C NMR (101 MHz, CHLOROFORM-d) δ=173.73, 155.44, 152.40, 145.37, 125.30, 121.74, 66.00, 60.22, 34.21, 31.91, 29.68, 29.67, 29.64, 29.60, 29.30, 27.92, 24.91, 22.69, 14.12; TLC(Petroleum ether: Ethyl acetate=3:1)$R_f$=0.72.

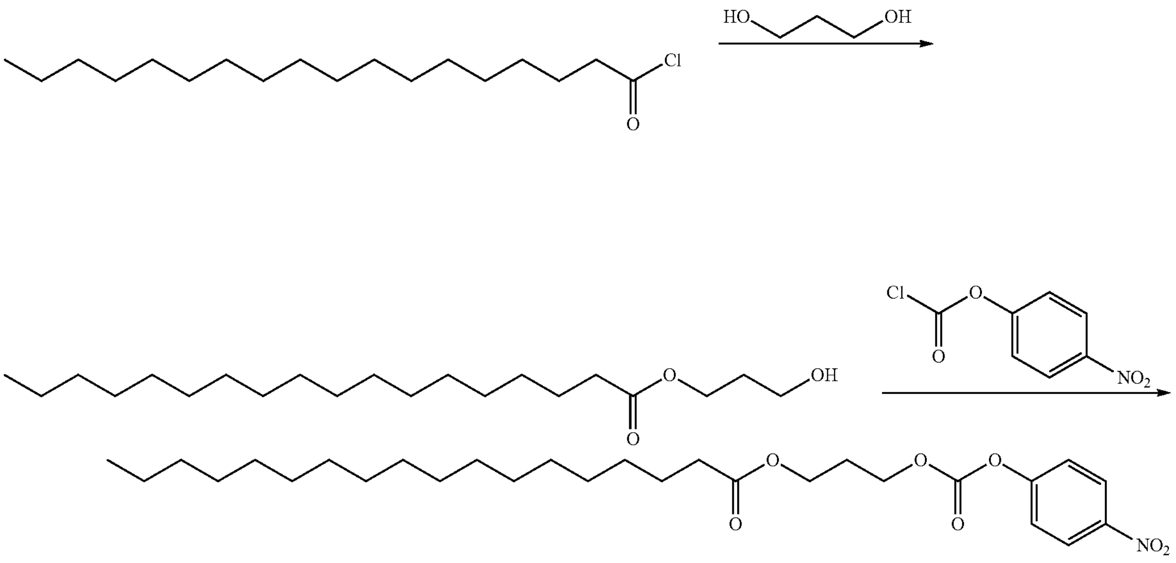

Example 11. Synthesis of (R)-3-(((4-nitrophenoxy)carbonyl)oxy)propane-1,2-diyl didodecanoate

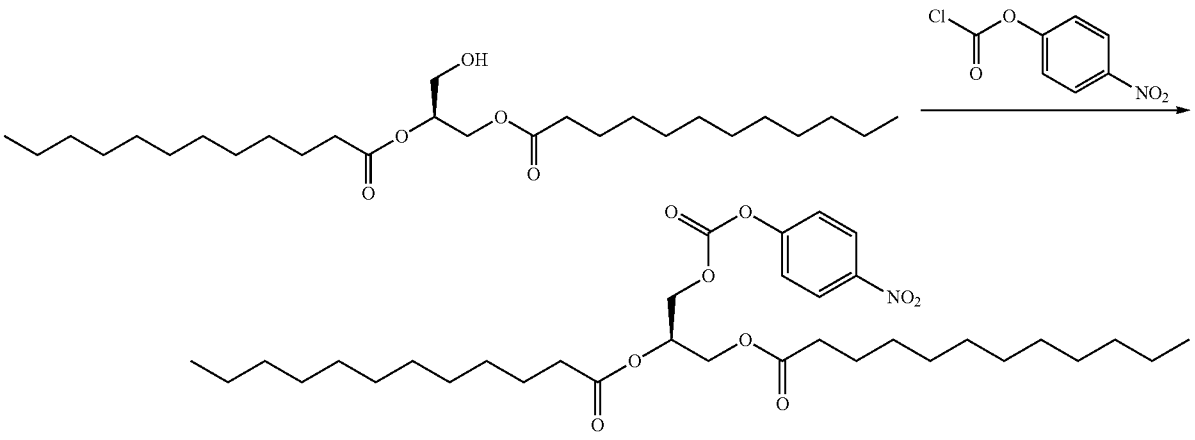

To a solution of 4-nitrophenyl carbonochloridate (69.51 mg, 0.34 mmol) in THF (3.0 ml) at room temperature was added (S)-3-hydroxypropane-1,2-diyl didodecanoate (1,2-dilaurin) and DIPEA (0.11 ml, 0.66 mmol). The reaction mixture was stirred at room temperature for 3 hrs. Solvent was evaporated under reduced pressure, diluted with EtOAc, washed with water, dried over sodium sulfate, concentrated to give the desired product (R)-3-(((4-nitrophenoxy)carbonyl)oxy)propane-1,2-diyl didodecanoate (204 mg, 100% yield). $^1$H NMR (400 MHz, Chloroform-d) δ 8.22 (d, J=8.9 Hz, 2H), 7.32 (d, J=8.9 Hz, 2H), 5.32-. 528 (m, 1H), 4.34-4.09 (m, 4H), 2.31-2.23 (m, 4H), 1.58-0.79 (m, 42H).

Example 12. Synthesis of 4,10,17-trioxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-1-(((2R,3R,4S,5R,6R)-3,4,5-tris(benzoyloxy)-6-((benzoyloxy)methyl)tetrahydro-2H-pyran-2-yl)oxy)-13-oxa-5,9,16-triazahenicosan-21-oic acid

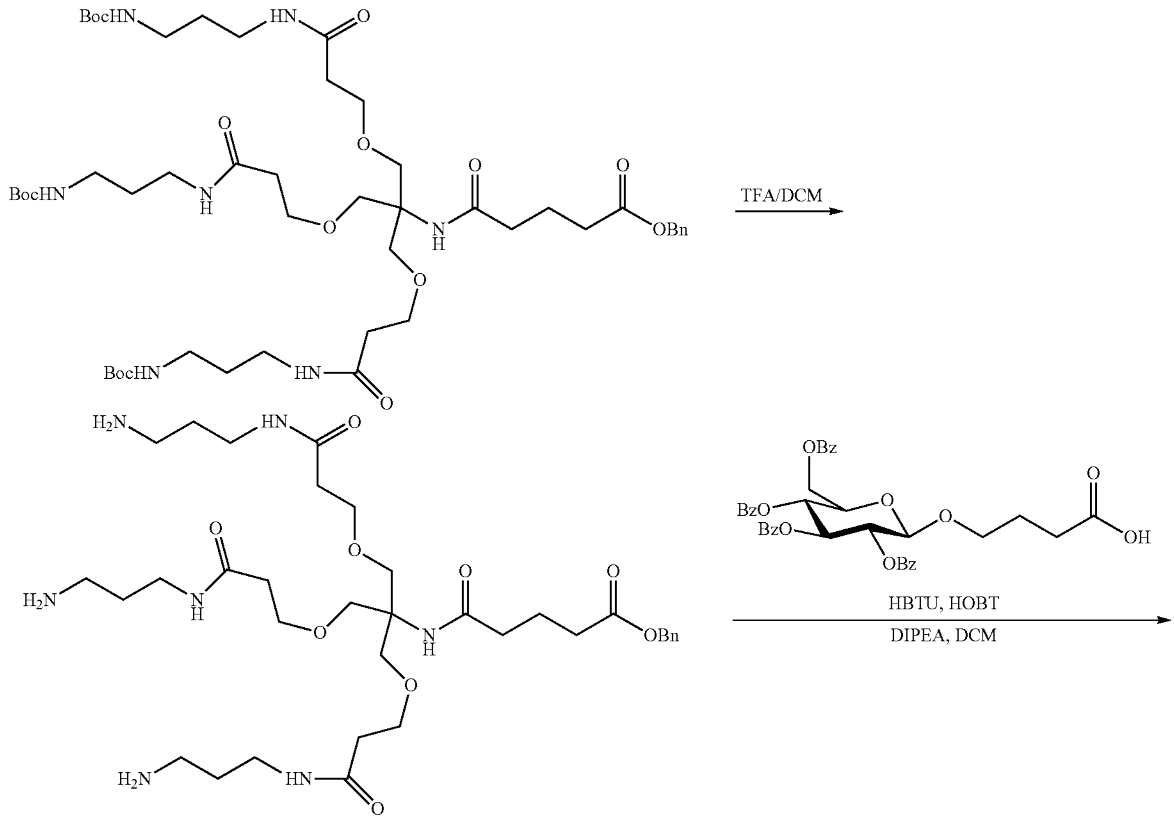

-continued

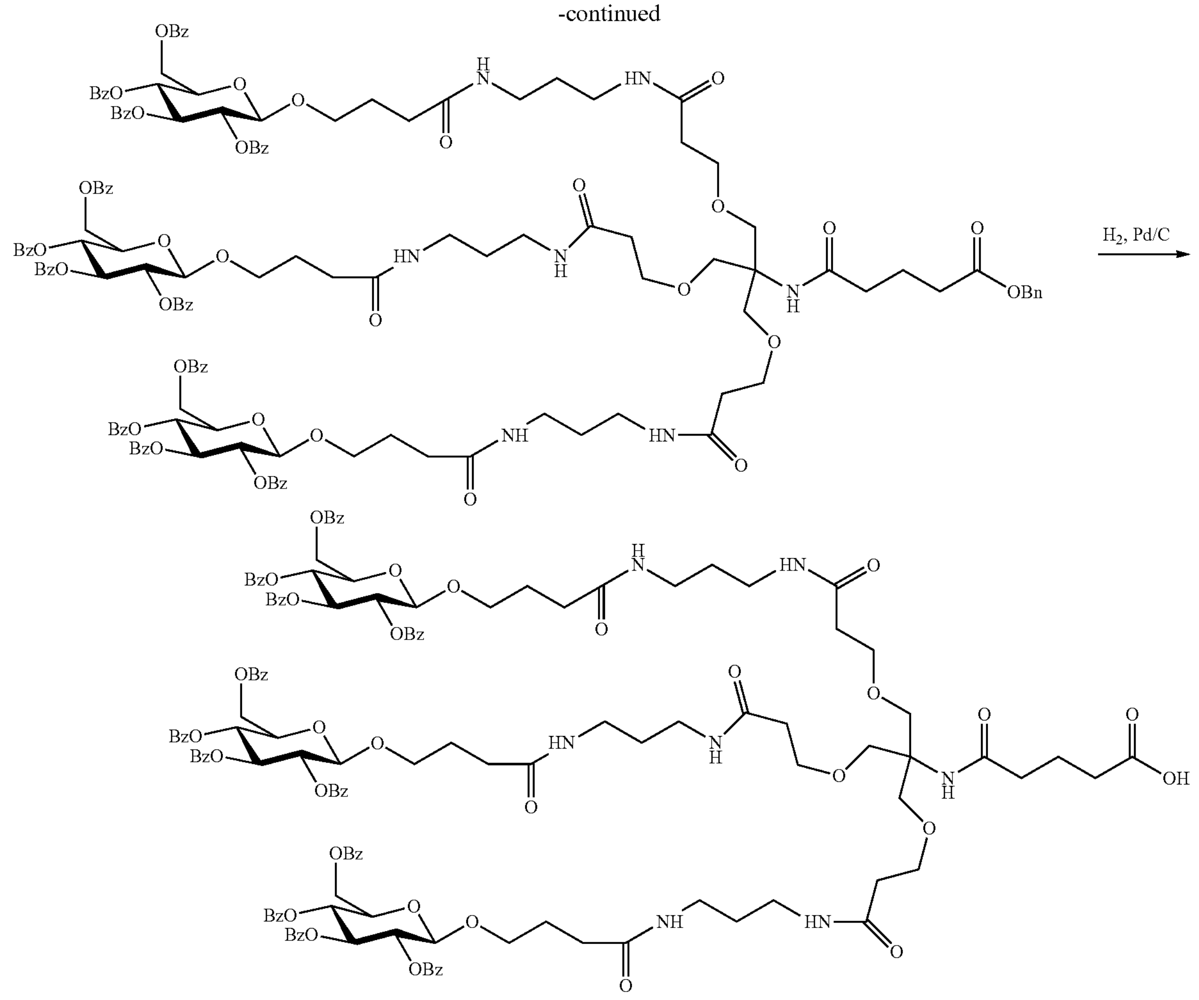

Step 1: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (0.95 g, 0.940 mmol) in DCM (5 mL) was added TFA (5 mL). The reaction mixture was stirred at room temperature for 4 hrs. LC-MS showed the reaction was completed. Solvent was evaporated under reduced pressure to give benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate as a colorless oil. Directly use for next step without purification.

Step 2: To a solution of benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (0.46 mmol) in DCM (6 mL) was added HOBt (62.16 mg, 0.46 mmol), HBTU (558.24 mg, 1.47 mmol), DIPEA (1.2 mL, 6.9 mmol) and a solution of 4-(((2R,3R,4S,5R,6R)-3,4,5-tris(benzoyloxy)-6-((benzoyloxy)methyl)tetrahydro-2H-pyran-2-yl)oxy)butanoic acid (1.10 g, 1.61 mmol) in acetonitrile (5 mL). The reaction mixture was stirred at rt for 3 hrs. Solvent was evaporated under reduced pressure to give a residue, which was diluted with EtOAc, washed with water, dried over anhydrous sodium sulfate to give a residue, which was purified by ISCO (24 g gold column) eluting with DCM to 20% MeOH in DCM to give 4,10,17-trioxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-1-(((2R,3R,4S,5R,6R)-3,4,5-tris(benzoyloxy)-6-((benzoyloxy)methyl)tetrahydro-2H-pyran-2-yl)oxy)-13-oxa-5,9,16-triazahenicosan-21-anoic benzyl ester (1.14 g, 91.7%). MS (ESI), 1353.6 ((M/2+H)$^+$.

Step 3. To a solution of 4,10,17-trioxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-1-(((2R,3R,4S,5R,6R)-3,4,5-tris(benzoyloxy)-6-((benzoyloxy)methyl)tetrahydro-2H-pyran-2-yl)oxy)-13-oxa-5,9,16-triazahenicosan-21-anoic benzyl ester (1.09 g, 0.400 mmol) in EtOAc (50 mL) was added 10% Pd—C(200 mg). The reaction mixture was stirred at rt for 4 hrs under hydrogen balloon. LC-MS showed the reaction was not completed. The reaction mixture was added another 10% Pd—C(300 mg) and stirred at room temperature for 24 hrs under hydrogen balloon. The reaction mixture was filtered, washed with EtOAc/MeOH, concentrated to give 4,10,17-trioxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-1-(((2R,3R,4S,5R,6R)-3,4,5-tris(benzoyloxy)-6-((benzoyloxy)methyl)tetrahydro-2H-pyran-2-yl)oxy)-13-oxa-5,9,16-triazahenicosan-21-oic acid (1.055 g, 100%). MS (ESI), 1308.1 ((M/2+H)$^+$.

Example 13. Synthesis of 5-(4-(4,6-bis((3,9,13,20,26-pentaoxo-15,15-bis((3-oxo-3-((3-(4-(((2R,3R,4S,5R,6R)-3,4,5- tris(benzoyloxy)-6-((benzoyloxy)methyl)tetrahydro-2H-pyran-2-yl)oxy)butanamido)propyl)amino)propoxy)methyl)-29-(((2R,3R,4S,5R,6R)-3,4,5-tris(benzoyloxy)-6-((benzoyloxy)methyl)tetrahydro-2H-pyran-2-yl)oxy)-17-oxa-4,8,14,21,25-pentaazanonacosyl)amino)-1,3,5-triazin-2-yl)piperazin-1-yl)-5-oxopentanoic acid
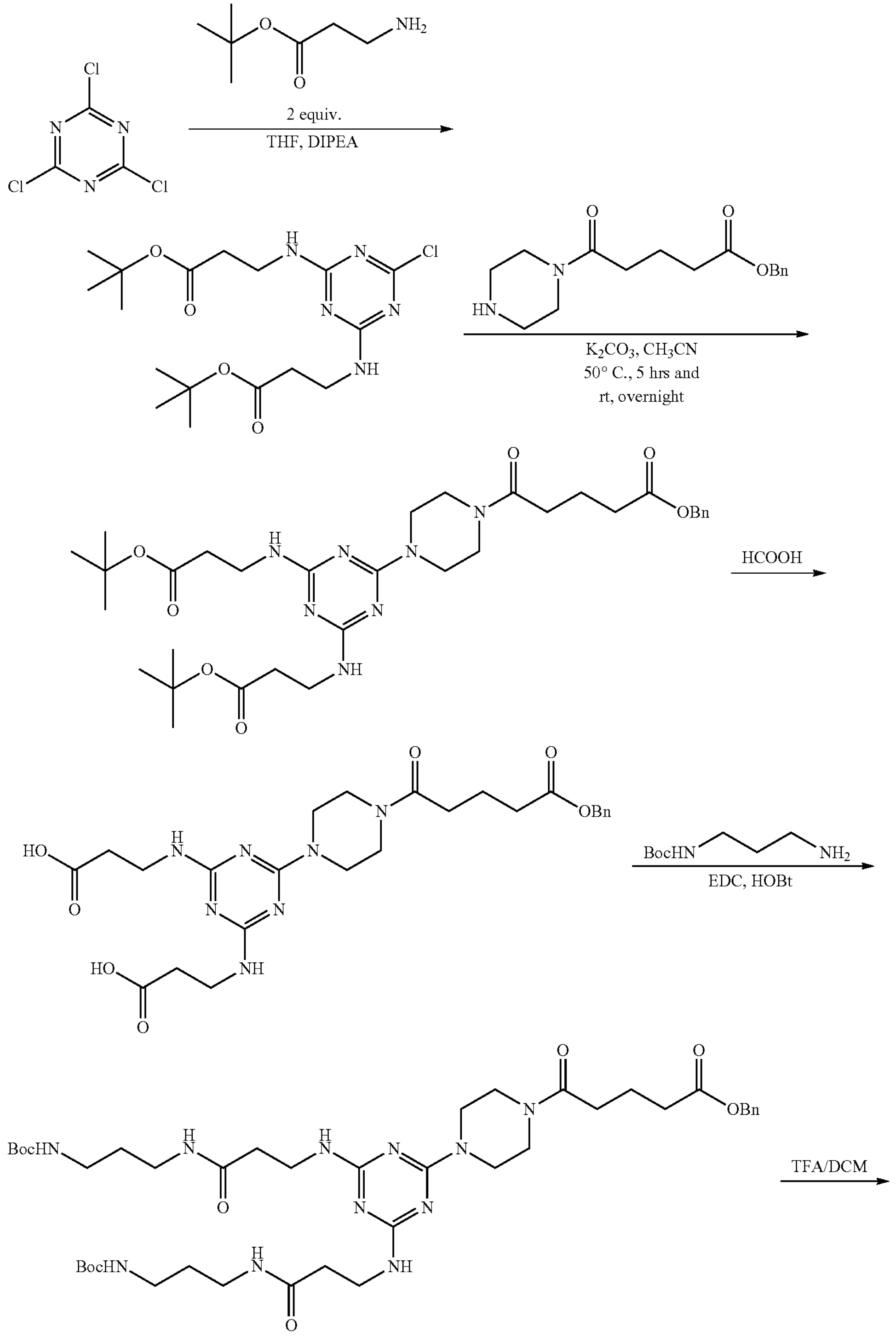

-continued
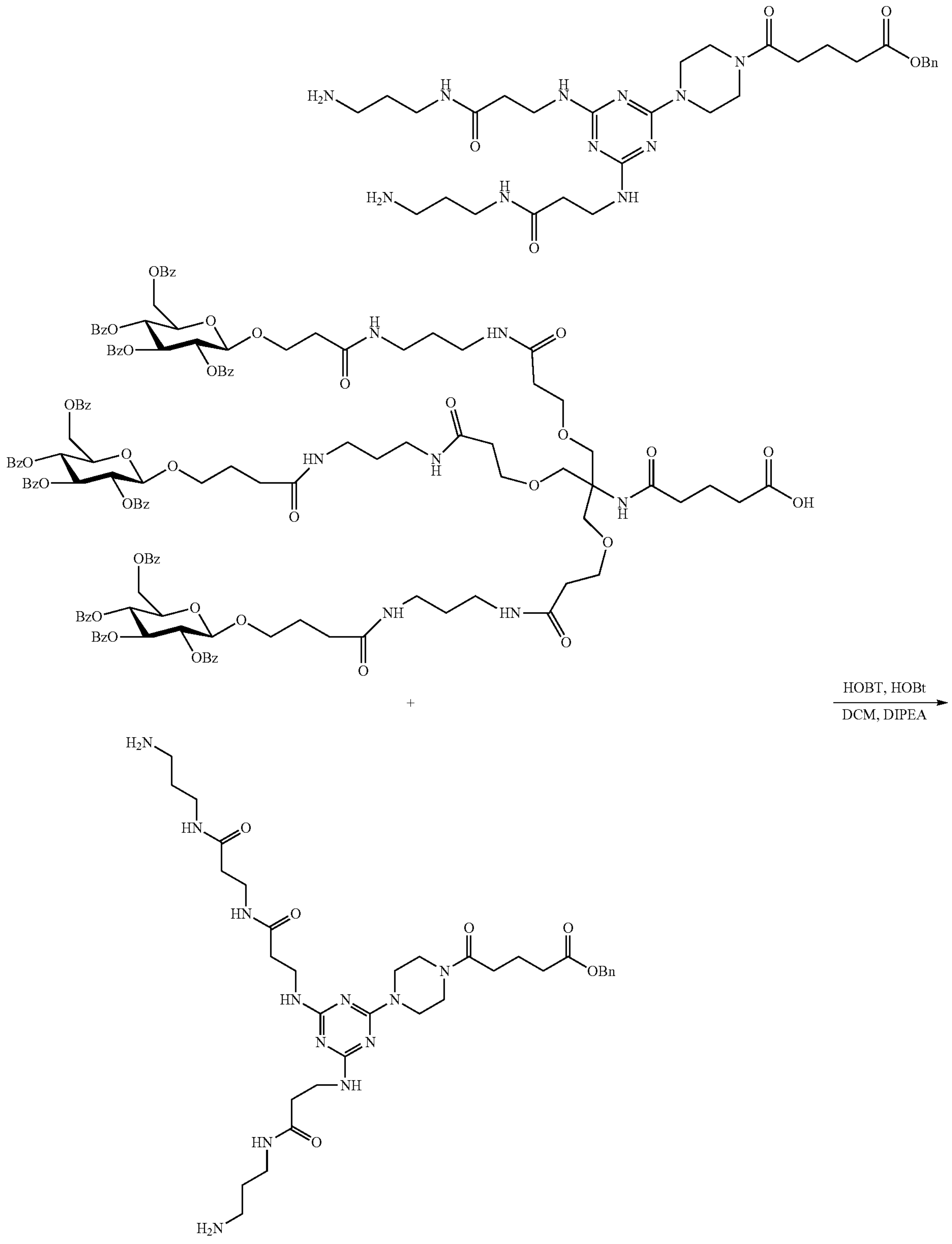

-continued
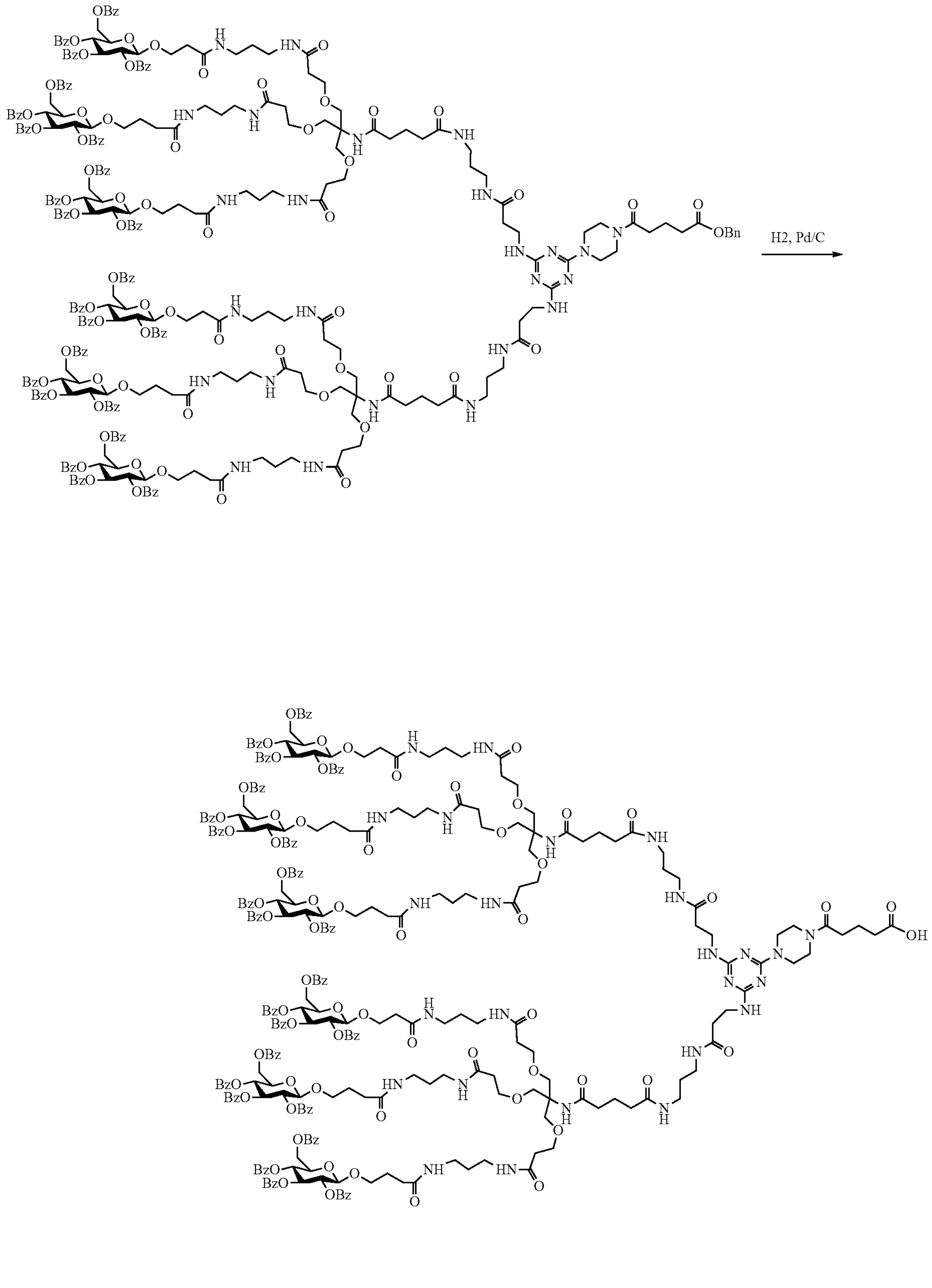

Step 1 to 2. To a solid reagent 2,4,6-trichloro-1,3,5-triazine (0.500 g, 2.71 mmol) in THF (30 mL) was added tert-butyl 3-aminopropanoate HCl salt (0.985 g, 5.42 mmol) and DIPEA (2.36 ml, 13.56 mmol). The reaction mixture was stirred at room temperature for 5 hrs. LC-MS showed the desired product; MS (ESI): 402.4 $(M+H)^+$. Solvent was evaporated under reduced pressure to give a residue, which was directly used for next step. To a solution of di-tert-butyl 3,3'-((6-chloro-1,3,5-triazine-2,4-diyl)bis(azanediyl))dipropionate (1.052 g, 2.71 mmol) in aceotnitrile (50 mL) was added benzyl 5-oxo-5-(piperazin-1-yl) pentanoate (1.103 g, 3.80 mmol) and $K_2CO_3$ (2.248 g, 16.27 mmol). The reaction mixture was stirred at room temperature for overnight and at 50° C. Diluted with EtOAc, filtered and concentrated under reduced pressure to give a residue, which was purified by ISCO (40 g gold) eluting with 20% EtOAc in hexane to 50% EtOAc in hexane to give di-tert-butyl 3,3'-((6-(4-(5-(benzyloxy)-5-oxopentanoyl) piperazin-1-yl)-1,3,5-triazine-2,4-diyl)bis(azanediyl))dipropionate (1.13 g, 64%) as a white solid. $^1H$ NMR (400 MHz, Chloroform-d) δ 7.43-7.30 (m, 5H), 5.15 (s, 2H), 3.75 (brs, 4H), 3.63 (brs, 6H), 3.43 (brs, 2H), 2.51 (q, J=7.0, 6.5 Hz, 6H), 2.42 (t, J=7.4 Hz, 2H), 2.09-1.96 (m, 2H), 1.48 (s, 18H); MS (ESI): 656.6 $(M+H)^+$.

Step 3. A solution of di-tert-butyl 3,3'-((6-(4-(5-(benzyloxy)-5-oxopentanoyl) piperazin-1-yl)-1,3,5-triazine-2,4-diyl)bis(azanediyl))dipropionate (1.10 g, 1.68 mmol) in formic acid (20 mL) was stirred at room temperature for overnight. LC-MS showed the reaction was not completed and solvent was evaporated. Formic acid (20 mL) was added to the reaction mixture and the reaction mixture was stirred at room temperature for 5 hrs. LC-MS showed the reaction was complete. Solvent was concentrated, co-evaporated with toluene (2×) and dried under vacuum for overnight to give 3,3'-((6-(4-(5-(benzyloxy)-5-oxopentanoyl) piperazin-1-yl)-1,3,5-triazine-2,4-diyl)bis(azanediyl)) dipropionic acid (0.91 g, 100% yield) as a white solid. MS (ESI), 544.2 $(M+H)^+$.

Step 4. A solution of 3,3'-((6-(4-(5-(benzyloxy)-5-oxopentanoyl) piperazin-1-yl)-1,3,5-triazine-2,4-diyl)bis(azanediyl)) dipropionic acid (0.91 g, 1.68 mmol) and HOBt (0.76 g, 4.36 mmol) in DCM (30 mL) and DMF (3 mL) at 0° C. was added tert-butyl (3-aminopropyl) carbamate (0.840 g, 4.36 mmol), EDC HCl salt (0.836 g, 4.36 mmol) and DIPEA (1.460 ml, 8.39 mmol). The reaction mixture was stirred at 0° C. for 15 minutes and at room temperature for 20 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold catridge) eluting with DCM to 30% MeOH in DCM to give benzyl 5-(4-(4,6-bis((3-((3-((tert-butoxycarbonyl)amino)propyl) amino)-3-oxopropyl)amino)-1,3,5-triazin-2-yl) piperazin-1-yl)-5-oxopentanoate (1.11 g, 77% yield) as a white solid. MS (ESI): 857.5 $(M+H)^+$.

Step A 5. solution of benzyl 5-(4-(4,6-bis((3-((3-((tert-butoxycarbonyl)amino)propyl)amino)-3-oxopropyl)amino)-1,3,5-triazin-2-yl) piperazin-1-yl)-5-oxopentanoate (75.93 mg, 0.090 mmol) in DCM (3 mL) was added TFA (0.5 mL). The reaction mixture was stirred at room temperature for 3 hrs. Solvent was evaporated under reduced pressure, use directly for next step without purification. MS (ESI): 656.3 $(M+H)^+$.

Step 6. To a solution of 4,10,17-trioxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-1-(((2R,3R,4S,5R,6R)-3,4,5-tris(benzoyloxy)-6-((benzoyloxy)methyl) tetrahydro-2H-pyran-2-yl)oxy)-13-oxa-5,9,16-triazahenicosan-21-oic acid (580 mg, 0.222 mmol) in DCM (10 mL) was added HBTU (84.1 mg, 0.220 mmol), HOBt (11.99 mg, 0.09 mmol) and DIPEA (0.15 ml, 0.890 mmol). The reaction mixture was stirred at rt for 5 minutes and a solution of benzyl 5-(4-(4,6-bis((3-((3-aminopropyl) amino)-3-oxopropyl)amino)-1,3,5-triazin-2-yl) piperazin-1-yl)-5-oxopentanoate TFA salt (0.090 mmol) in acetonitrile was added to the reaction mixture. The reaction mixture was stirred at rt for overnight. Solvent was evaporated under reduced pressure to give a residue, which was purified by ISCO (24 g gold) eluting with DCM to 40% MeOH in DCM to give 5-(4-(4,6-b is ((3,9,13,20,26-pentaoxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-29-(((2R,3R,4S,5R,6R)-3,4,5-tris(benzoyloxy)-6-((benzoyloxy)methyl) tetrahydro-2H-pyran-2-yl)oxy)-17-oxa-4,8,14,21,25-pentaazanonacosyl)amino)-1,3,5-triazin-2-yl) piperazin-1-yl)-5-oxopentanoic benzyl ester (300 mg, 57.8%). MS (ESI), 1950.6 $((M/3+H)^+$.

Step 7. To a solution of 5-(4-(4,6-bis((3,9,13,20,26-pentaoxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy) methyl)-29-(((2R,3R,4S,5R,6R)-3,4,5-tris(benzoyloxy)-6-((benzoyloxy)methyl)tetrahydro-2H-pyran-2-yl)oxy)-17-oxa-4,8,14,21,25-pentaazanonacosyl)amino)-1,3,5-triazin-2-yl) piperazin-1-yl)-5-oxopentanoic benzyl ester (300 mg, 0.05 mmol) in EtOAc (10 ml) was added 10% Pd—C(100 mg). The reaction mixture was stirred at rt under hydrogen balloon for overnight. LC-MS showed the reaction was not complete. The reaction mixture was added MeOH (1 mL) and triethylsilane (2 mL). The reaction mixture was stirred at room temperature for 4 hrs. LC-MS showed the desired product. The reaction mixture was filtered, washed with EtOAc/MeOH, and concentrated under reduced pressure to give a residue, which was purified by ISCO (50 g C18 catridge) eluting with 1% TFA in water to 100% acetonitrile and lyophilized to give 5-(4-(4,6-bis((3,9,13,20,26-pentaoxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy) methyl)-29-(((2R,3R,4S,5R,6R)-3,4,5-tris(benzoyloxy)-6-((benzoyloxy)methyl)tetrahydro-2H-pyran-2-yl)oxy)-17-oxa-4,8,14,21,25-pentaazanonacosyl)amino)-1,3,5-triazin-2-yl) piperazin-1-yl)-5-oxopentanoic acid (120 mg, 40.6% yield) as a white solid. MS (ESI), 1920 $((M/3+H)^+$.

Example 14. Synthesis of 5-(4-(4,6-bis((3,9,13,20,26-pentaoxo-15,15-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-30-(((2S,3S,4S,5R,6R)-3,4,5-triacetoxy-6-(acetoxymethyl)tetrahydro-2H-pyran-2-yl)oxy)-17-oxa-4,8,14,21,25-pentaazatriacontyl)amino)-1,3,5-triazin-2-yl) piperazin-1-yl)-5-oxopentanoic acid
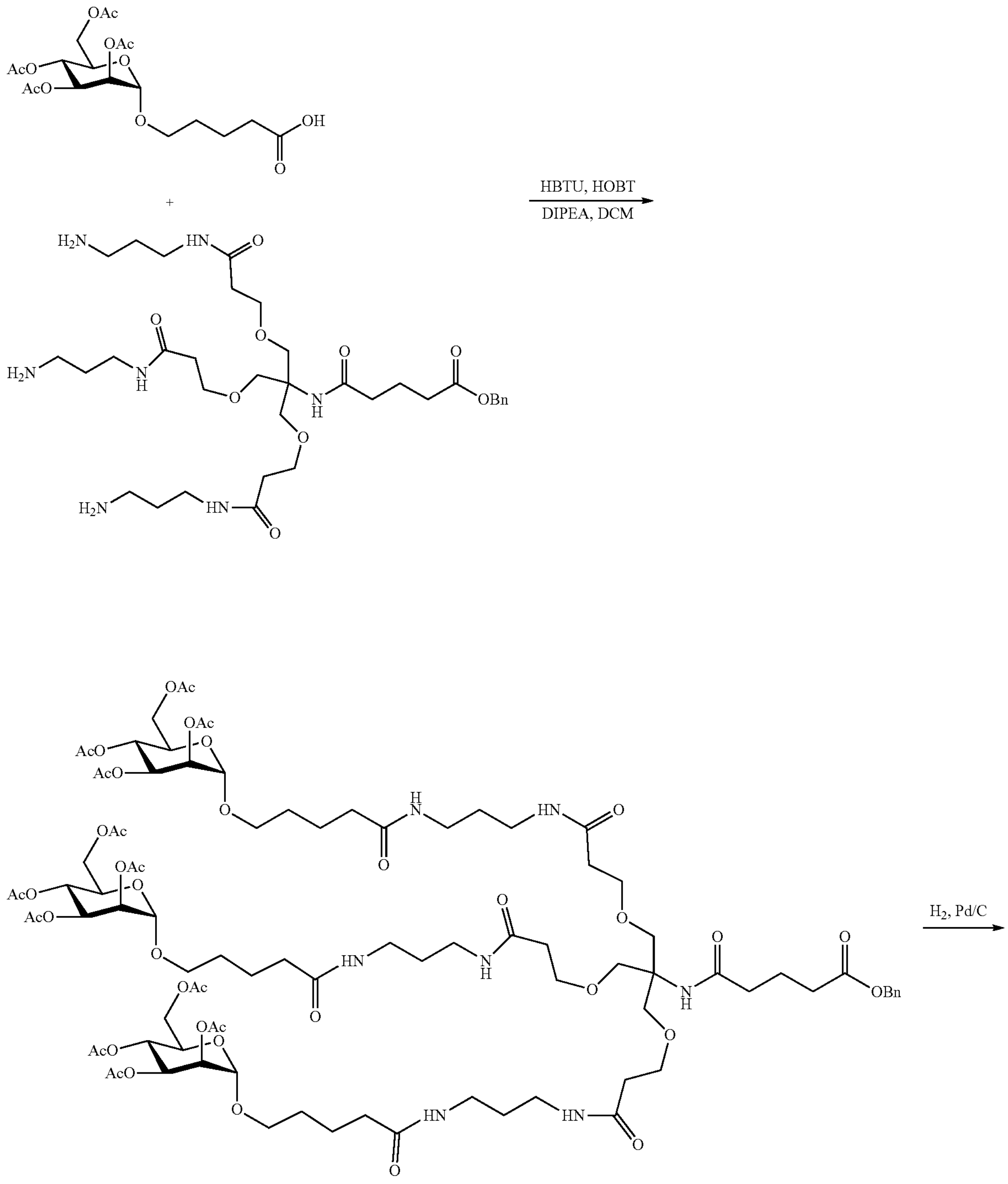

-continued
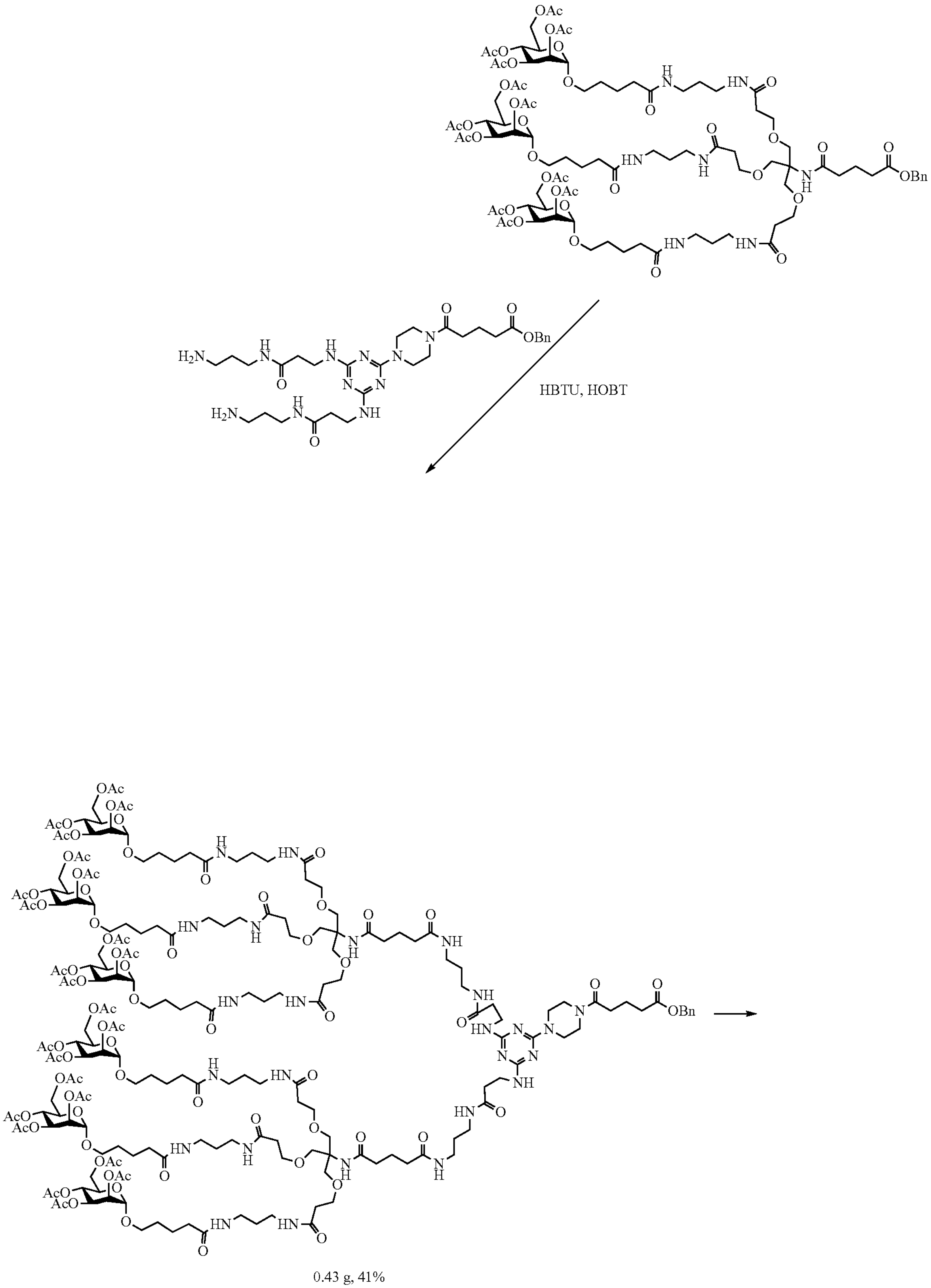

-continued

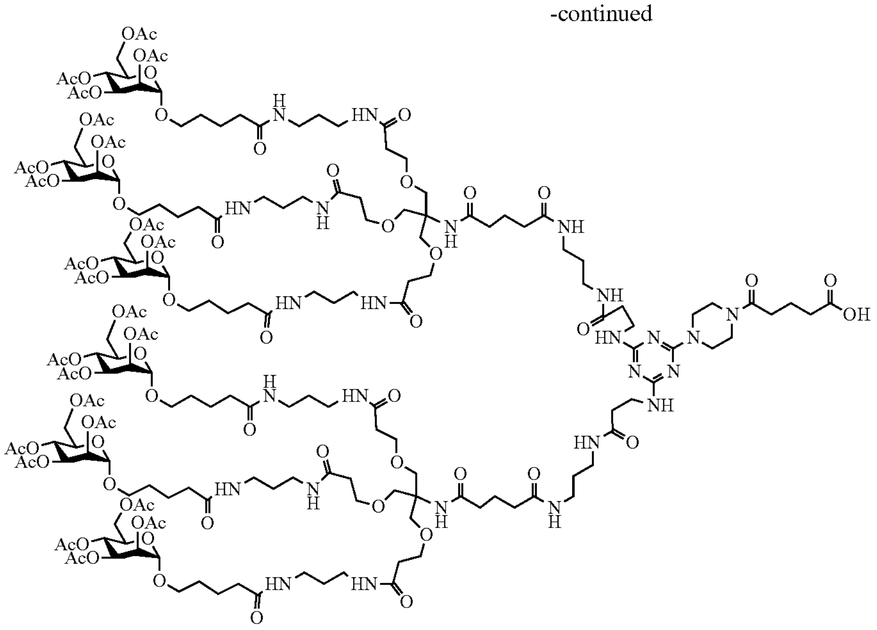

0.40 g, 97%

Step 1. To solution a 1 of 5-(((2S,3S,4S,5R,6R)-3,4,5-triacetoxy-6-(acetoxymethyl)tetrahydro-2H-pyran-2-yl)oxy)pentanoic acid (2.43 g, 5.43 mmol) in DCM was added HBTU (2.06 g, 5.43 mmol), HOBt (183.36 mg, 1.36 mmol) and DIPEA (4.73 ml, 27.14 mmol). The reaction mixture was stirred at room temperature for 10 minutes, and a solution of benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate TFA salt (1.36 mmol) in acetonitrile was added. The reaction mixture was stirred at room temperature for 3 hrs. Solvent was concentrated under reduced pressure to give a residue, which was purified by ISCO (80 g gold catridge) eluting with 5% MeOH in DCM to 60% MeOH in DCM to give 5,12,18-trioxo-7,7-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-22-(((2S,3S,4S,5R,6R)-3,4,5-triacetoxy-6-(acetoxymethyl)tetrahydro-2H-pyran-2-yl)oxy)-9-oxa-6,13,17-triazadocosanoic benzyl ester (2.22 g, 81.8%). MS (ESI): 1002 $(M/2+H)^+$.

Step 2. To a solution of 5,12,18-trioxo-7,7-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-22-(((2S,3S,4S,5R,6R)-3,4,5-triacetoxy-6-(acetoxymethyl)tetrahydro-2H-pyran-2-yl)oxy)-9-oxa-6,13,17-triazadocosanoic benzyl ester (2.20 g, 1.1 mmol) in EtOAc (30 mL) and MeOH (3 mL) was added 10% Pd—C(300 mg) and triethylsilane (1.8 mL, 11.3 mmol) slowly. The reaction mixture was stirred at room temperature for 1 hr. The reaction mixture was filtered through celite and concentrated to give 5,12,18-trioxo-7,7-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-22-(((2S,3S,4S,5R,6R)-3,4,5-triacetoxy-6-(acetoxymethyl)tetrahydro-2H-pyran-2-yl)oxy)-9-oxa-6,13,17-triazadocosanoic acid. MS (ESI), 1912 $(M+H)^+$.

Step 3. To a solution of 5,12,18-trioxo-7,7-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-22-(((2S,3S,4S,5R,6R)-3,4,5-triacetoxy-6-(acetoxymethyl)tetrahydro-2H-pyran-2-yl)oxy)-9-oxa-6,13,17-triazadocosanoic acid (1911 mg, 0.580 mmol) in DCM (30 mL) was added HBTU (266 mg, 0.700 mmol), HOBt (31.56 mg, 0.23 mmol) and DIPEA (0.81 ml, 4.67 mmol). The reaction mixture was stirred at rt for 10 minutes and a solution of benzyl 5-(4-(4,6-bis((3-((3-aminopropyl)amino)-3-oxopropyl)amino)-1,3,5-triazin-2-yl)piperazin-1-yl)-5-oxopentanoate TFA salt (0.23 mmol) in acetonitrile (5 mL) was added to the reaction mixture. The reaction mixture was stirred at rt for 3 hrs. Solvent was evaporated under reduced pressure to give a residue, which was purified by ISCO (24 g gold) eluting with DCM to 50% MeOH in DCM to give 5-(4-(4,6-bis((3,9,13,20,26-pentaoxo-15,15-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-30-(((2S,3S,4S,5R,6R)-3,4,5-triacetoxy-6-(acetoxymethyl)tetrahydro-2H-pyran-2-yl)oxy)-17-oxa-4,8,14,21,25-pentaazatriacontyl)amino)-1,3,5-triazin-2-yl) piperazin-1-yl)-5-oxopentanoic benzyl ester (430 mg, 41.4%). MS (ESI), 1482.1 $(M/3+H)^+$.

Step 4. A solution of 5-(4-(4,6-bis((3,9,13,20,26-pentaoxo-15,15-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-30-(((2S,3S,4S,5R,6R)-3,4,5-triacetoxy-6-(acetoxymethyl)tetrahydro-2H-pyran-2-yl)oxy)-17-oxa-4,8,14,21,25-pentaazatriacontyl)amino)-1,3,5-triazin-2-yl) piperazin-1-yl)-5-oxopentanoic benzyl ester (420 mg, 0.090 mmol) in EtOAc (15 mL) and MeOH (2 mL) was added 10% Pd—C (200 mg). The reaction mixture was stirred at room temperature under hydrogen balloon for overnight. The reaction mixture was filtered through celite, washed with 50% MeOH in EtOAc, and concentrated under reduced pressure to give 5-(4-(4,6-bis((3,9,13,20,26-pentaoxo-15,15-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-30-(((2S,3S,4S,5R,6R)-3,4,5-triacetoxy-6-(acetoxymethyl)tetrahydro-2H-pyran-2-yl)oxy)-17-oxa-4,8,14,21,25-pentaazatriacontyl)amino)-1,3,5-triazin-2-yl) piperazin-1-yl)-5-oxopentanoic acid. MS (ESI), 1452.0 $(M/3+H)^+$.

Example 15. Synthesis of 3-(((4-nitrophenoxy)carbonyl)oxy)propyl (4E,8E,12E,16E)-4,8,13,17,21-pentamethyldocosa-4,8,12,16,20-pentaenoate

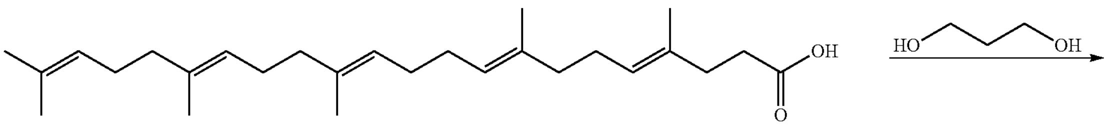

turbanaric acid

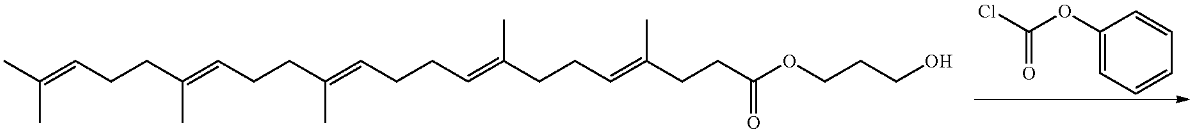

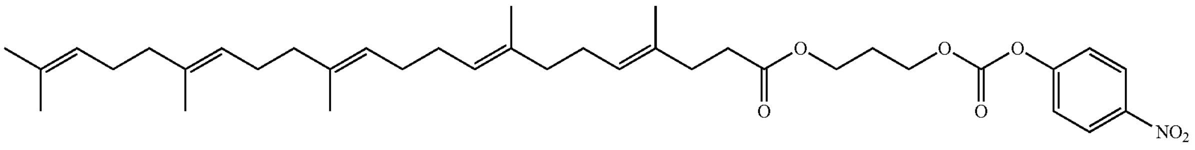

Step 1. To the solution of turbinaric acid (2.00 g, 4.992 mmol) in DCM (20 mL) was added 1,3-propanediol (1.8 mL, 24.96 mmol), EDC(1.91 g, 9.984 mmol) and DMAP (30.5 mg). The reaction mixture was stirred at rt for 5 hrs. LC-MS showed the reaction was complete. The reaction mixture was concentrated, diluted with EtOAc (100 mL), washed successively with 1N HC aq solution (20 ml), saturated $NaHCO_3$aq solution (20 mL), water (10 mL), and brine (5 mL), dried over sodium sulfate, filtered, and concentrated to give a residue, which was purified by ISCO (40 g gold catridge) using 0-100% EtOAc in hexane as the gradient to give 3-hydroxypropyl (4E,8E,12E,16E)-4,8,13,17,21-pentamethyldocosa-4,8,12,16,20-pentaenoate (1.129 g, 49% yield). $^1$H NMR (400 MHz, DMSO-$d_6$) δ 5.15-5.02 (m, 5H), 4.46 (t, J=5.1 Hz, 1H), 4.06 (t, J=6.6 Hz, 2H), 3.45 (td, J=6.3, 5.1 Hz, 2H), 2.40-2.31 (m, 2H), 2.20 (t, J=7.6 Hz, 2H), 2.08-1.90 (m, 16H), 1.70 (p, J=6.4 Hz, 2H), 1.64 (d, J=1.5 Hz, 3H), 1.56 (m, 15H); MS (ESI), 481.3 $(M+Na)^+$.

Step 2. To a solution of 3-hydroxypropyl (4E,8E,12E,16E)-4,8,13,17,21-pentamethyldocosa-4,8,12,16,20-pentaenoate (1.12 g, 2.4416 mmol) in anhydrous DCM (12.5 mL) at 0° C. was added TEA (0.68 mL), and a solution of 4-nitrophenyl chloroformate (738 mg) in anhydrous DCM (5 ml) slowly. The reaction mixture was stirred at 0° C. for 40 min, and at room temperature for overnight. The reaction mixture was concentrated to give a residue, which was purified by ISCO (40 gold catridge) eluting with using 0-50% EtOAc in hexane to give 3-(((4-nitrophenoxy)carbonyl)oxy)propyl (4E,8E,12E,16E)-4,8,13,17,21-pentamethyldocosa-4,8,12,16,20-pentaenoate (1.06 g, 70% yield). $^1$H NMR (400 MHz, DMSO-$d_6$) δ 8.34-8.29 (m, 2H), 7.58-7.51 (m, 2H), 5.13-5.01 (m, 5H), 4.32 (t, J=6.3 Hz, 2H), 4.13 (t, J=6.3 Hz, 2H), 2.44-2.34 (m, 2H), 2.21 (t, J=7.6 Hz, 2H), 2.07-1.87 (m, 18H), 1.63 (d, J=1.5 Hz, 3H), 1.55 (m, 15H).

Example 16. Preparation of Certain Chemical Moieties and Oligonucleotides Comprising Certain Chemical Moieties In some embodiments, the present disclosure provides chemical moieties that can be incorporated into oligonucleotides. In some embodiments, a chemical moiety is a targeting moiety. In some embodiments, a chemical moiety is a carbohydrate moiety. In some embodiments, a chemical moiety is a lipid moiety. In some embodiments, chemical moieties may be incorporated into oligonucleotides to improve one or more properties, activities, and/or delivery. Certain chemical moieties, their preparation, and oligonucleotides comprising such moieties are described in the present example. Those skilled in the art appreciate that such chemical moieties may also be incorporated into oligonucleotides having other base sequences, modifications, etc.

Synthesis of 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oic acid
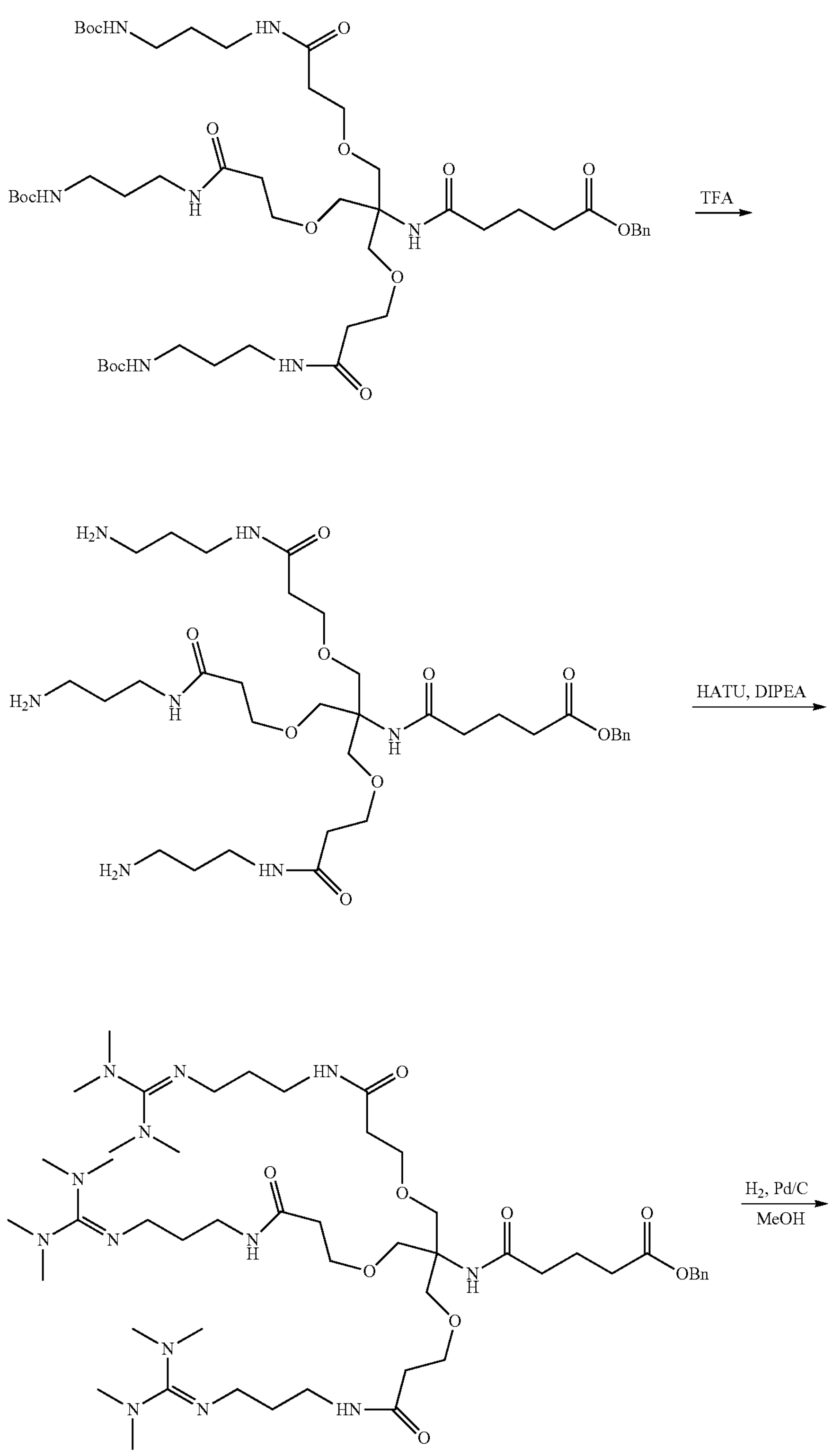

-continued

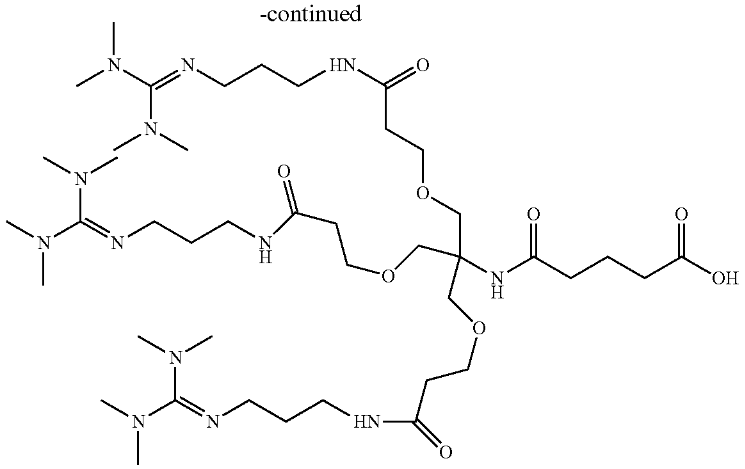

Step 1. To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (9.0 g, 8.91 mmo) in DCM (100 mL) was added TFA (30.47 g, 267.27 mmol, 19.79 mL) at 0° C. The mixture was stirred at 0-15° C. for 4 hr. The mixture was formed two phase. Lower phase was separated and concentrated under reduced pressure to give a crude. benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate TFA salt (13 g) was obtained as a yellow oil. $^1$H NMR (400 MHz, METHANOL-$d_4$) Shift=7.39-7.27 (m, 5H), 5.12 (s, 2H), 3.70-3.63 (m, 13H), 3.32-3.30 (m, 2H), 3.26 (s, 2H), 2.94 (t, J=7.3 Hz, 7H), 2.49-2.38 (m, 9H), 2.23 (t, J=7.4 Hz, 2H), 1.94-1.78 (m, 9H). LCMS: $M+H^+$=710.2.

Step 2. To a solution of benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate TFA salt (13 g) in DCM (200 mL) was added DIPEA (15.97 g, 123.58 mmol, 21.53 mL) and HATU (15.51 g, 40.78 mmol). The mixture was stirred at 15° C. for 15 hr. LCMS showed compound 2 was consumed and desired MS was detected. The mixture was concentrated under reduced pressure to give a residue. The residue was purified by prep-HPLC(column: Agela innoval ods-2 250*80 mm; mobile phase: [water (0.1% TFA)-ACN]; B %: 8%-38%, 20 min) to give compound benzyl 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oate (6.5 g, 52.37% yield) as a brown oil. LCMS: $M/2+H^+$=503.1.

Step 3. To a solution of compound benzyl 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oate (5.7 g, 5.68 mmol) in MeOH (30 mL) and $H_2O$ (6 mL) was added $LiOH \cdot H_2O$ (1.67 g, 39.73 mmol). The mixture was stirred at 15° C. for 2 hr. LCMS showed compound 3 was consumed and desired MS was detected. The mixture was concentrated under reduced pressure to give a residue. The residue was purified by prep-HPLC(column: Phenomenex luna C18 250*50 mm*10 um; mobile phase: [water (0.1% TFA)-ACN]; B %: 0%-25%, 20 min). 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oic acid (2.09 g, 2.25 mmol, 40% yield) was obtained as a yellow gum. $^1$HNMR (400 MHz, DMSO-$d_6$) Shift=8.07 (br t, J=5.7 Hz, 3H), 7.75 (br t, J=5.0 Hz, 3H), 7.08 (s, 1H), 3.63-3.45 (m, 12H), 3.09 (q, J=6.1 Hz, 11H), 2.88 (br d, J=15.3 Hz, 36H), 2.29 (br t, J=6.4 Hz, 6H), 2.18 (t, J=7.5 Hz, 2H), 2.12-2.06 (m, 2H), 1.65 (br t, J=6.6 Hz, 8H). $^{13}$CNMR (101 MHz, DMSO-$d_6$) Shift=173.10, 170.88, 169.27, 159.88, 157.61, 157.27, 156.93, 156.58, 119.48, 116.56, 113.63, 110.70, 67.13, 66.27, 58.46, 40.77, 34.82, 34.34, 33.88, 31.87, 28.23, 19.66, 0.00. LCMS: $M+H^+$=915.7, purity: 98.265%.

Synthesis of 5-(((2R,3R,4S,5R,6R)-3,4,5-triacetoxy-6-(acetoxymethyl)tetrahydro-2H-pyran-2-yl)oxy) pentanoic acid

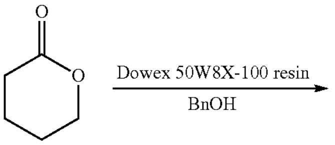

1

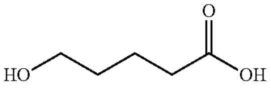

2

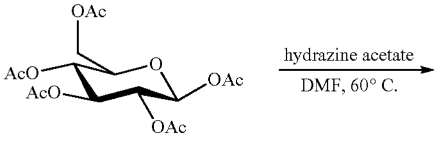

3

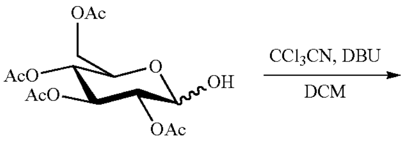

4

-continued

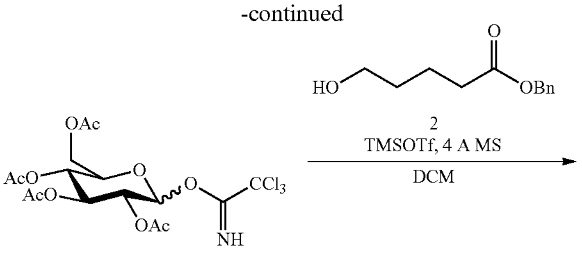

5

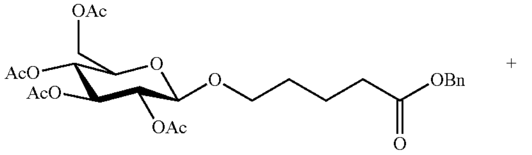

6

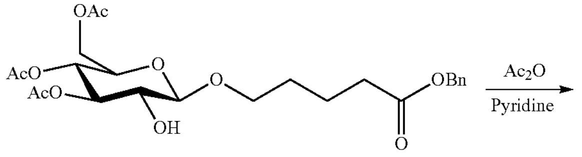

6A

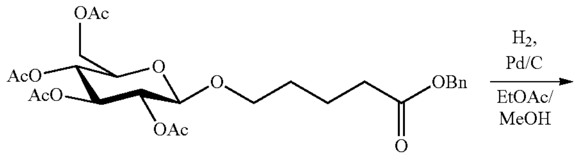

6

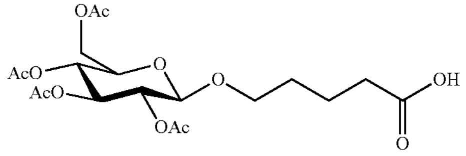

7

Step 1. A mixture of phenylmethanol (864.10 g, 7.99 mol), compound 1 (100 g, 998.85 mmol), and cation exchange resin (1.92 g, 998.85 mmol.) was stirred at 75° C. with $N_2$ for 4 hr, and then the mixture was stirred at 20° C. for 12 hr under $N_2$ atmosphere. TLC showed compound 1 was consumed completely and two main peaks were detected. The reaction mixture was filtered and then the residue was washed with DCM (500 mL). The reaction mixture was concentrated under reduced pressure to give a residue. The residue was purified by column chromatography ($SiO_2$, Petroleum ether/Ethyl acetate=10/1 to 3:1) to get compound 2 as a colorless oil (62 g, 29.81% yield). $^1$HNMR (400 MHz, CHLOROFORM-d): δ=7.41-7.27 (m, 5H), 5.11 (s, 2H), 3.62 (t, J=6.4 Hz, 2H), 2.39 (t, J=7.3 Hz, 2H), 1.77-1.70 (m, 2H), 1.65-1.51 (m, 2H); TLC(Petroleum ether/Ethyl acetate=3:1)Rf=0.20.

Step 2. To a solution of compound 3 (350 g, 896.66 mmol.) in DMF (2 L) was added acetic acid hydrazine (99.10 g, 1.08 mol). The mixture was stirred at 60° C. for 5 hr. TLC showed the starting material was consumed. The mixture was concentrated to move the most solvent and water (500 mL) was added, and the mixture was extracted with EtOAc (500 mL*3). The combined organic was dried over $Na_2SO_4$, filtered and concentrated to get the compound 4 as a brown oil (310 g, crude). $^1$HNMR (400 MHz, CHLOROFORM-d): δ=5.49 (t, J=9.9 Hz, 1H), 5.39 (d, J=3.5 Hz, 1H), 5.06-4.99 (m, 1H), 4.84 (dd, J=3.5, 10.1 Hz, 1H), 4.25-4.17 (m, 2H), 4.13-4.02 (m, 2H), 2.04-1.96 (m, 12H); TLC (Petroleum ether/Ethyl acetate=1:1), Rf=0.43.

Step 3. To a solution of compound 4 (310 g, 890.03 mmol.) in DCM (1.5 L) was added 2,2,2-trichloroacetonitrile (1.16 kg, 8.01 mol) at 0° C. The mixture was added drop-wise DBU (271.00 g, 1.78 mol) dissolved in DCM (1 L) at 0° C. The mixture was stirred at 20° C. for 1 h. TLC showed the starting material was consumed. The mixture was concentrated to get the crude. The mixture was purified by silica gel chromatography (Petroleum ether/Ethyl acetate=20:1, 10:1, 5:1) to get compound 5 as a yellow oil (90 g, 20.52% yield). $^1$HNMR (400 MHz, $CDCl_3$): δ=8.70 (s, 1H), 6.56 (br d, J=3.1 Hz, 1H), 5.57 (t, J=9.8 Hz, 1H), 5.24-5.08 (m, 2H), 4.35-4.15 (m, 2H), 2.11-1.99 (m, 12H); TLC (Petroleum ether/Ethyl acetate=1:1)$R_f$=0.31.

Step 4. To a solution compound 5 (89.5 g, 181.66 mmol) and compound 2 (75.66 g, 363.31 mmol) in DCM (800 mL) was added 4A MS (90 g), the mixture was stirred at −30° C. for 30 min. TMSOTf (40.37 g, 181.66 mmol.) was added to the reaction and the mixture was stirred at 25° C. for 3 hr. LCMS and TLC showed the starting material was consumed and LCMS showed the de-Ac MS was found. Sat. $NaHCO_3$ (aq., 100 mL) was added and the mixture was extracted with DCM (150 mL*3). The combined organic was dried over $Na_2SO_4$, filtered and concentrated to get the crude. Totally got the mixture of benzyl compound 6 and compound 6A (98 g) as a yellow oil, the mixture was used next step directly. TLC(Petroleum ether/Ethyl acetate=2:1) Rf=0.38.

Step 5. The mixture compound 6 and compound 6A (98 g crude) was dissolved in the pyridine (150 mL) and then $Ac_2O$ (150 mL) was added. The mixture was stirred at 20° C. for 12 h. TLC showed the starting material was consumed. The mixture was concentrated to get the crude. The mixture was purified by MPLC(silica, Petroleum ether/Ethyl acetate=20:1, 10:1, 05:1) to get compound 6 as a yellow oil (41 g, 41.84% yield) and 12 g crude. $^1$HNMR (400 MHz, $CDCl_3$): δ=7.39-7.31 (m, 5H), 5.23-4.93 (m, 3H), 4.48 (d, J=7.9 Hz, 1H), 4.37-4.22 (m, 1H), 4.17-4.05 (m, 1H), 3.92-3.81 (m, 1H), 3.71-3.63 (m, 1H), 3.48 (td, J=6.3, 9.8 Hz, 1H), 2.44-2.32 (m, 2H), 2.09-1.98 (m, 12H), 1.75-1.53 (m, 4H); LCMS: (M+$Na^+$): 561.0; SFC: de %: 100%; TLC(Petroleum ether/Ethyl acetate=3:1) Rf=0.14.

Step 6. To a solution of compound 7 (19.5 g, 36.21 mmol) in EtOAc (200 mL) was added Pd/C(4 g, 17.64 mmol, 10% purity) under $N_2$ atmosphere. The suspension was degassed and purged with $H_2$ for 3 times. The mixture was stirred under $H_2$ (25 Psi) at 20° C. for 2 hr. LCMS and TLC showed the starting material was consumed. The mixture was filtered, the cake was washed with MeOH (50 mL*3) and the combined filter was concentrated to get the crude. The mixture was purified by silica gel chromatography (Petroleum ether/Ethyl acetate=3:1, 1:1, 1:3) to get 5-(((2R,3R,4S,5R,6R)-3,4,5-triacetoxy-6-(acetoxymethyl)tetrahydro-2H-pyran-2-yl)oxy)pentanoic acid 7 as a white solid (23.9 g, 51.72 mmol, 71.41% yield, 97.03% LCMS purity). $^1$HNMR (400 MHz, CHLOROFORM-d): δ=5.24-5.17 (m, 1H), 5.12-4.96 (m, 2H), 4.50 (d, J=7.9 Hz, 1H), 4.26 (dd, J=4.7, 12.3 Hz, 1H), 4.20-4.02 (m, 1H), 3.95-3.85 (m, 1H), 3.75-3.64 (m, 1H), 3.55-3.46 (m, 1H), 2.42-2.32 (m, 2H), 2.15-1.99 (m, 12H), 1.76-1.57 (m, 4H); $^{13}$CNMR (101 MHz, CHLOROFORM-d): δ=178.85, 170.71, 170.30, 169.40, 169.35, 100.71, 72.81, 71.74, 71.25, 69.37, 68.42, 61.94, 33.36, 28.59, 21.09, 20.70, 20.56; LCMS: (M−$H^+$): 447.1, LCMS purity: 97.03%; TLC(Petroleum ether/Ethyl acetate=1:1) Rf=0.03.

Synthesis of 5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanoic acid
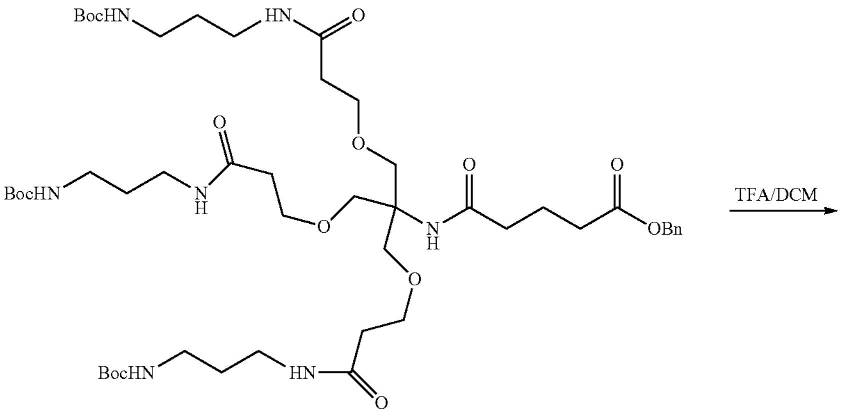
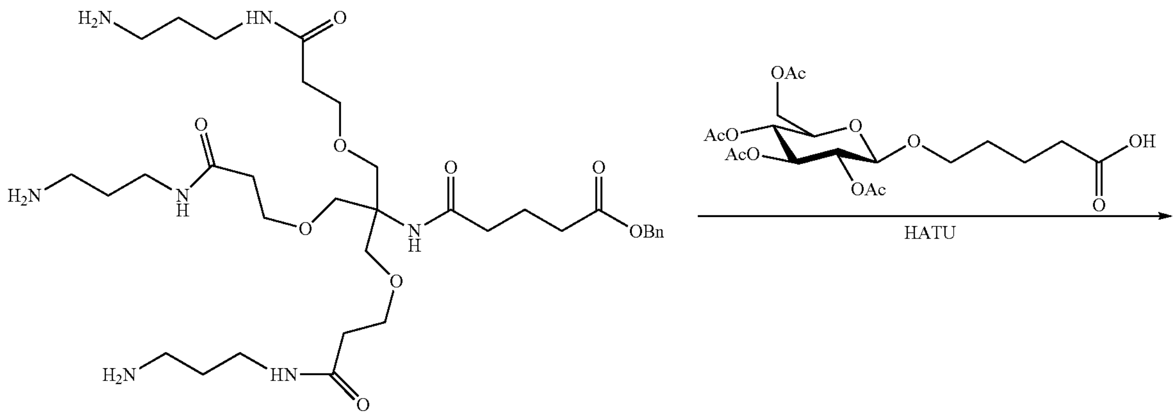

-continued

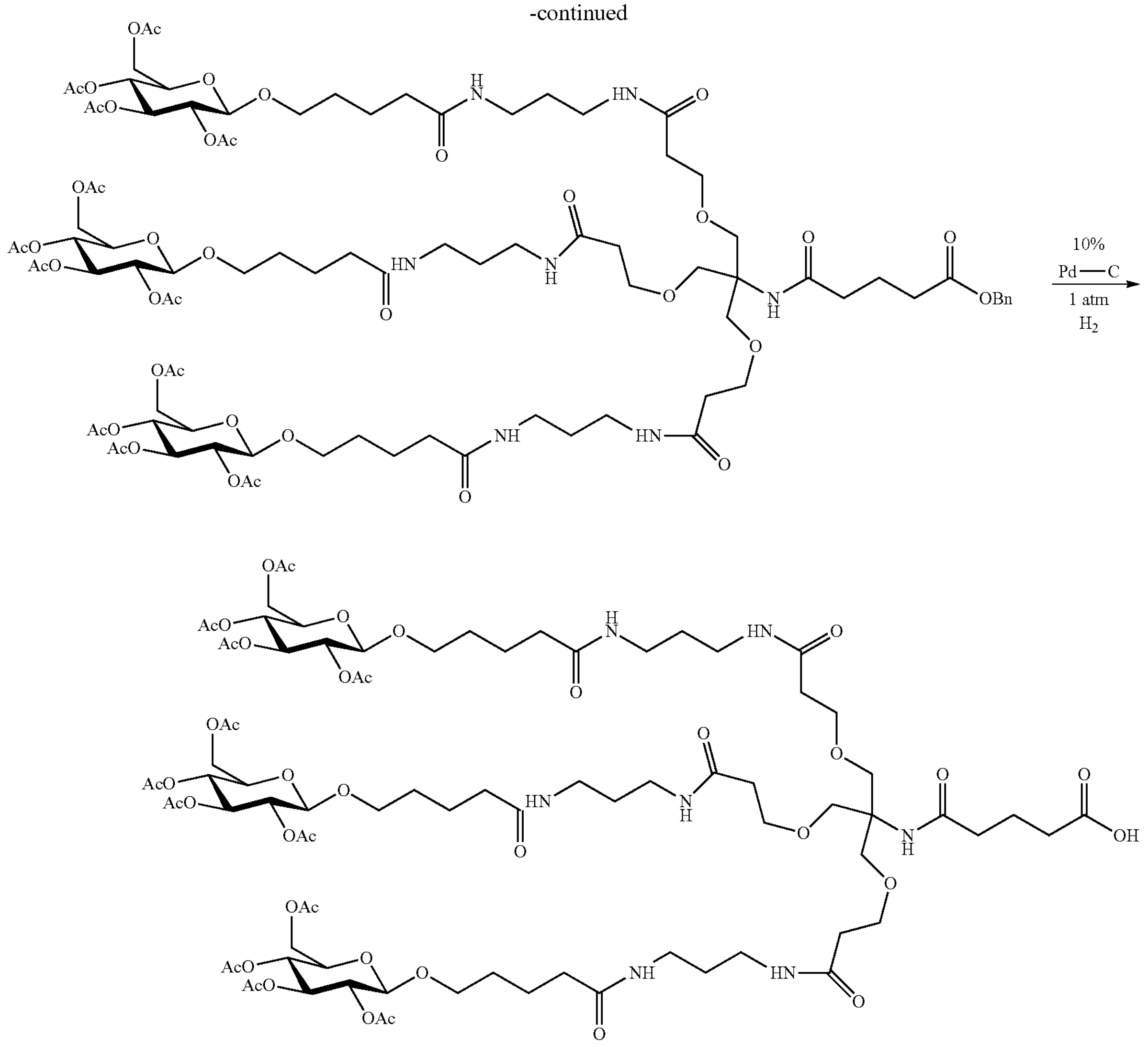

Step 1: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (2.15 g, 2.1282 mmol) in DCM (20 mL) was added TFA (5 mL). The reaction mixture was stirred at room temperature for 4 hrs. LC-MS showed the reaction was completed. Solvent was evaporated under reduced pressure to give benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate as a colorless oil. Directly use for next step without purification.

Step 2: To a solution of 5-(((2R,3R,4S,5R,6R)-3,4,5-triacetoxy-6-(acetoxymethyl)tetrahydro-2H-pyran-2-yl)oxy)pentanoic acid (3.817 g, 8.51 mmol) in DMF (20 mL) was added DIPEA (5.66 mL, 31.92 mmol) and HATU (2.824 g, 7.45 mmol) followed by benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (2.1282 mmol). The reaction mixture was stirred at room temperature for 3 hrs. Solvent was evaporated under reduced pressure to give a residue, which was purified by ISCO (120 g gold column) eluting with DCM to 50% MeOH in DCM to give 5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanoic benzyl ester (5.08 g, 120%), which containing some impurities. MS (ESI), 1001.4 ((M/2+H)$^+$.

Step 3. To a solution of 5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanoic benzyl ester (5.08 g) in EtOAc (100 mL) and MeOH (10 mL) was added 10% Pd—C(500 mg). The reaction mixture was stirred at rt for 4 hrs under hydrogen balloon. LC-MS showed the reaction was completed. The reaction mixture was filtered, washed with EtOAc/MeOH, concentrated to give 45,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanoic acid (4.60 g, 95%). MS (ESI), 1912 ((M+H)$^+$.

Synthesis of(S)-5,11,18,22-tetraoxo-16,16-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-1-(((2R,3R,4S,5R,6R)-3,4,5-triacetoxy-6-(acetoxymethyl)tetrahydro-2H-pyran-2-yl)oxy)-28-(5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanamido)-14-oxa-6,10,17,23-tetraazanonacosan-29-oic acid

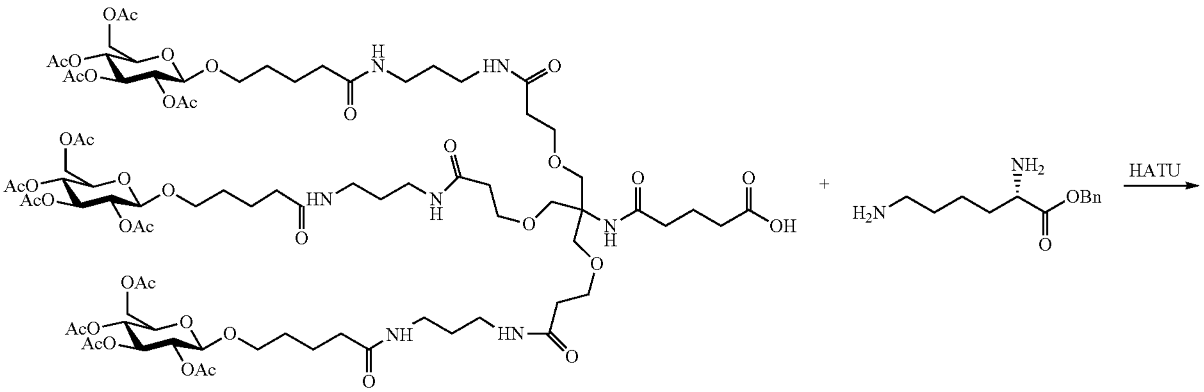

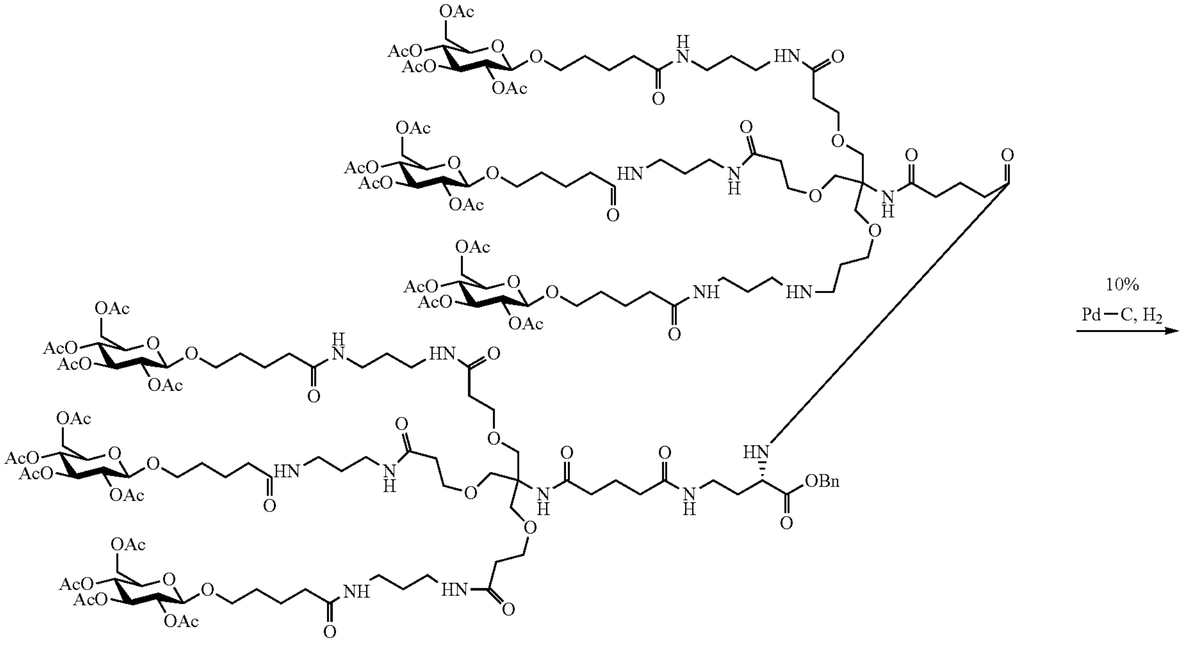

-continued

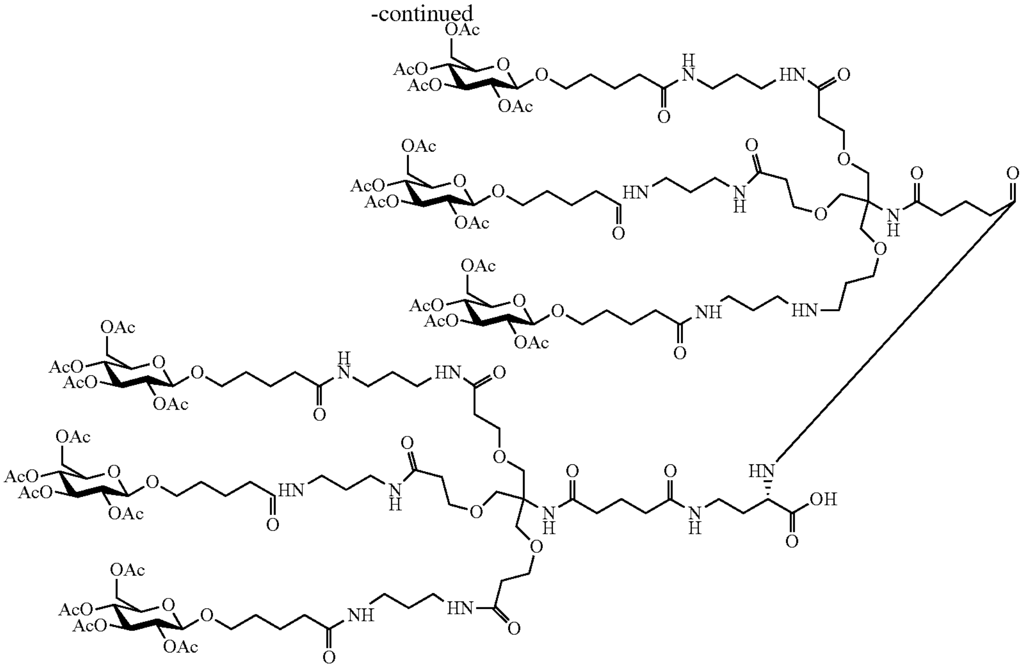

Step 1: To a solution of 5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanoic acid (987 mg, 0.520 mmol) in acetonitrile (3 mL) and DCM (10 ml) was added DIPEA (0.27 mL, 1.55 mmol) and HATU (150 mg, 0.400 mmol) followed by L-lysine benzyl ester di-4-toluensulfonate salt (100 mg, 0.170 mmol). The reaction mixture was stirred at room temperature for overnight. Solvent was evaporated under reduced pressure to give a residue, which was purified by ISCO (40 g gold column) eluting with DCM to 30% MeOH in DCM to give (S)-5,11,18,22-tetraoxo-16,16-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-1-(((2R,3R,4S,5R,6R)-3,4,5-triacetoxy-6-(acetoxymethyl)tetrahydro-2H-pyran-2-yl)oxy)-28-(5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanamido)-14-oxa-6,10,17,23-tetraazanonacosan-29-oic benzyl ester (433 mg, 63%), which containing some impurities. MS (ESI), 1342.0 ((M/3+H)$^+$.

Step 3. To a solution of(S)-5,11,18,22-tetraoxo-16,16-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-1-(((2R,3R,4S,5R,6R)-3,4,5-triacetoxy-6-(acetoxymethyl)tetrahydro-2H-pyran-2-yl)oxy)-28-(5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanamido)-14-oxa-6,10,17,23-tetraazanonacosan-29-oic benzyl ester (430 mg) in EtOAc (15 mL) and MeOH (3 mL) was added 10% Pd—C (100 mg). The reaction mixture was stirred at rt for 4 hrs under hydrogen balloon. LC-MS showed the reaction was completed. The reaction mixture was filtered, washed with EtOAc/MeOH, concentrated to give (S)-5,11,18,22-tetraoxo-16,16-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-1-(((2R,3R,4S,5R,6R)-3,4,5-triacetoxy-6-(acetoxymethyl)tetrahydro-2H-pyran-2-yl)oxy)-28-(5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanamido)-14-oxa-6,10,17,23-tetraazanonacosan-29-oic acid (400 mg, 94%). MS (ESI), 1968 ((M/2+H)$^+$.

Synthesis of WV-12567

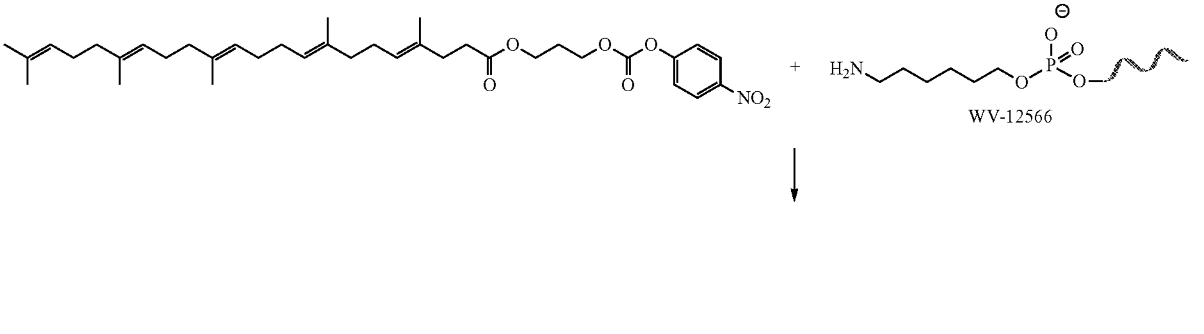

WV-12566

-continued

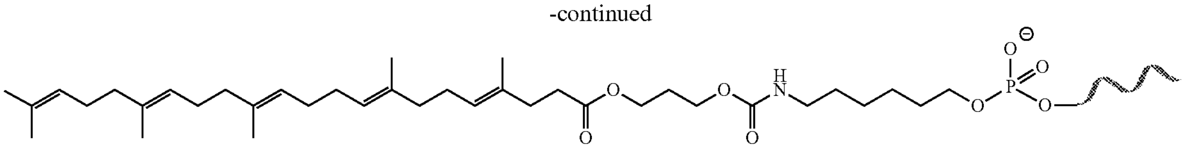

WV-12567

To a solution of WV-12566 in 0.4 ml NMP and 0.57 ml water was added DIPEA (20 μL) and a solution of 3-(((4-nitrophenoxy)carbonyl)oxy)propyl (4E,8E,12E,16E)-4,8,13,17,21-pentamethyldocosa-4,8,12,16,20-pentaenoate (20 mg) in NMP(0.40 mL). The reaction mixture was shaken for 12 hours at 35° C. LC-MS showed the starting material was disappeared. The crude product was purified on RP HPLC (C8) using 50 mM TEAA in water and acetonitrile, and desalt to obtain 1.77 mg of the conjugate WV-12567. Deconvoluted mass: 7362; Calculated molecular weight: 7360.

Synthesis of WV-12570

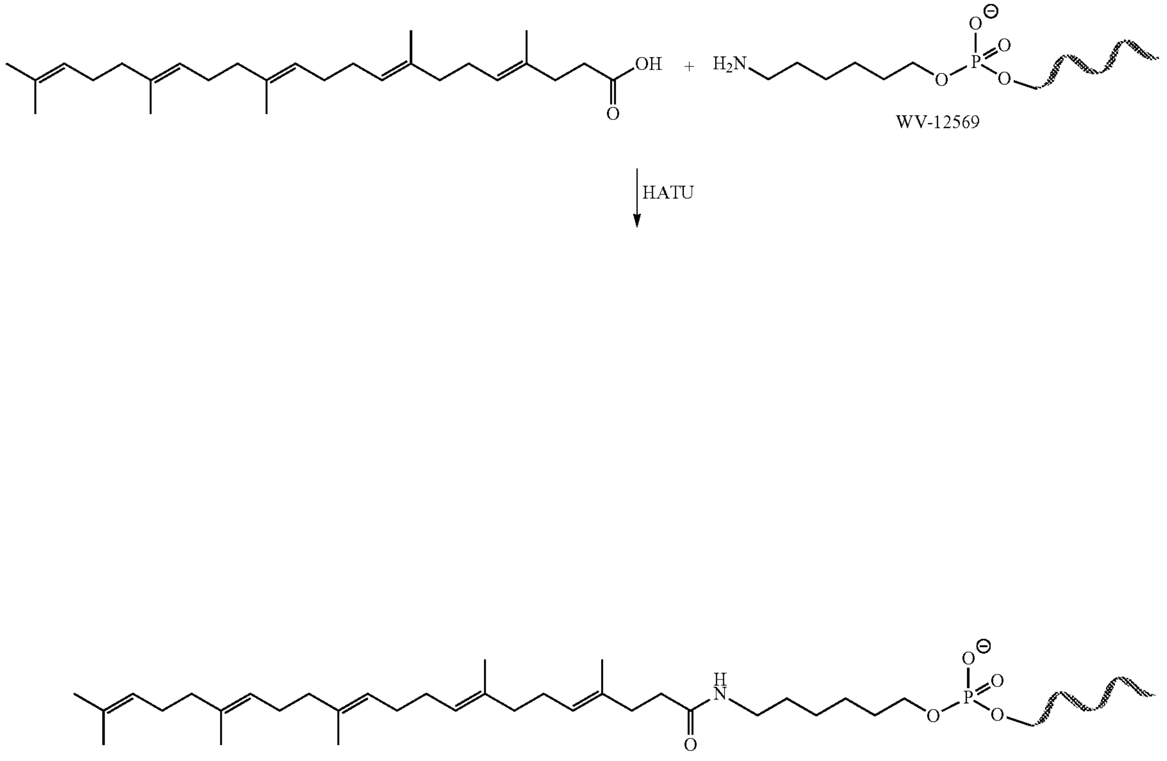

WV-12569

WV-12570

To a solution of (4E,8E,12E,16E)-4,8,13,17,21-pentamethyldocosa-4,8,12,16,20-pentaenoic acid (turbinaric acid) (6.4 mg, 16 μmol) and HATU (5.4 mg, 14.4 μmol) was added DIPEA (17 μL). The mixture was shaken for 30 min at rt. The reaction mixture was added into a solution of WV 12569 (12.4 mg, 1.6 μmol) in water (0.20 mL) and NMP (0.20 ml) and stirred for 2 hrs at 35° C. LC-MS showed the starting material was disappeared. The crude product was purified on RP (C-8) HPLC using 50 mM TEAA in water and acetonitrile, and desalt to obtain 2.10 mg of the conjugate WV-12570. Deconvoluted mass: 8172; Calculated molecular weight: 8170.

Synthesis of WV-14333

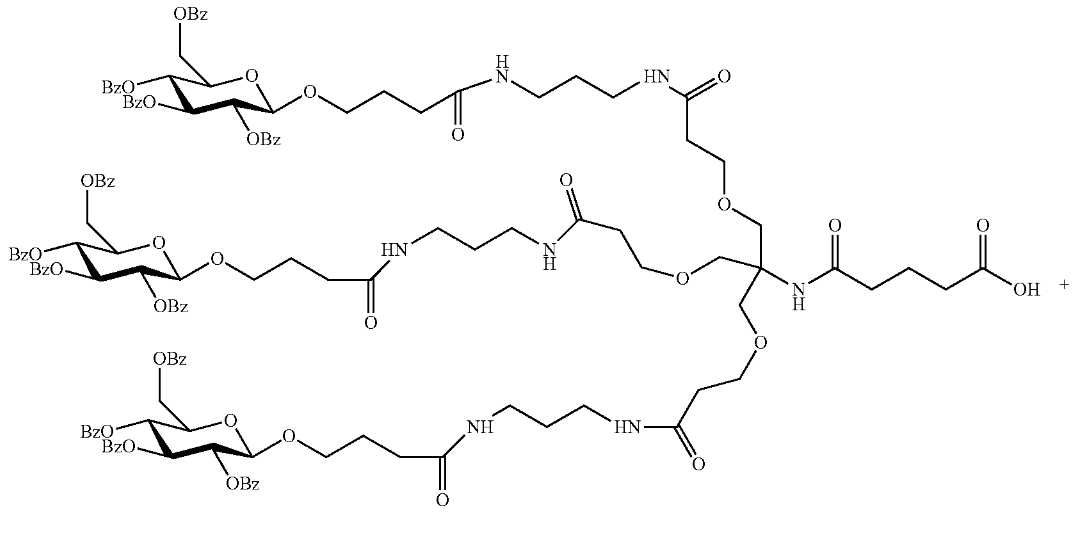

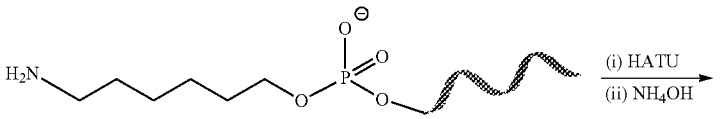

WV-12566

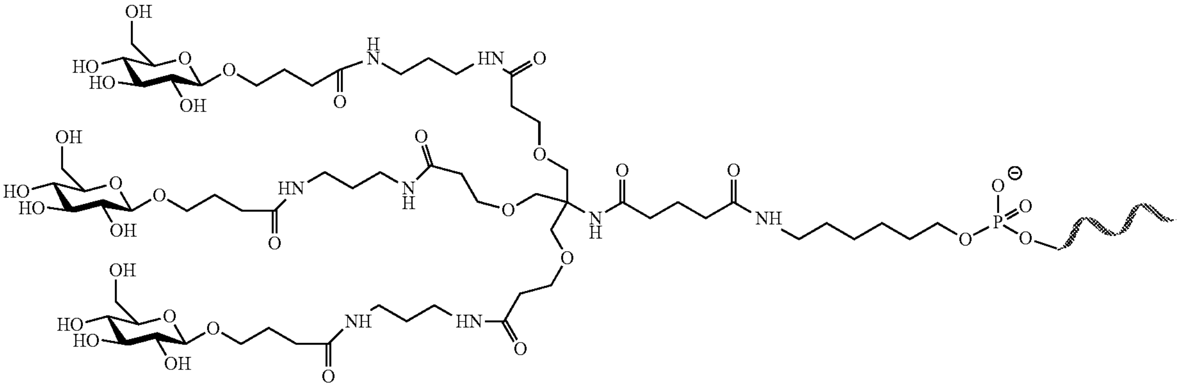

WV-14333

A solution of 4,10,17-trioxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-1-(((2R,3R,4S,5R,6R)-3,4,5-tris(benzoyloxy)-6-((benzoyloxy)methyl)tetrahydro-2H-pyran-2-yl)oxy)-13-oxa-5,9,16-triazahenicosan-21-oic acid (25.4 mg, 9.72 μmol) in acetonitrile (0.50 mL) was added HATU (3.32 mg, 8.75 μmol) and DIPEA (8.5 μL). The reaction mixture was stirred at room temperature for 30 minutes. The reaction mixture was added into a solution of WV-12566 (16.7 mg, 2.43 μmol) in 0.5 mL water. The reaction mixture was stirred at 30° C. for 2 hrs, and LC-MS showed the reaction was complete. The reaction mixture was transferred to the pressure tube, and 4 ml 28-30% ammonium hydroxide was added. The reaction mixture was stirred at 35° C. for overnight. LC-MS showed the reaction was completely de-protected. The crude product was purified by ISCO via 30 g C18 Catridge eluting with 50 mM TEAA to acetonitrile, and desalt to obtain 12.8 mg of the conjugate WV-14333. Deconvoluted mass: 8224; Calculated molecular weight: 8221.

Synthesis of WV-14332

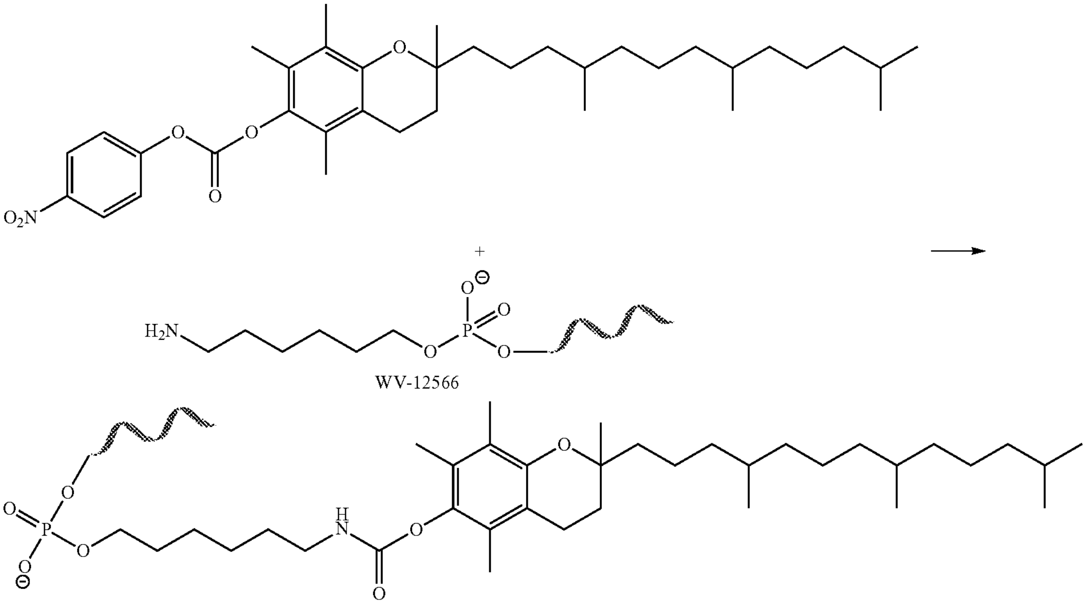

WV-12566

WV-14332

A solution of 4-nitrophenyl(2,5,7,8-tetramethyl-2-(4,8,12-trimethyltridecyl) chroman-6-yl) carbonate (7.24 mg, 12.15 μmol) and DIPEA (8.50 μL) in NMP(0.20 ml) was added to a solution of WV-12566 (16.7 mg, 2.43 μmol) in 0.5 ml DMSO and 0.05 mL water. The reaction mixture was shaken for 3 hours at 40° C. LC-MS showed the reaction was very clean. The crude product was lyophilized, purified on RP (C-8) HPLC using 50 mM TEAA in water and acetonitrile, and desalt to obtain 10 mg of the conjugate WV-14332. Deconvoluted mass: 7335; Calculated molecular weight: 7334.

Synthesis of WV-14346

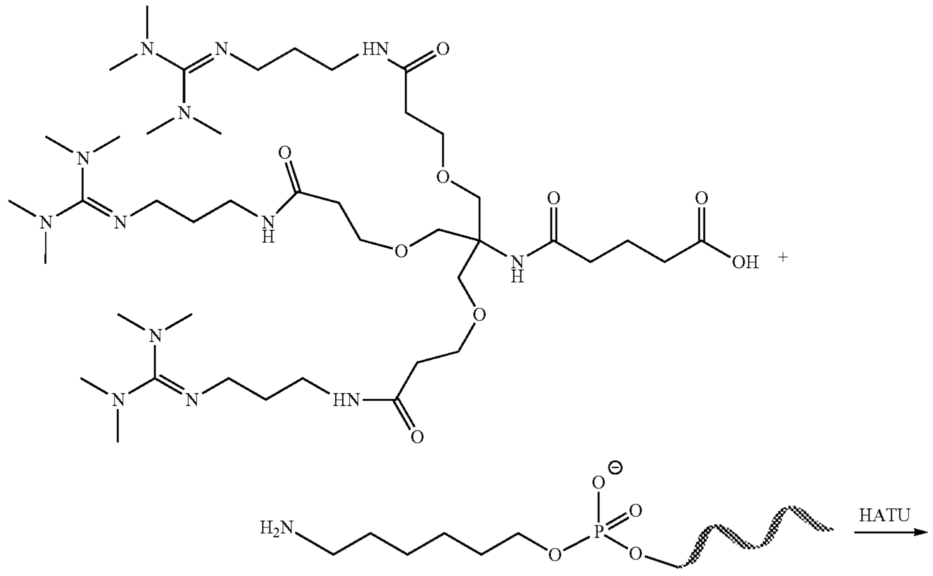

WV-12566

-continued

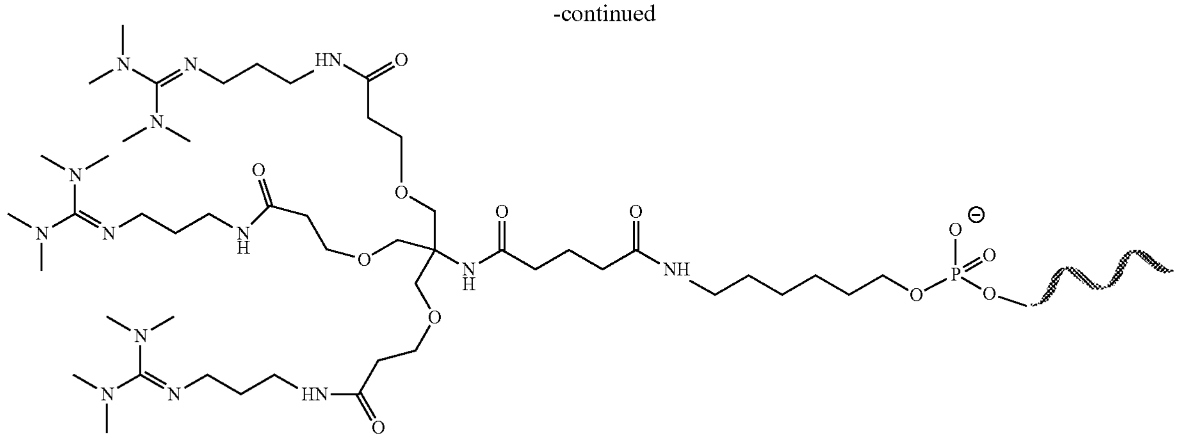

WV-14346

A solution of 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oic acid (75.26 mg, 82.34 μmol) in DMF (1.0 mL) was added DIPEA (123 μL, 0.823 mmol) and HATU (28.1 mg, 74.12 μmol). The reaction mixture was stirred at room temperature for 15 minutes. The reaction mixture was added to a solution of WV-12566 (113.22 mg, 16.47 μmol) in 1.50 ml DMSO and 0.50 mL water. The reaction mixture was shaken for 2 hours at rt. LC-MS showed the reaction was complete. The reaction mixture was diluted with water, and speed-vacuum to dry. The crude product was purified by RP-HPLC eluting with 50 mM TEAA in water to acetonitrile, and desalt to obtain 84.3 mg of the conjugate WV-14346. Deconvoluted mass: 7772; Calculated molecular weight: 7771.

Synthesis of WV-14335 (SEQ ID NO: 3252)

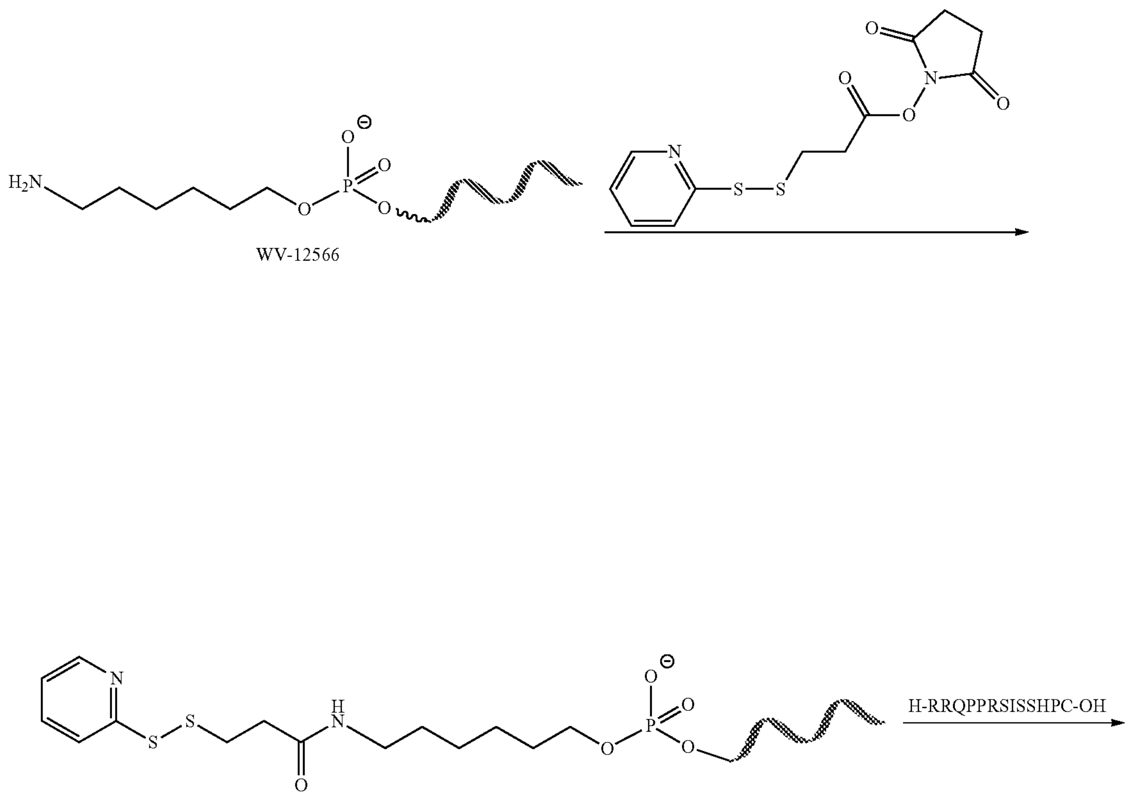

WV-12566

-continued

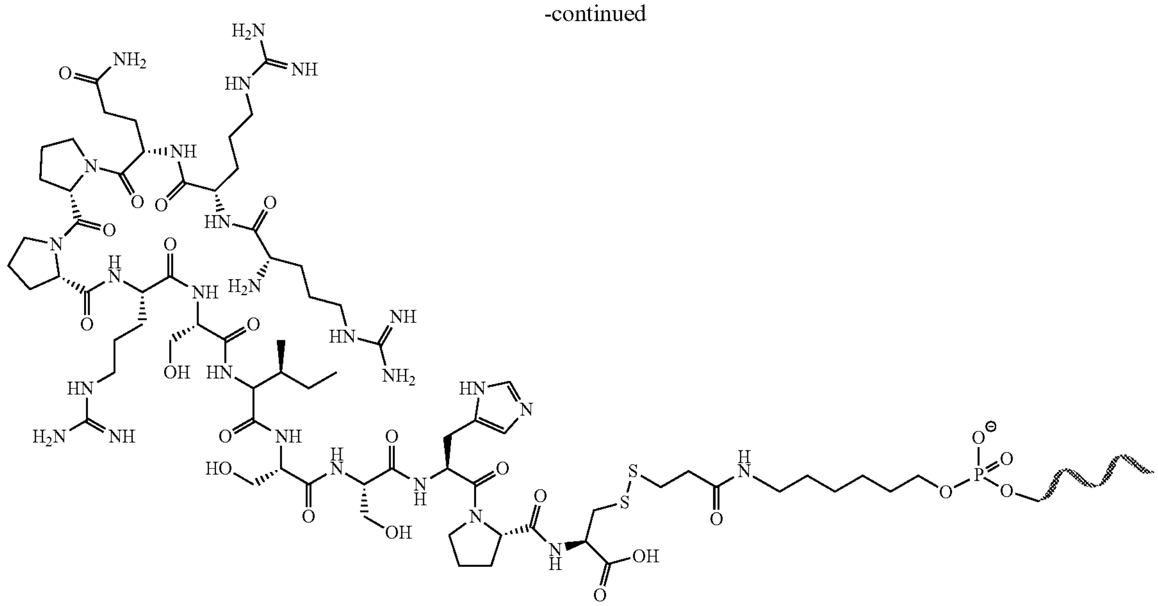

WV-14335

Step 1. A solution of 3-(2-Pyridyldithio)-propionic acid-OSu (9.08 mg) in DMF (1.0 mL) was added into a solution of WV-12566 (100 mg, 14.54 in 1.5 ml 0.5 M sodium phosphate buffer (pH=8). The reaction mixture was stirred at room temperature for 1 hr. LC-MS showed that reaction was completed. Diluted with water, and lyophilized to give the desired product.

Synthesis of WV-14335

Step 1. A solution of 3-(2-Pyridyldithio)-propionic acid-OSu (9.08 mg) in DMF (1.0 mL) was added into a solution of WV-12566 (100 mg, 14.54 in 1.5 ml 0.5 M sodium phosphate buffer (pH=8). The reaction mixture was stirred at room temperature for 1 hr. LC-MS showed that reaction was completed. Diluted with water, and lyophilized to give the desired product.

Step 2. A solution of H-RRQPPRSISSHPC-OH (SEQ ID NO: 3252) (5.47 mg, 3.6 μmol) in DMF (0.85 ml) and 0.1 M sodium bicarbonate (0.15 ml) was added to the above product (step 1) (12 mg, 1.8 μmol) in 0.1 M sodium bicarbonate (0.50 mL). The reaction mixture was shaken for 1.5 hours at rt. LC-MS showed the reaction was complete. The reaction mixture was diluted with water, and speed-vacuum to dry. The crude product was purified by RP-HPLC eluting with 50 mM TEAA in water to acetonitrile, and desalt to obtain 3.0 mg of the conjugate WV-14335. Deconvoluted mass: 8485; Calculated molecular weight: 8482.

Synthesis of WV-14347 (SEQ ID NO: 3259)

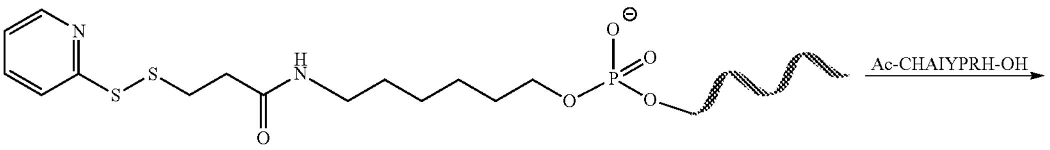

-continued

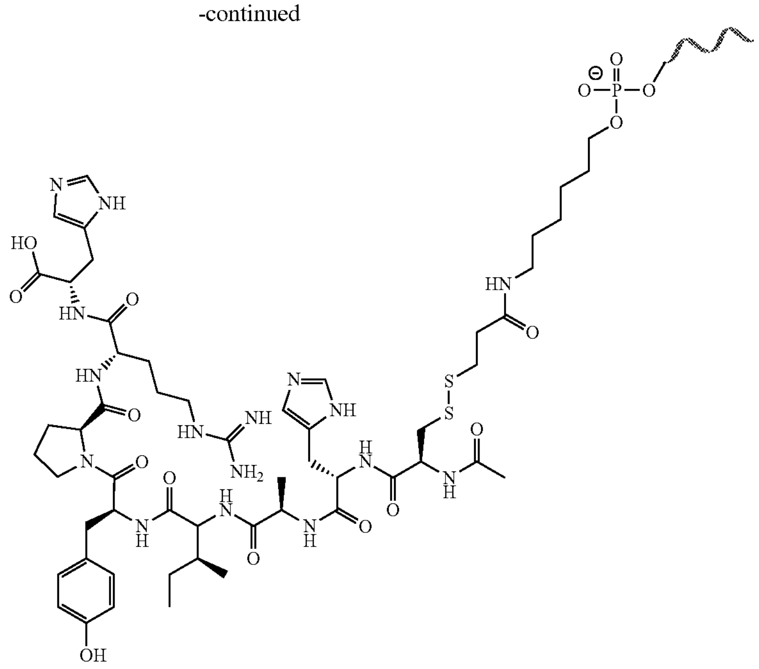

A solution of Ac-CHAIYPRH-OH (SEQ ID NO: 3259) (3.74 mg, 3.6 μmol) in DMF (0.85 mL) and 0.1 M $NaHCO_3$ (0.15 mL) was added to SPDP oligo (step 1 product of WV-14335) (12 mg, 1.8 μmol) in 0.10 M $NaHCO_3$ (0.50 mL). The reaction mixture was shaken for 1.5 hours at room temperature. LC-MS showed the reaction was complete. The reaction mixture was diluted with water, and speed-vacuum to dry. The crude product was purified by RP-HPLC eluting with 50 mM TEAA in water to acetonitrile, and desalt to obtain 8.8 mg of the conjugate WV-14347. Deconvoluted mass: 8003; Calculated molecular weight: 7999.

Synthesis of WV-14348 (SEQ ID NO: 3260)

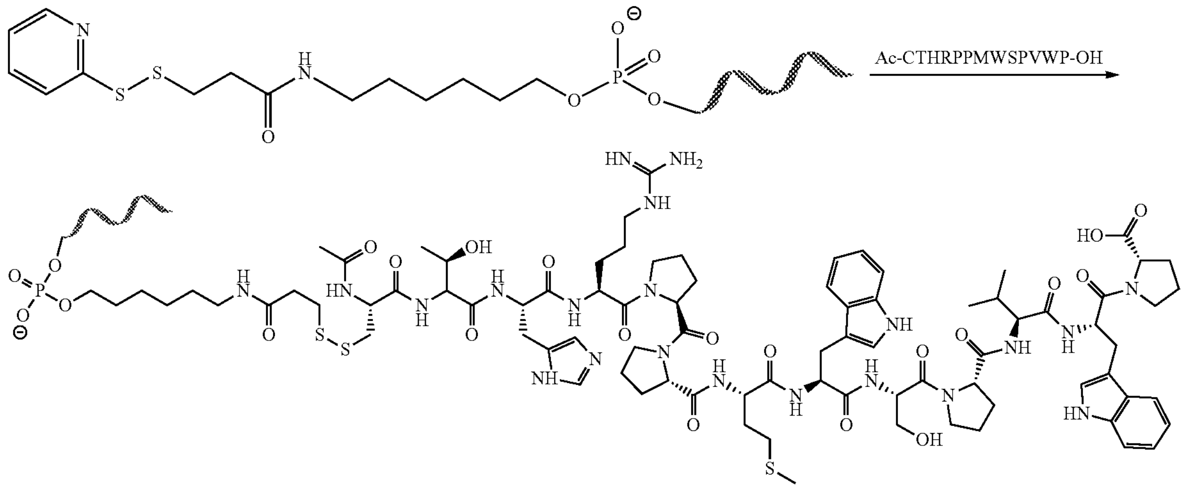

A solution of Ac-CTHRPPMWSPVWP-OH (SEQ ID NO: 3260) (5.88 mg, 3.6 μmol) in DMF (0.85 mL) and 0.1 M $NaHCO_3$ (0.15 mL) was added to SPDP oligo (step 1 product of WV-14335) (12 mg, 1.8 μmol) in 0.10 M $NaHCO_3$ (0.50 mL). The reaction mixture was shaken for 1.5 hours at room temperature. LC-MS showed the reaction was complete. The reaction mixture was diluted with water, and speed-vacuum to dry. The crude product was purified by RP-HPLC eluting with 50 mM TEAA in water to acetonitrile, and desalt to obtain 4.1 mg of the conjugate WV-14348. Deconvoluted mass: 8602; Calculated molecular weight: 8597.

Synthesis of WV-15074 (SEQ ID NO: 3259)

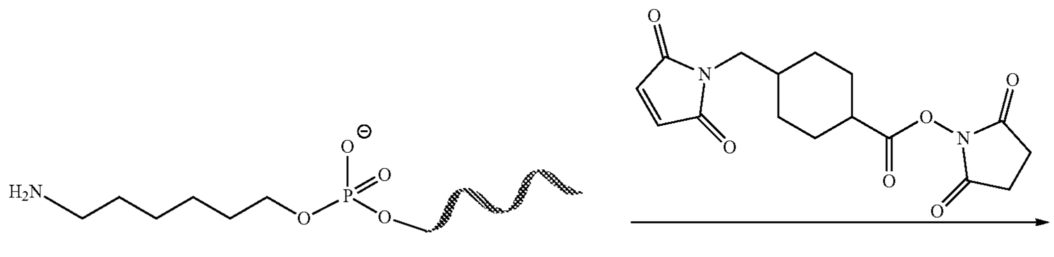

WV-12566

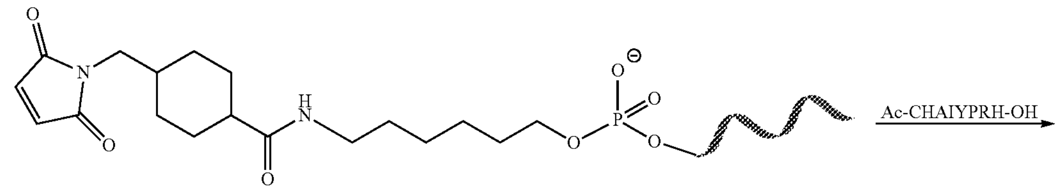

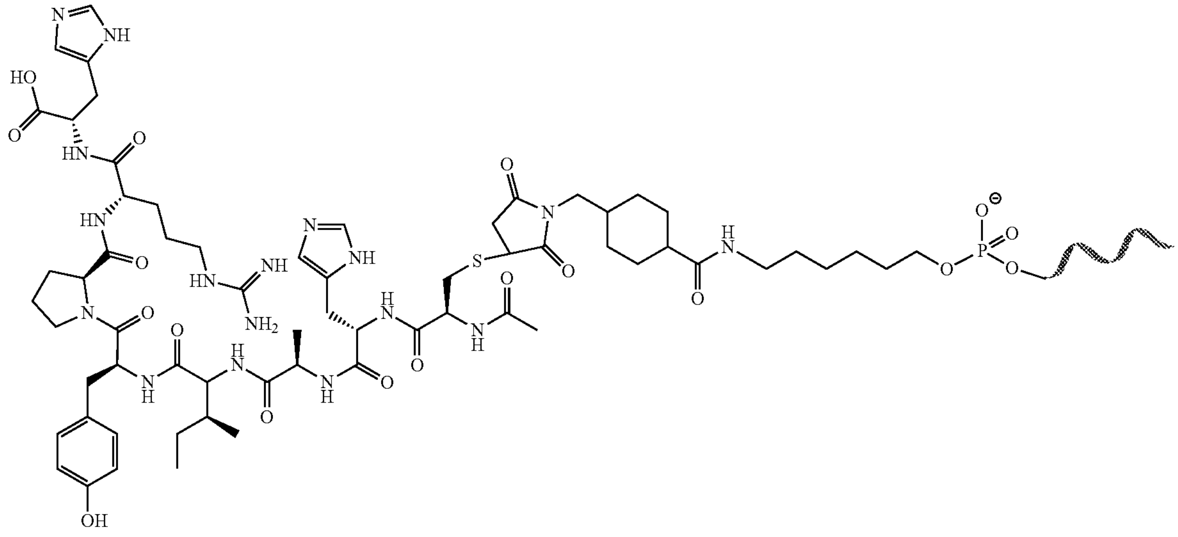

WV-15074

Step 1. A solution of 2,5-dioxopyrrolidin-1-yl 4-((2,5-dioxo-2,5-dihydro-1H-pyrrol-1-yl)methyl)cyclohexane-1-carboxylate (8.25 mg, 24.71 μmol) in DMF (0.30 mL) was added to WV-12566 (113.22 mg, 16.47 μmol) and DIPEA (31 μL, 173 μmol) in DMSO(1.50 mL) and water (0.5 mL). The reaction mixture was stirred for 30 minutes at room temperature. LC-MS showed the reaction was almost complete.

Step 2. A solution of Ac-CHAIYPRH-OH (SEQ ID NO: 3259) (38.47 mg, 37.1 μmol) in DMF (0.50 mL) was added to the above reaction mixture. The reaction mixture was stirred at room temperature for 2 hr. LC_MS showed the reaction was complete. The reaction mixture was diluted with water, and speed-vacuum to dry. The crude product was purified by RP-HPLC eluting with 50 mM TEAA in water to acetonitrile, and desalt to obtain 66.0 mg of the conjugate WV-15074. Deconvoluted mass: 8133; Calculated molecular weight: 8132.

Synthesis of WV-15075 (SEQ ID NO: 3260)

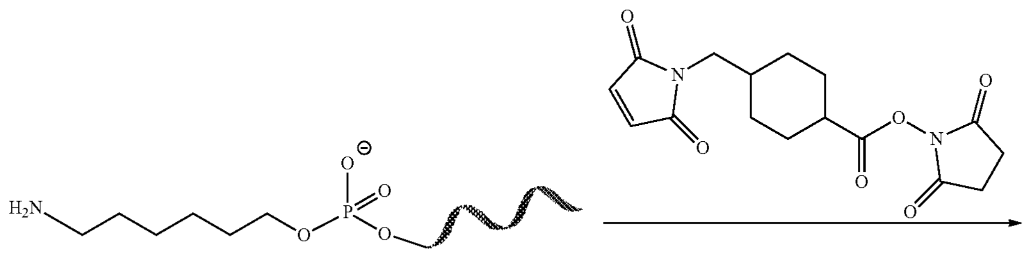

WV-12566

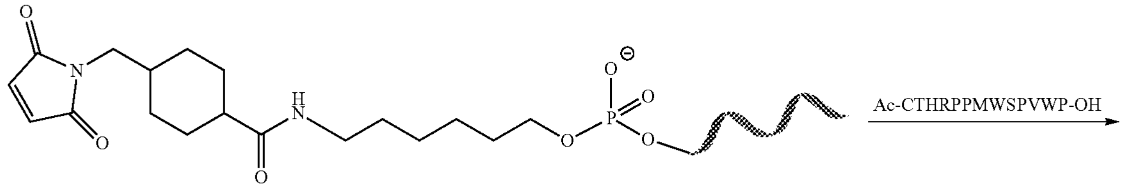

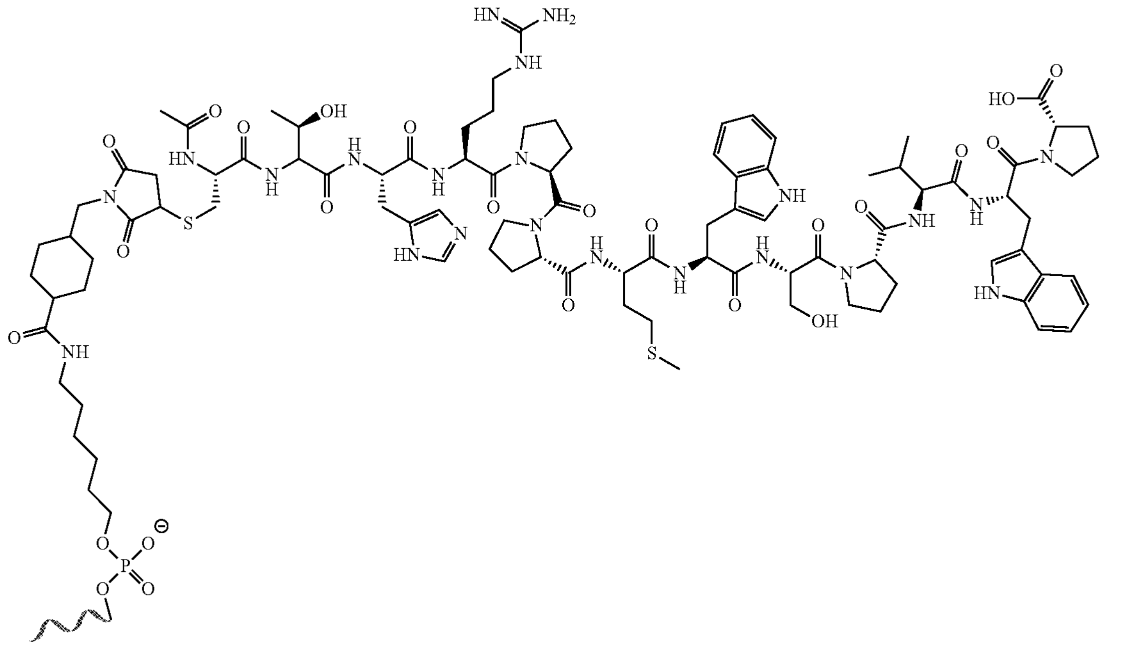

WV-15075

Step 1. A solution of 2,5-dioxopyrrolidin-1-yl 4-((2,5-dioxo-2,5-dihydro-1H-pyrrol-1-yl)methyl)cyclohexane-1-carboxylate (1.3 mg, 3.99 μmol) in DMF (0.10 mL) was added to a solution of WV-12566 (16.7 mg, 2.49 μmol) and DIPEA (3.5 μL) in DMSO(0.30 mL) and water (0.10 mL). The reaction mixture was shaken for 1 hr at room temperature. LC-MS showed the reaction was almost complete.

Step 2. A solution of Ac-CTHRPPMWSPVWP-OH (SEQ ID NO: 3260) (9.8 mg, 6.0 μmol) in DMF (0.20 mL) was added to the above reaction mixture. The reaction mixture was stirred at room temperature for 3 hrs. LC_MS showed the reaction was complete. The reaction mixture was diluted with water, and speed-vacuum to dry. The crude product was purified by RP-HPLC eluting with 50 mM TEAA in water to acetonitrile, and desalt to obtain 8.9 mg of the conjugate WV-15075. Deconvoluted mass: 8735; Calculated molecular weight: 8730.

Synthesis of WV-15076 (SEQ ID NO: 3252)

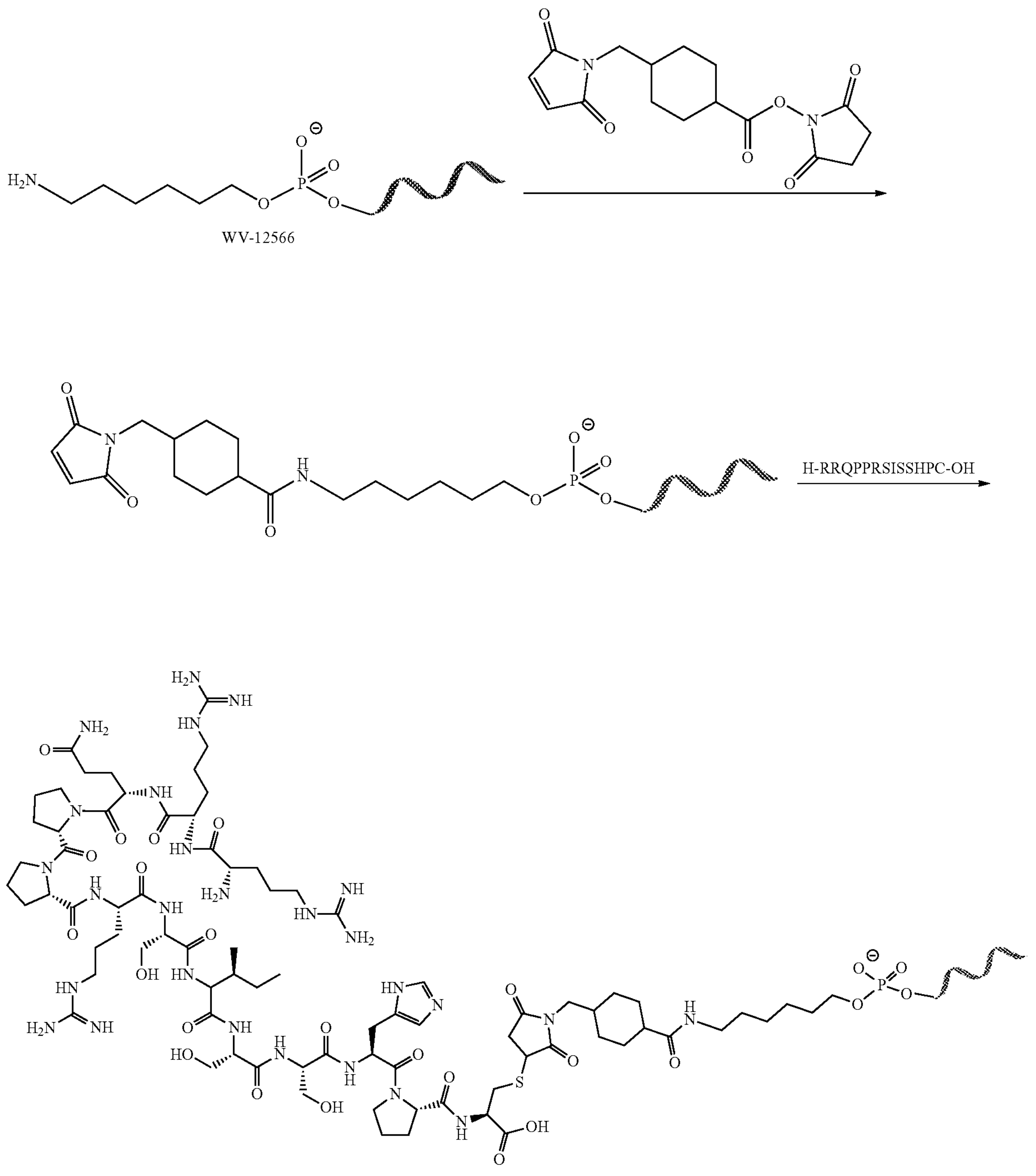

WV-12566

WV-15076

Step 1. A solution of 2,5-dioxopyrrolidin-1-yl 4-((2,5-dioxo-2,5-dihydro-1H-pyrrol-1-yl)methyl)cyclohexane-1-carboxylate (1.3 mg, 3.99 μmol) in DMF (0.10 mL) was added to a solution of WV-12566 (16.7 mg, 2.49 μmol) and DIPEA (3.5 μL) in DMSO(0.30 mL) and water (0.10 mL). The reaction mixture was shaken for 1 hr at room temperature. LC-MS showed the reaction was almost complete.

Step 2. A solution of H-RRQPPRSISSHPC-OH (SEQ ID NO: 3252) (9.1 mg, 6.0 μmol) in DMF (0.20 mL) was added to the above reaction mixture. The reaction mixture was stirred at room temperature for 3 hrs. LC_MS showed the reaction was complete. The reaction mixture was diluted with water, and speed-vacuum to dry. The crude product was purified by RP-HPLC eluting with 50 mM TEAA in water to acetonitrile, and desalt to obtain 4.7 mg of the conjugate WV-15076. Deconvoluted mass: 8735; Calculated molecular weight: 8730.

Synthesis of WV-15367

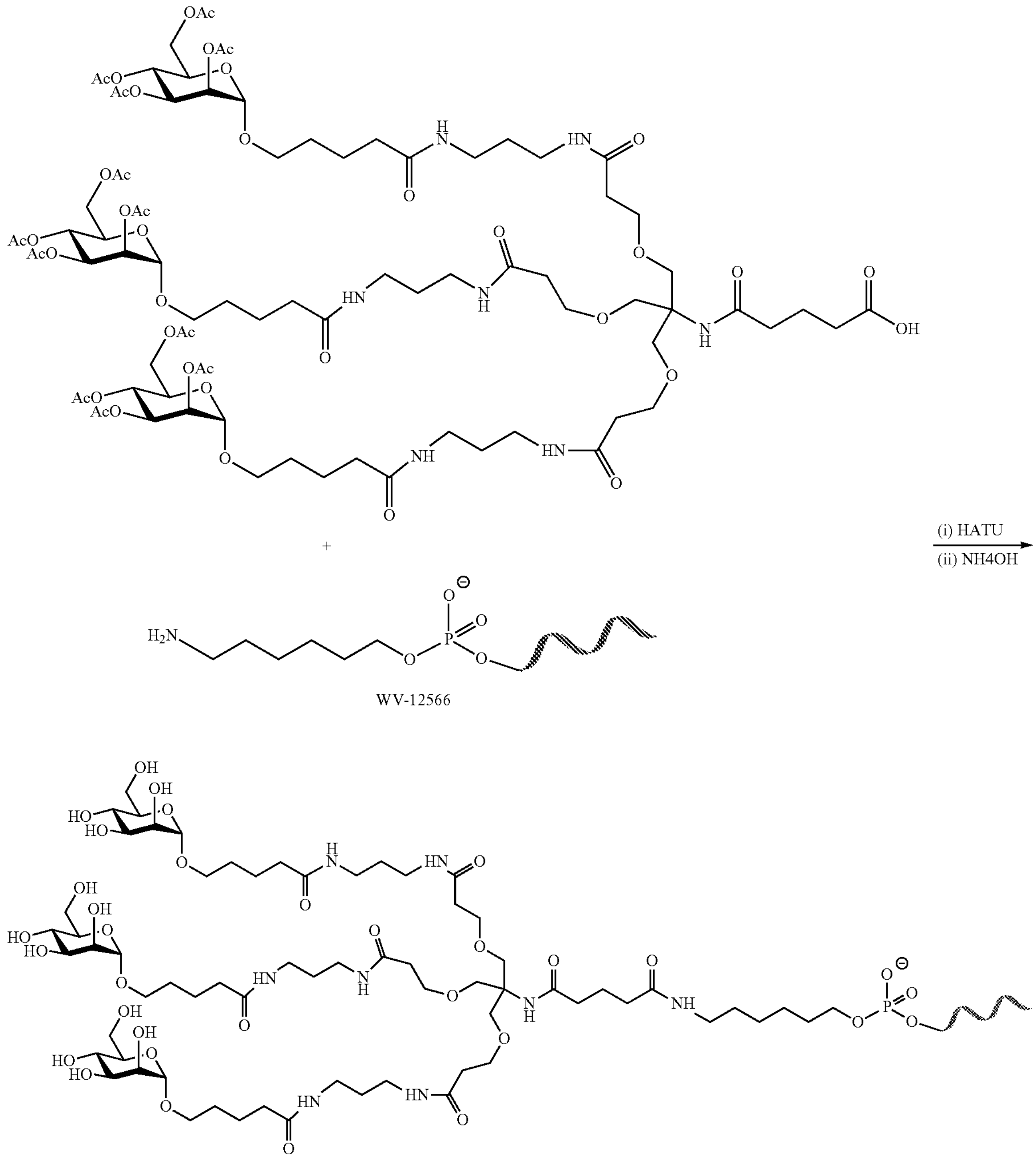

WV-12566

WV-15367

A solution of 5,12,18-trioxo-7,7-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-22-(((2S,3S,4S,5R,6R)-3,4,5-triacetoxy-6-(acetoxymethyl)tetrahydro-2H-pyran-2-yl)oxy)-9-oxa-6,13,17-triazadocosanoic acid (13.9 mg, 7.29 μmol) in DMF (0.50 mL) was added DIPEA (6.3 μL, 36.4 μmol) and HATU (2.3 mg, 6.0 μmol). The reaction mixture was stirred at room temperature for 30 minutes. The reaction mixture was added to a solution of WV-12566 (16.7 mg, 2.43 μmol) in 0.30 ml DMSO and 0.10 mL water. The reaction mixture was shaken for 2 hours at rt. LC_MS showed the reaction was complete. The reaction mixture was added 28-30% ammonium hydroxide, stirred at 40° C. for 3 hrs. LC MS showed the reaction was complete. The reaction mixture was diluted with water, and speed-vacuum to dry. The crude product was purified by RP-HPLC eluting with 50 mM TEAA in water to acetonitrile, and desalt to obtain 9.2 mg of the conjugate WV-15367. Deconvoluted mass: 8269; Calculated molecular weight: 8263.

Synthesis of WV-15368
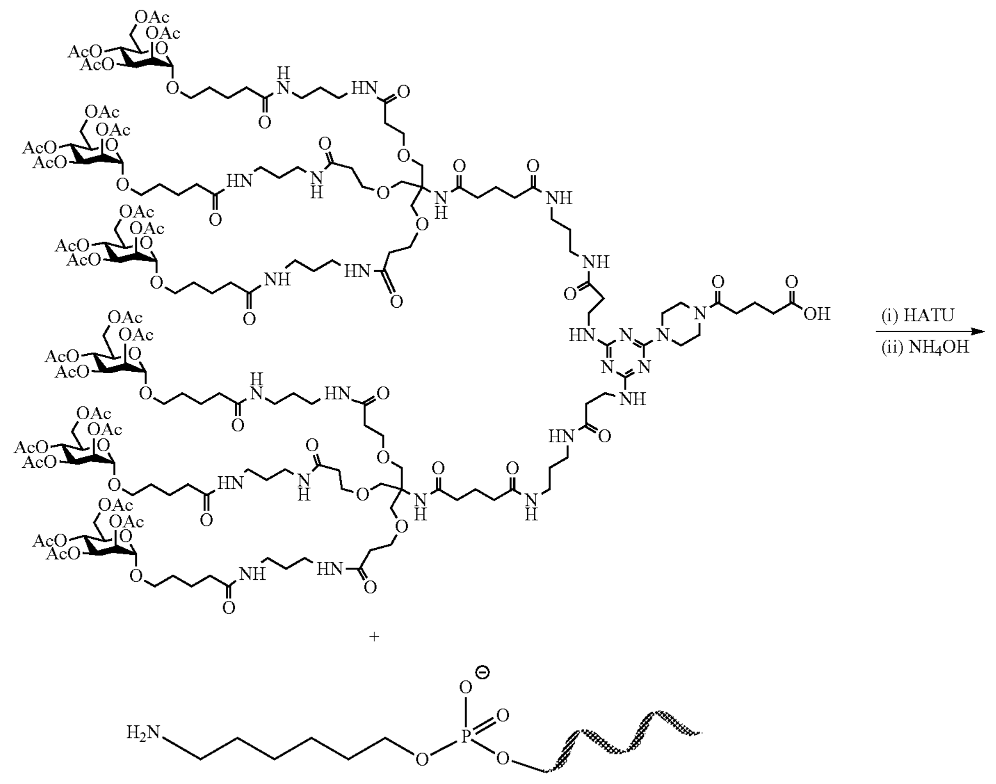
WV-12566
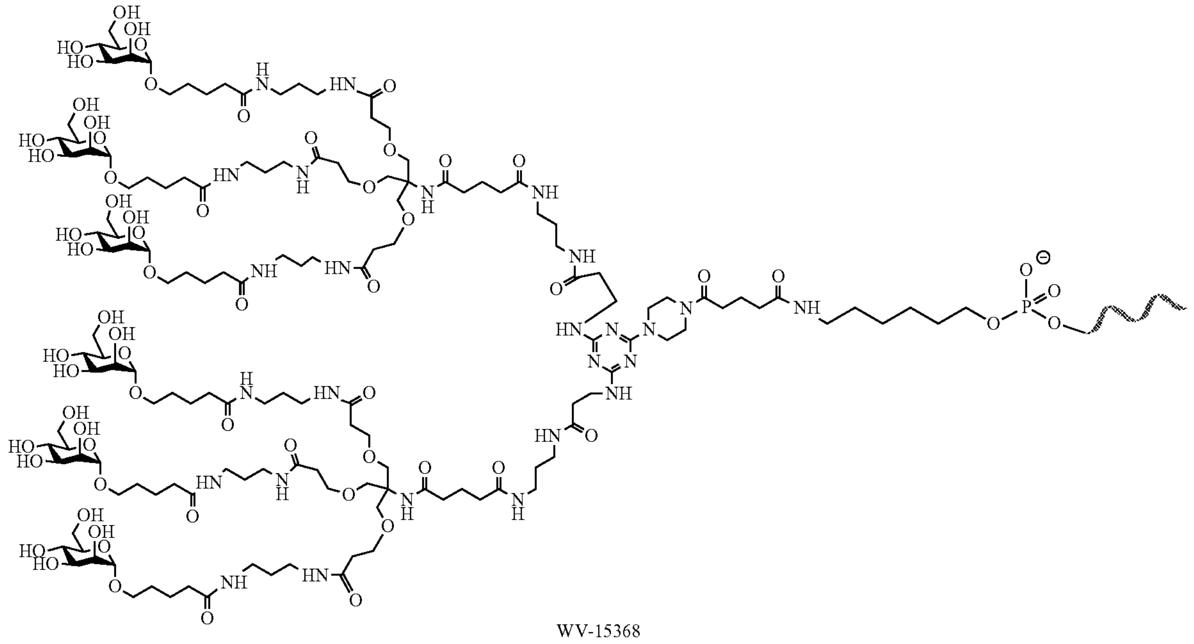
WV-15368

A solution of 5-(4-(4,6-bis((3,9,13,20,26-pentaoxo-15,15-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-30-(((2S,3S,4S,5R,6R)-3,4,5-triacetoxy-6-(acetoxymethyl)tetrahydro-2H-pyran-2-yl)oxy)-17-oxa-4,8,14,21,25-pentaazatriacontyl)amino)-1,3,5-triazin-2-yl) piperazin-1-yl)-5-oxopentanoic acid (31.7 mg, 7.29 μmol) in DMF (0.50 mL) was added DIPEA (6.3 μL 36.4 μmol) and HATU (2.3 mg, 6.0 μmol). The reaction mixture was stirred at room temperature for 30 minutes. The reaction mixture was added to a solution of WV-12566 (16.7 mg, 2.43 μmol) in 0.30 ml DMSO and 0.10 mL water. The reaction mixture was shaken for 2 hours at rt. LC_MS showed the reaction was complete. The reaction mixture was added 28-30% ammonium hydroxide (1.0 mL), stirred at 40° C. for 5 hrs. LC_MS showed the reaction was complete. The reaction mixture was diluted with water, and speed-vacuum to dry. The crude product was purified by RP-HPLC eluting with 50 mM TEAA in water to acetonitrile, and desalt to obtain 7.5 mg of the conjugate WV-15368. Deconvoluted mass: 10206; Calculated molecular weight: 10200.

Synthesis of WV-15882

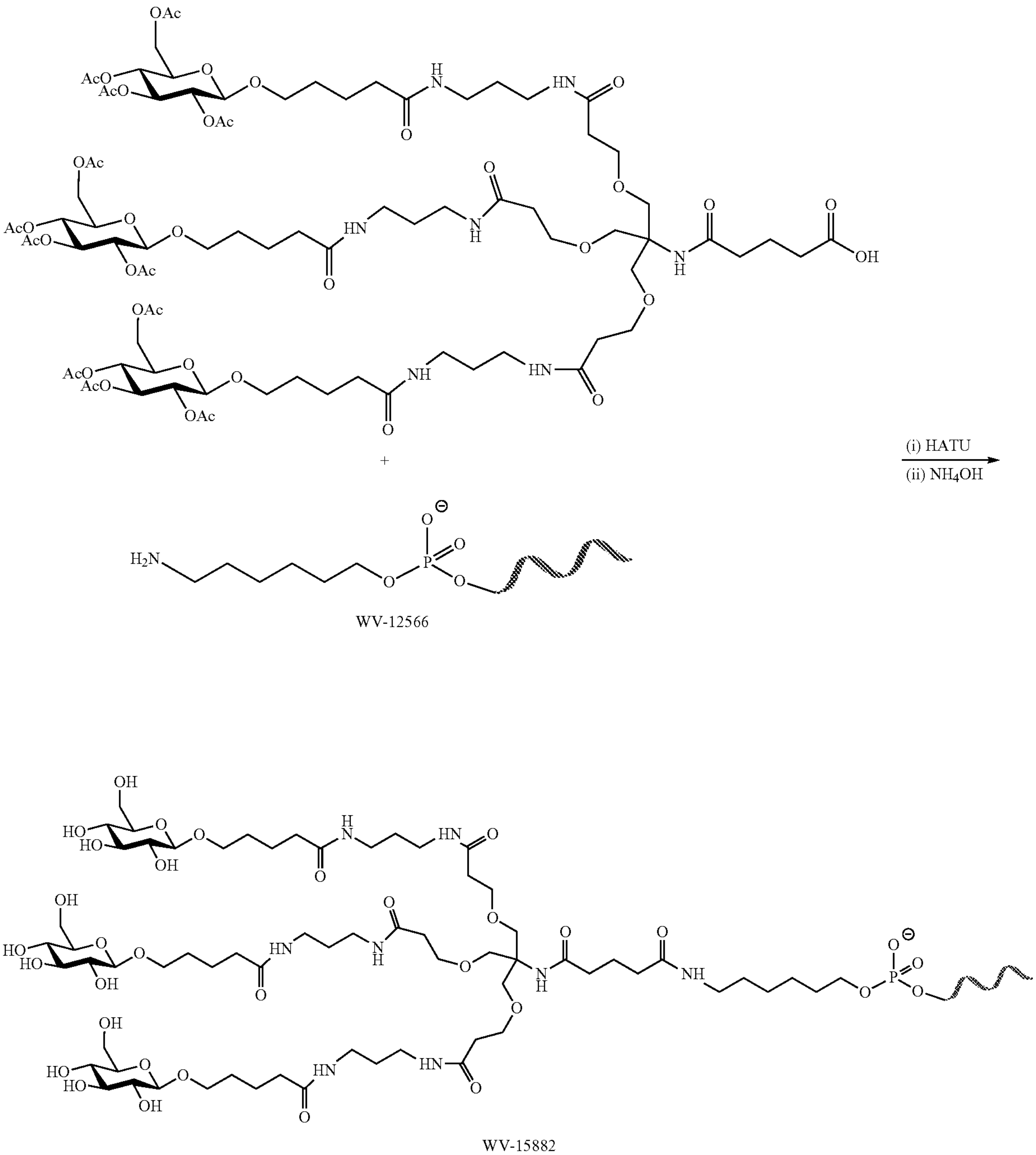

WV-12566

WV-15882

A solution of 5,12,18-trioxo-7,7-bis((3-oxo-3-((3-(5-(((2R,3R,4S,5R,6R)-3,4,5-triacetoxy-6-(acetoxymethyl)tetrahydro-2H-pyran-2-yl)oxy)pentanamido)propyl)amino)propoxy)methyl)-22-(((2R,3R,4S,5R,6R)-3,4,5-triacetoxy-6-(acetoxymethyl)tetrahydro-2H-pyran-2-yl)oxy)-9-oxa-6,13,17-triazadocosanoic acid (102 mg, 53.43 μmol) in DMF (1.0 mL) was added DIPEA (46.8 μL, 266.5 μmol) and HATU (13.5 mg, 35.68 μmol). The reaction mixture was stirred at room temperature for 30 minutes. The reaction mixture was added to a solution of WV-12566 (122.65 mg, 17.84 μmol) in 1.5 ml DMSO and 0.50 mL water. The reaction mixture was shaken for 1.5 hours at rt. LC MS showed the reaction was completed. The reaction mixture was added 28-20% ammonium hydroxide (5.0 mL) and stirred at 35° C. for 1.5 hrs. LC_MS showed the reaction was complete. The reaction mixture was diluted with water, and speed-vacuum to dry. The crude product was purified by RP-HPLC eluting with 50 mM TEAA in water to acetonitrile, and desalt to obtain 83.8 mg of the conjugate WV-15882. Deconvoluted mass: 8263; Calculated molecular weight: 8264.

Some of the examples reference oligonucleotides which target Malat1. Some of these oligonucleotides are described elsewhere herein and/or below.

| Oligo-nucleotide | Modified Sequence | SEQ ID NO: | Naked Sequence | Stereo-chemistry |
|---|---|---|---|---|
| WV-2809 | L001 * Geo * Geo * Geo * Teo * m5Ceo * A * G * C * T * G * C * C * A * A * T * Geo * m5Ceo * Teo * Aeo * Geo | 3261 | GGGTCAGCTGCCAATGCTAG | XXXXXXXXXXXXXXXXXXXX |
| WV-3356 | L001Geo * Geo * Geo * Teo * m5Ceo * A * G * C * T * G * C * C * A * A * T * Geo * m5Ceo * Teo * Aeo * Geo | 3262 | GGGTCAGCTGCCAATGCTAG | OXXXXXXXXXXXXXXXXXXX |
| WV-7430 | Mod043L001Geo * Geo * Geo * Teo * m5Ceo * A * G * C * T * G * C * C * A * A* T* Geo * m5Ceo * Teo * Aeo * Geo | 3263 | GGGTCAGCTGCCAATGCTAG | OXXXXXXXXXXXXXXXXXXX |
| WV-7519 | Mod009L001 * Geo * Geo * Geo * Teo * m5Ceo * A * G * C * T * G * C * C * A * A * T * Geo * m5Ceo * Teo * Aeo * Geo | 3264 | GGGTCAGCTGCCAATGCTAG | XXXXXXXXXXXXXXXXXXXX |
| WV-7557 | L001mU * Geo * Geo * Geo * Teo * * C * T * G * G * T * T * A * T * mG * mA * mC * mU * mC | 3265 | UGCCAGGCTGGTTATGACUC | OXXXXXXXXXXXXXXXXXXX |
| WV-7558 | Mod027L001mU * mG * mC * mC * mA * G * G * C * T * G * G * T * T * A * T * mG * mA * mC * mU * mC | 3266 | UGCCAGGCTGGTTATGACUC | OXXXXXXXXXXXXXXXXXXX |
| WV-7559 | Mod028L001mU * mG * mC * mC * mA * G * G * C * T * G * G * T * T * A * T * mG * mA * mC * mU * mC | 3267 | UGCCAGGCTGGTTATGACUC | OXXXXXXXXXXXXXXXXXXX |
| WV-7560 | Mod007L001mU * mG * mC * mC * mA * G * G * C * T * G * G * T * T * A * T * mG * mA * mC * mU * mC | 3268 | UGCCAGGCTGGTTATGACUC | OXXXXXXXXXXXXXXXXXXX |
| WV-8448 | Mod059L001mU * mG * mC * mC * mA * G * G * C * T * G * G * T * T * A * T * mG * mA * mC * mU * mC | 3269 | UGCCAGGCTGGTTATGACUC | OXXXXXXXXXXXXXXXXXXX |
| WV-8927 | Mod053L001mU * mG * mC * mC * mA * G * G * C * T * G * G* T * T * A * T * mG * mA * mC * mU * mC | 3270 | UGCCAGGCTGGTTATGACUC | OXXXXXXXXXXXXXXXXXXX |
| WV-8929 | Mod057L001mU * mG * mC * mC * mA * G * G * C * T * G * G * T * T * A * T * mG * mA * mC * mU * mC | 3271 | UGCCAGGCTGGTTATGACUC | OXXXXXXXXXXXXXXXXXXX |
| WV-8930 | Mod058L001mU * mG * mC * mC * mA * G * G *C * T * G * G * T * T * A * T * mG * mA * mC * mU * mC | 3272 | UGCCAGGCTGGTTATGACUC | OXXXXXXXXXXXXXXXXXXX |
| WV-8931 | Mod009L001mU * mG * mC * mC * mA * G * G *C * T * G * G * T * T * A * T * mG * mA * mC * mU * mC | 3273 | UGCCAGGCTGGTTATGACUC | OXXXXXXXXXXXXXXXXXXX |
| WV-8934 | Mod050L001mU * mG * mC * mC * mA * G * G * C * T * G * G * T * T * A * T * mG * mA * mC * mU * mC | 3274 | UGCCAGGCTGGTTATGACUC | OXXXXXXXXXXXXXXXXXXX |
| WV-9385 | Mod066L001mU * mG * mC * mC * mA * G * G * C * T * G * G * T * T * A * T * mG * mA * mC * mU * mC | 3275 | UGCCAGGCTGGTTATGACUC | OXXXXXXXXXXXXXXXXXXX |
| WV-9390 | Mod074L001m1U * mG * mC * mC * mA * G * G * C * T * G * G * T * T * A * T * mG * mA * mC * mU * mC | 3276 | UGCCAGGCTGGTTATGACUC | OXXXXXXXXXXXXXXXXXXX |
| WV-13809 | Mod0971001mU * SGeom5Ceom5CeomA * SG * SG * RC * ST * SG * RG * ST * ST * RA * ST * SmG * SmA * SmC * SmU * SmC | 3277 | UGCCAGGCTGGTTATGACUC | OSOOOSSRSSRSSRSSSSSS |
| WV-27145 | mU * SGCCmA * SG * SG * RC * STn001G * RG * ST * ST * RA * ST * SmG * SmA * SmC * SmU * SmC * SfU | 3278 | UGCCAGGCTGGTTATGACUCU | SOOOSSRSnXRSSRSSSSSSS |

The Modifications (e.g., designated by Mod followed by a number, such as Mod097, Mod074, etc.) are described in the legend to Table A1 or elsewhere herein.

Synthesis of WV-13809

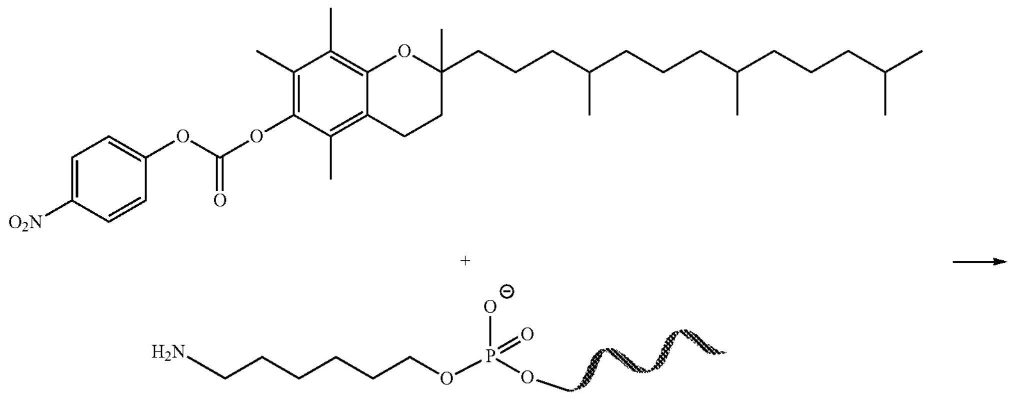

WV-9696

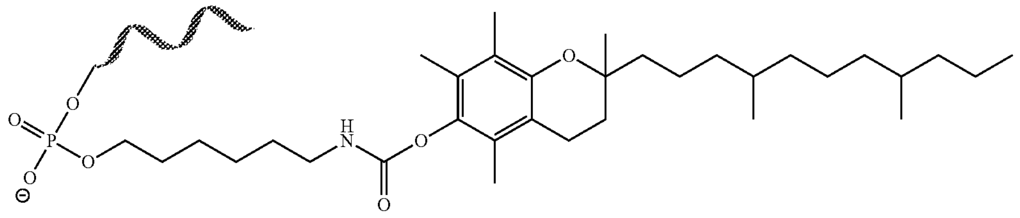

WV-13809

A solution of 4-nitrophenyl(2,5,7,8-tetramethyl-2-(4,8,12-trimethyltridecyl) chroman-6-yl) carbonate (activated vitamin E) (15 mg, 25 μmol) and DIPEA (21 μL) in NMP(0.20 ml) was added to a solution of WV-9696 in 0.5 ml DMSO and 0.05 ml water. The reaction mixture was shaken for 2 hrs at 50° C. LC-MS showed the reaction was completed. The crude product was lyophilized, purified on RP (C-8) HPLC using 50 mM TEAA in water and acetonitrile, and desalt to obtain 4.90 mg of the conjugate WV-13809. Deconvoluted mass: 7451; Calculated molecular weight: 7451.

Synthesis of WV-14349

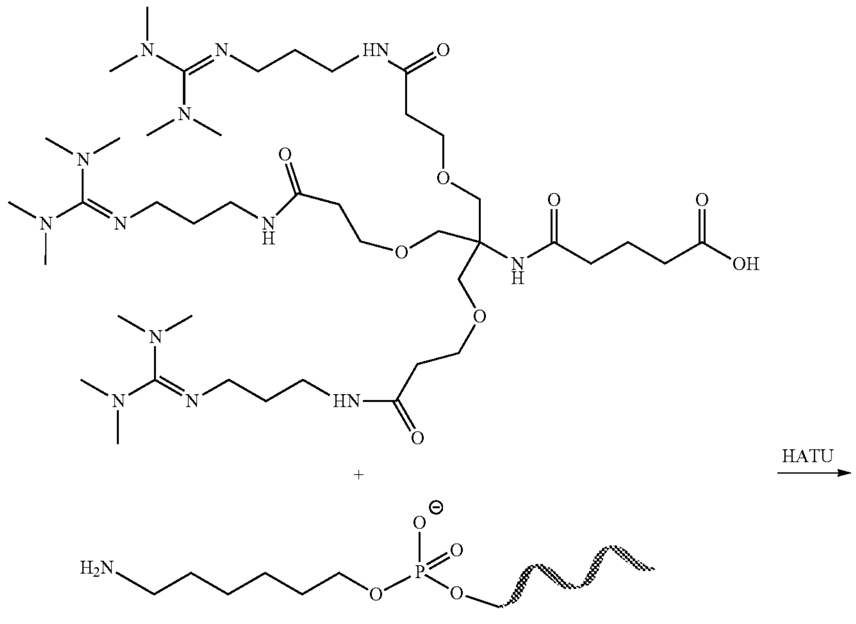

WV-9696

-continued

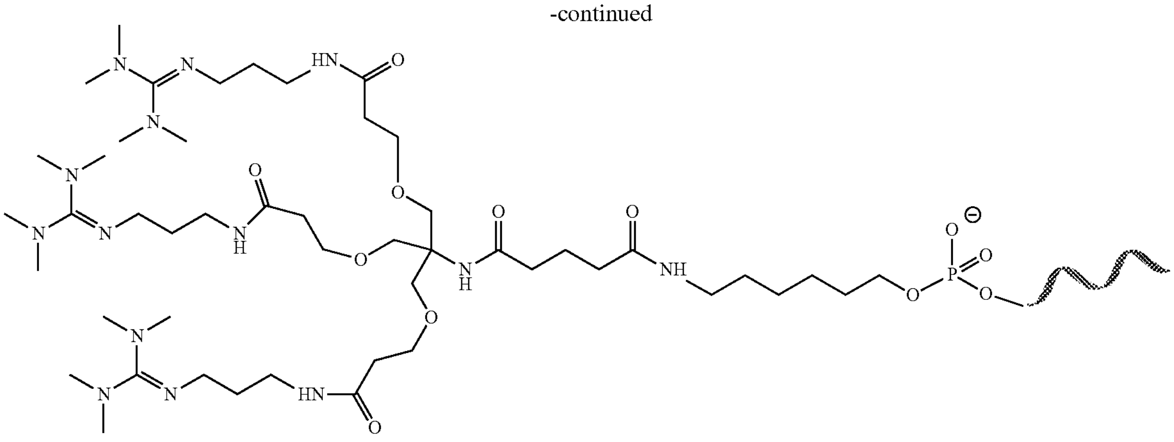

WV-14349

A solution of 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oic acid (19.61 mg, 21.45 μmol) in DMF (0.30 mL) was added DIPEA (75 μL) and HATU (7.32 mg, 19.31 μmol). The reaction mixture was stirred at room temperature for 20 minutes. The reaction mixture was added to a solution of WV-9696 (30 mg, 4.29 μmol) in 0.4 ml DMSO and 0.10 mL water. The reaction mixture was shaken at rt for overnight. LC_MS showed the reaction was not complete. A solution of 3-(dimethylamino)-14,14-bis(3-(dimethylamino)-2-methyl-9-oxo-12-oxa-2,4,8-triazatridec-3-en-13-yl)-2-methyl-9,16-dioxo-12-oxa-2,4,8,15-tetraazaicos-3-en-20-oic acid (10 mg) in DMF (0.10 mL) was added DIPEA (38 μL) and HATU (3.7 mg). The reaction mixture was stirred at room temperature for 20 minutes. The reaction mixture was added into the above the reaction mixture with WV-9696. The reaction mixture was stirred at 30° C. for 2 hrs. LC MS showed the reaction was completed. The reaction mixture was diluted with water, and speed-vacuum to dry. The crude product was purified by RP-HPLC eluting with 50 mM TEAA in water to acetonitrile, and desalt to obtain 9.1 mg of the conjugate WV-14349. Deconvoluted mass: 7893; Calculated molecular weight: 7889.

Synthesis of WV8448

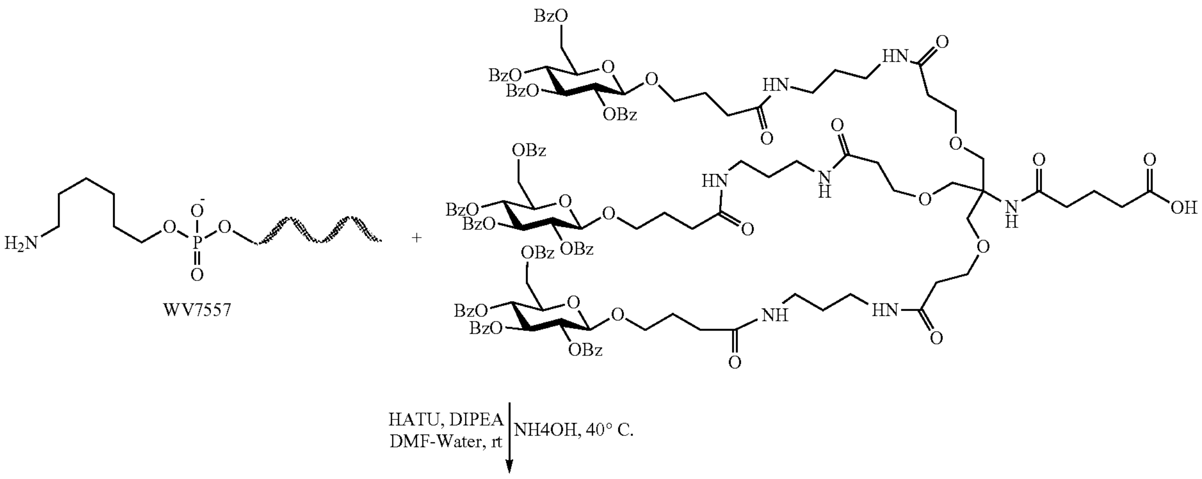

-continued

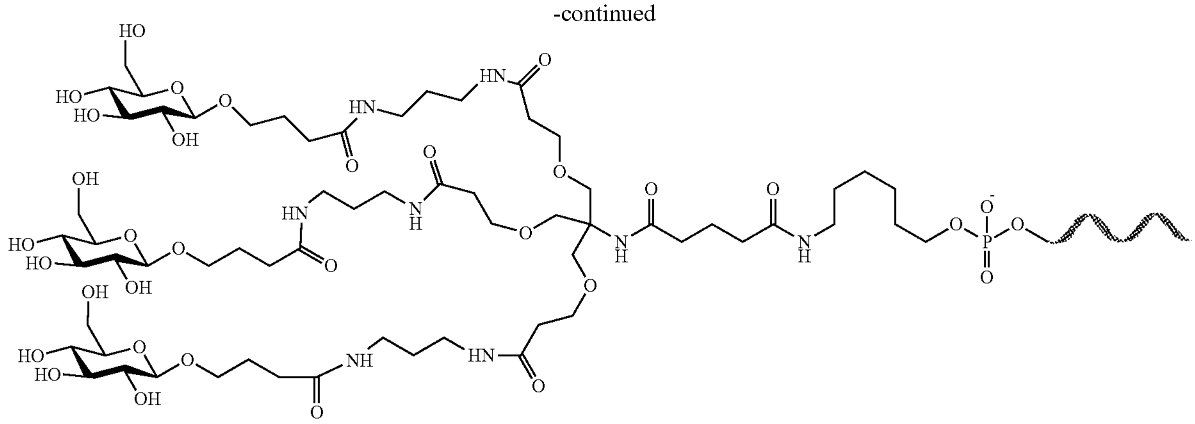

WV8448

To a soluition of 4,10,17-trioxo-15,15-bis((3-oxo-3-((3-(4-(((2R,3R,4S,5R,6R)-3,4,5-tris(benzoyloxy)-6-((benzoyloxy)methyl)tetrahydro-2H-pyran-2-yl)oxy)butanamido)propyl)amino)propoxy)methyl)-1-(((2R,3R,5R,6R)-3,4,5-tris(benzoyloxy)-6-((benzoyloxy)methyl)tetrahydro-2H-pyran-2-yl)oxy)-13-oxa-5,9,16-triazahenicosan-21-oic acid (57 mg, 21.8 μmol), HATU (7.5 mg, 19.6 μmol) and DIPEA (14.6 mg, 109 μmol) in DMF (2.0 mL) was stirred at room temperature for 15 minutes. To this solution was added 75 mg (10.9 μmol) of WV7557 in 1 ml water. Reaction mixture was stirred for 60 minutes to obtain the desired product. This product was heated at 40° C. with $NH_4OH$ for 3 hrs. LC_MS showed the reaction was completed. The reaction mixture was diluted with water, and speed-vacuum to dry. The crude product was purified by RP-HPLC eluting with 50 mM TEAA in water to acetonitrile, and desalt to obtain 39.73 mg of the conjugate WV-8448. Deconvoluted mass: 8233; Calculated molecular weight: 8227.

Synthesis of WV8927

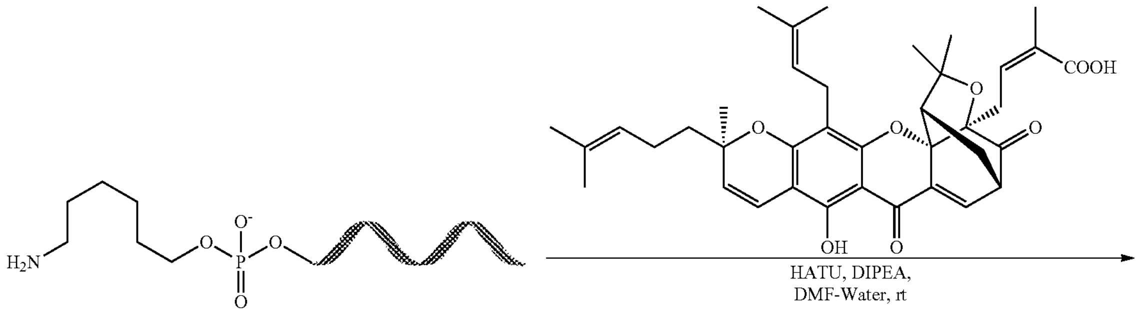

WV7557

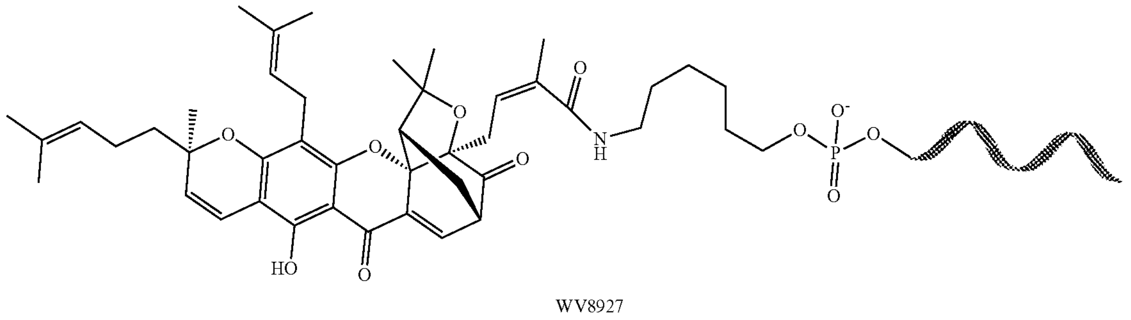

WV8927

To a solution of gambogic acid (21 mg, 33.6 μmol) in 2 ml dry DMF was added HATU (11.5 mg, 30.2 μmol) and DIPEA (3.6 mg, 28 μmol) and vortexed well. This solution was added WV7557 (42 mg, 5.6 μmol) in water (1 ml) and shaken for 4 hours. LC-Analysis indicated product formation, but starting material remained. Another 6 six equivalents of Gambogic acid-HATU complex (same amount used initially) was added and shaken well for 2 hours. LC analysis indicated more product formation. The reaction mixture was diluted with water (10 ml). Excess gambogic acid precipitated out. This precipitate was filtered off and the crude product was purified by RP-HPLC eluting with 50 mM TEAA in water to acetonitrile, and desalt to obtain 19 mg of the conjugate WV-8927. Deconvoluted mass: 7496; Calculated molecular weight: 7492.

Synthesis of WV-7558

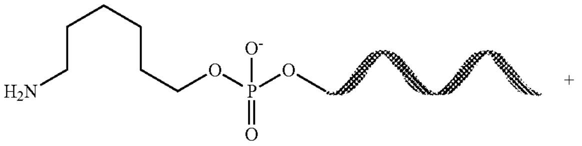

WV7557

-continued

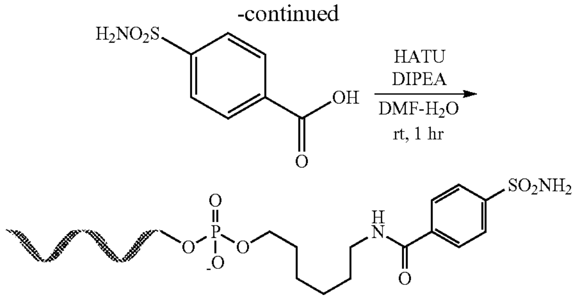

WV7558

To a solution of 4-sulfamoylbenzoic acid (7.3 mg, 36 μmol) in DMF (2.0 mL) was added HATU (12.4 mg, 32.7 μmol) and DIPEA (46 mg, 360 μmol) and vortexed. After 2 minutes WV7557 (50 mg, 7.27 μmol) in 1 ml water was added and shaken well. After 60 minutes the reaction mixture was diluted with water (5 ml) and filtered. The filtrate was purified by RP column chromatography (C-18) and desalted to obtain the product (17 mg). Mass calculated: 7064; Deconvoluted Mass: 7068.

Synthesis of WV-7559

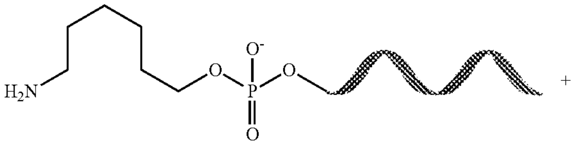

WV7557

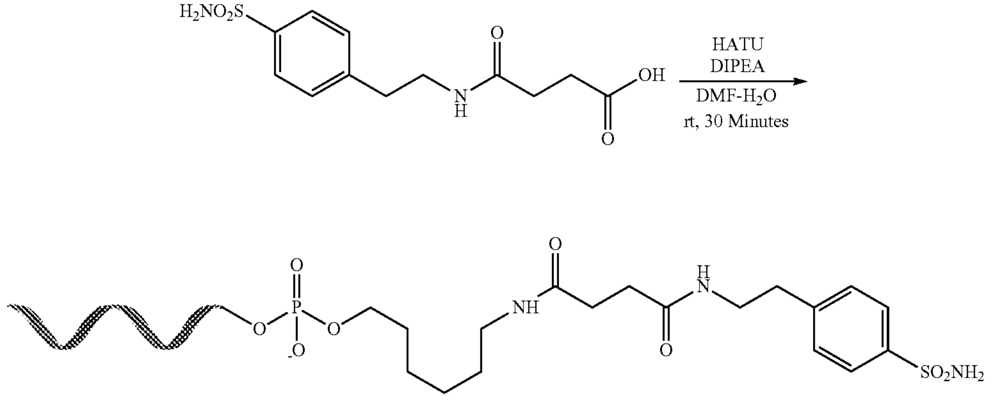

WV7559

To a solution of 4-oxo-4-((4-sulfamoylphenethyl)amino) butanoic acid (8.7 mg, 29 μmol) in DMF (2.0 mL) was added HATU (9.9 mg, 26 μmol) and DIPEA (37 mg, 290 μmol) and vortexed. After 2 minutes WV7557 (40 mg, 5.81 μmol) in 1 ml water was added and shaken well. After 30 minutes the reaction mixture was diluted with water (5 ml) and filtered. The filtrate was purified by RP column chromatography (C-18) and desalted to obtain the product (13 mg). Mass calculated: 7163; Deconvoluted Mass: 7166.

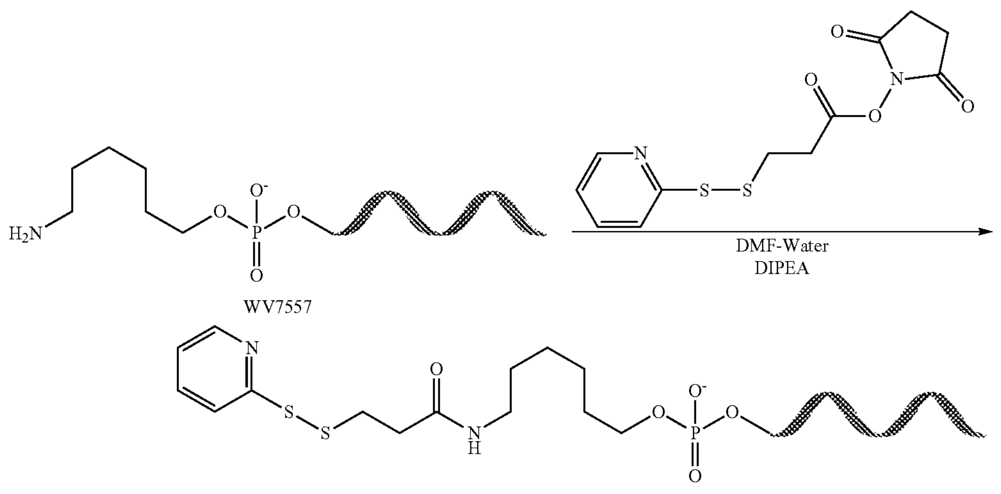
To a solution of WV7557 (62 mg, 9 μmol) in water (0.5 ml) and DMF (2.5 ml) was added DIPEA (11.6 mg, 90 μmol) and stirred well. To this solution was added 3-(2-Pyridyldithio)-propionic acid-OSu (4 mg, 12.6 μmol) and stirred well for 2 h. The crude product was diluted with water and purified on ISCO (C18 column) using 50 mM TEAA and acetonitrile. Amount of product obtained: 46 mg.
Synthesis of WV-8929
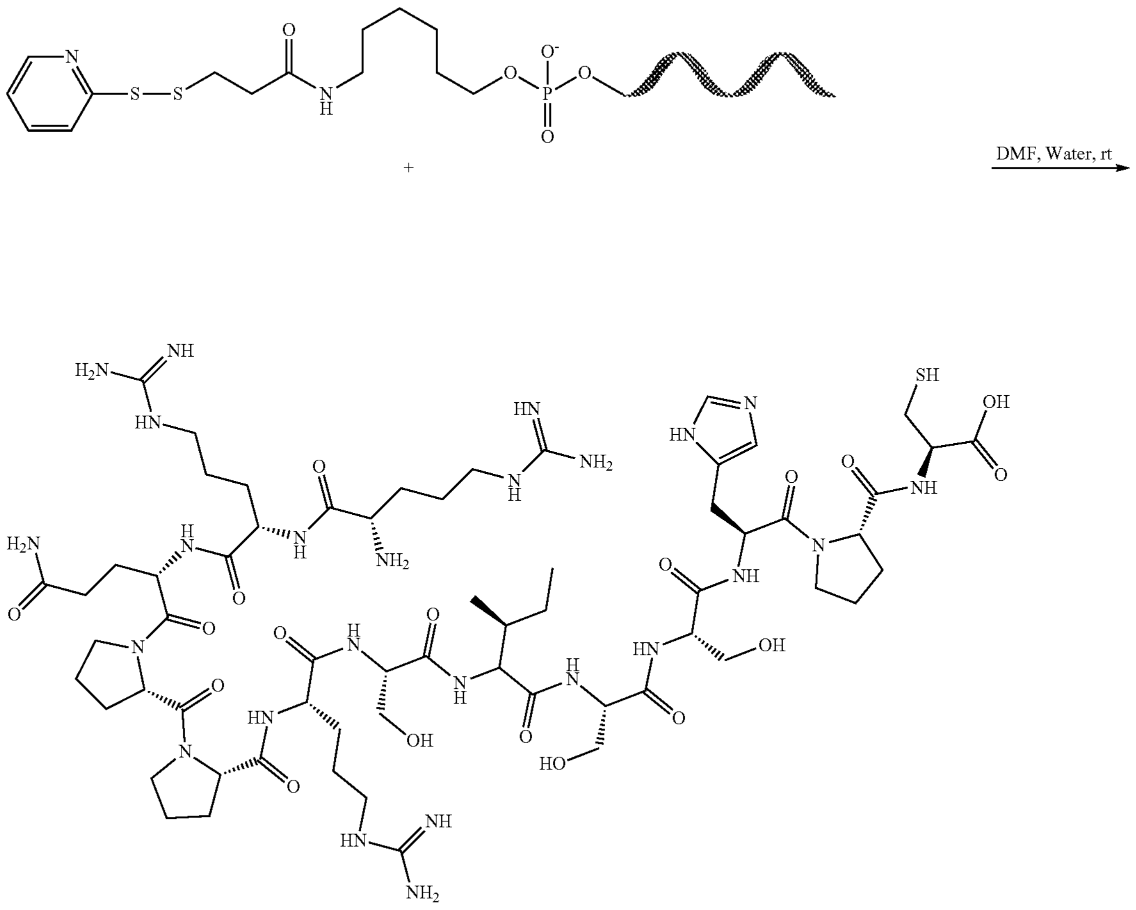

-continued

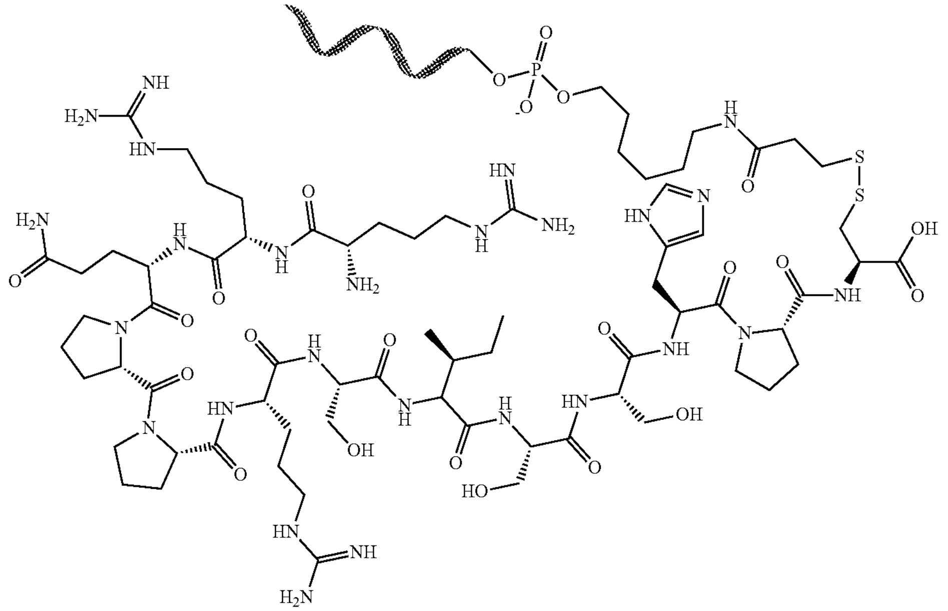

WV8929

To a solution of the oligo (WV7557 derivative, 23.5 mg, 3.3 μmol) in water-DMF (2 ml+1 ml) mixture was added DIPEA (8.52 mg, 66 μmol), and vortexed for 5 minutes. To this solution was added H-RRQPPRSISSHPC-OH (SEQ ID NO: 3252) (10 mg, 6.6 μmol) and again vortexed for 5 minutes. After 12 hours, the reaction mixture was analyzed by LC-MS. LC_MS showed the reaction was completed. The reaction mixture was diluted with water, and speed-vacuum to dry. The crude product was purified by RP-HPLC eluting with 50 mM TEAA in water to acetonitrile, and desalt to obtain 14 mg of the conjugate WV-8929. Deconvoluted mass: 8496; Calculated molecular weight: 8490.

Synthesis of WV-8930

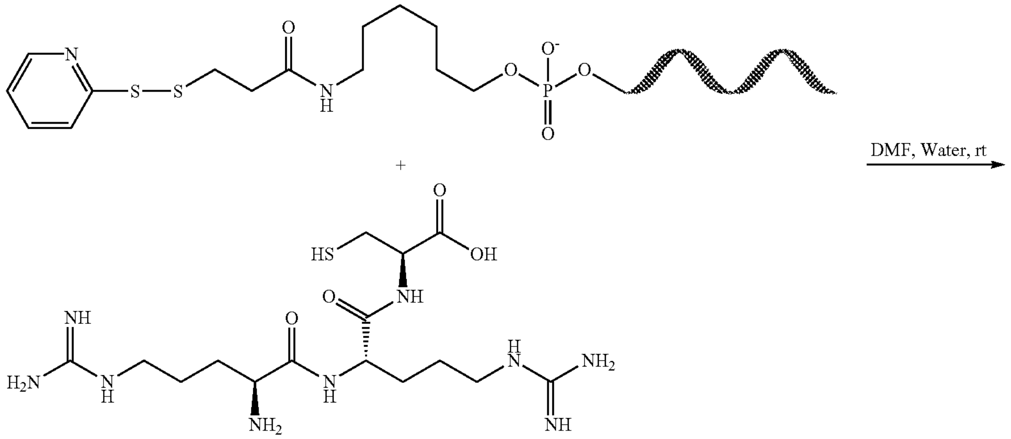

-continued

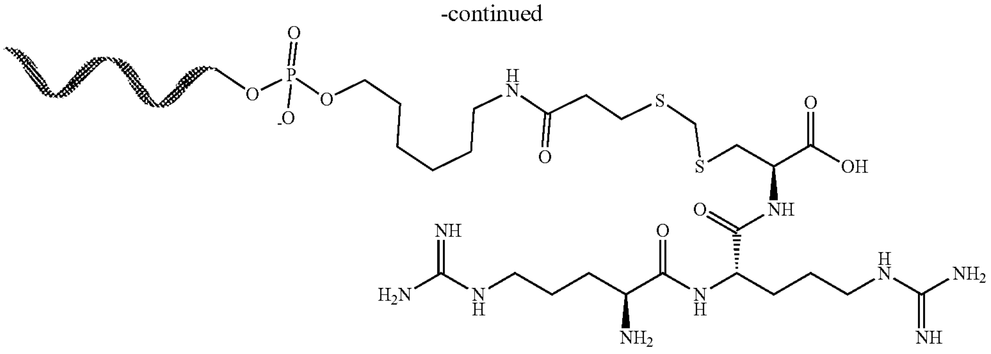

WV8930

To a solution of the oligo (WV7557 derivative, 23.5 mg, 3.3 µmol) in water-DMF (2 ml+1 ml) mixture was added DIPEA (8.52 mg, 66 µmol) and vortexed for 5 minutes. To this solution was added H-Arg-Arg-Cys-OH (4 mg, 10 µmol) and vortexed for 5 minutes. After 12 hours, the reaction mixture was analyzed by LC-MS. LC_MS showed the reaction was completed. The reaction mixture was diluted with water, and speed-vacuum to dry. The crude product was purified by RP-HPLC eluting with 50 mM TEAA in water to acetonitrile, and desalt to obtain 5 mg of the conjugate WV-8930. Deconvoluted mass: 7405; Calculated molecular weight: 7401.

Synthesis of WV8931

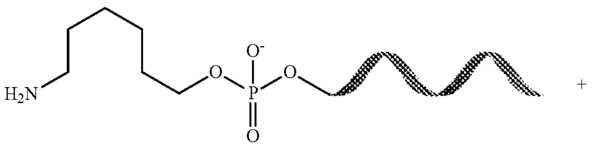

WV7557

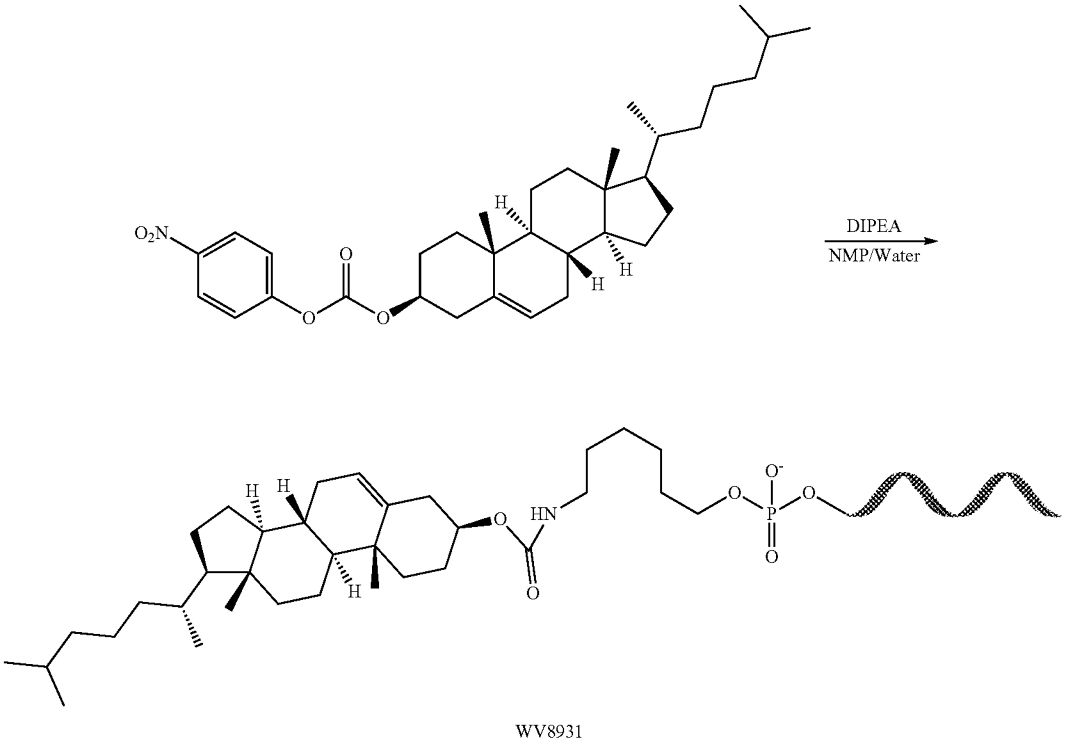

WV8931

To a solution of WV7557 (20 mg, 2.91 μmol) in 0.47 ml water was treated with DIPEA (3.76 mg, 29.1 μmol) and vortexed well for 5 minutes. To this solution was added a solution of (3S,8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yl (4-nitrophenyl) carbonate (activated cholesterol derivative) (10.50 mg, 19 μmol) in NMP(1.0 ml). The solution turned slightly yellowish. It was shaken at 40 degrees for 12 hours. A bright yellow solution was obtained. LC-MS analysis indicated product formation. This solution was diluted to 10 ml using water, filtered and purified on a RP-HPLC using a C-8 column and desalted. Amount of product obtained: 18 mg; Deconvoluted mass: 7298; Calculated molecular weight: 7293.

Synthesis of WV8934

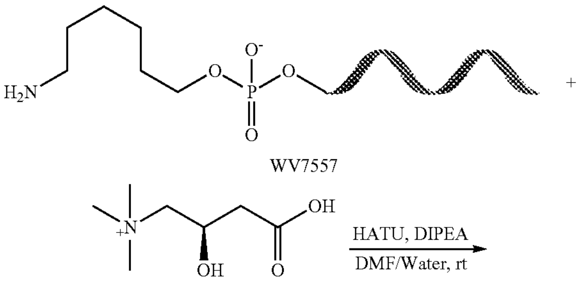

-continued

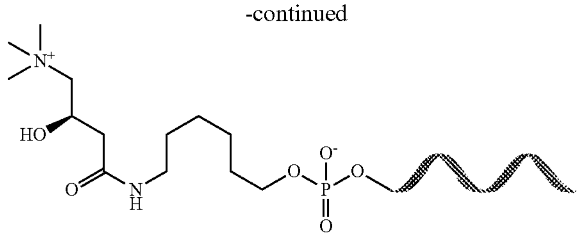

WV8934

L-carnitine (3 mg, 17.5 μmol) and HATU (6 mg, 16 μmol) were mixed together and made in to a 1 ml solution in DMF. DIPEA (5.7 mg, 44 μmol) was added and stirred well for 3 minutes. To this solution was added a solution of WV-7557 (30 mg, 4.4 mmol) in 0.5 ml water and stirred well for 30 minutes. LC-MS analysis of the solution indicated product formation. But starting oligo was present in the reaction mixture. 4 equivalents more L-carnitine/HATU complex was added again and stirred well for 2 h. The reaction mixture was diluted with water and the crude product was purified on a RP (C-18) column to obtain the product. Amount of product obtained: 12 mg, Calculated mass: 7025; De-convoluted mass: 7029.

Synthesis of WV-9390

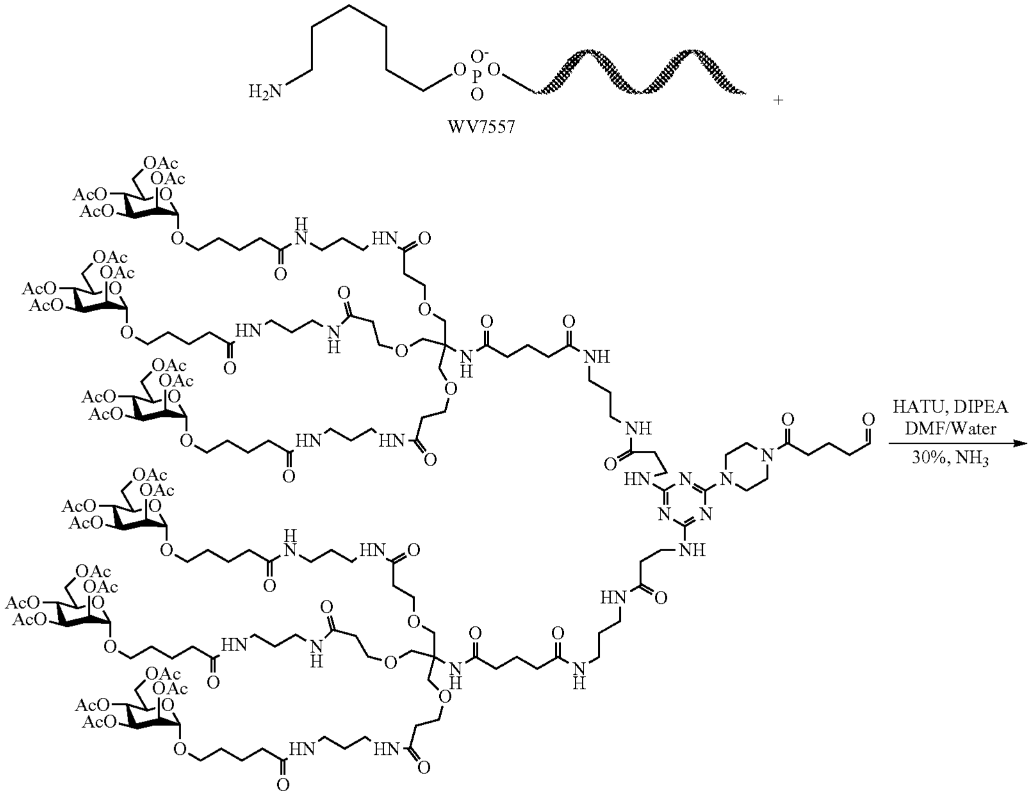

-continued

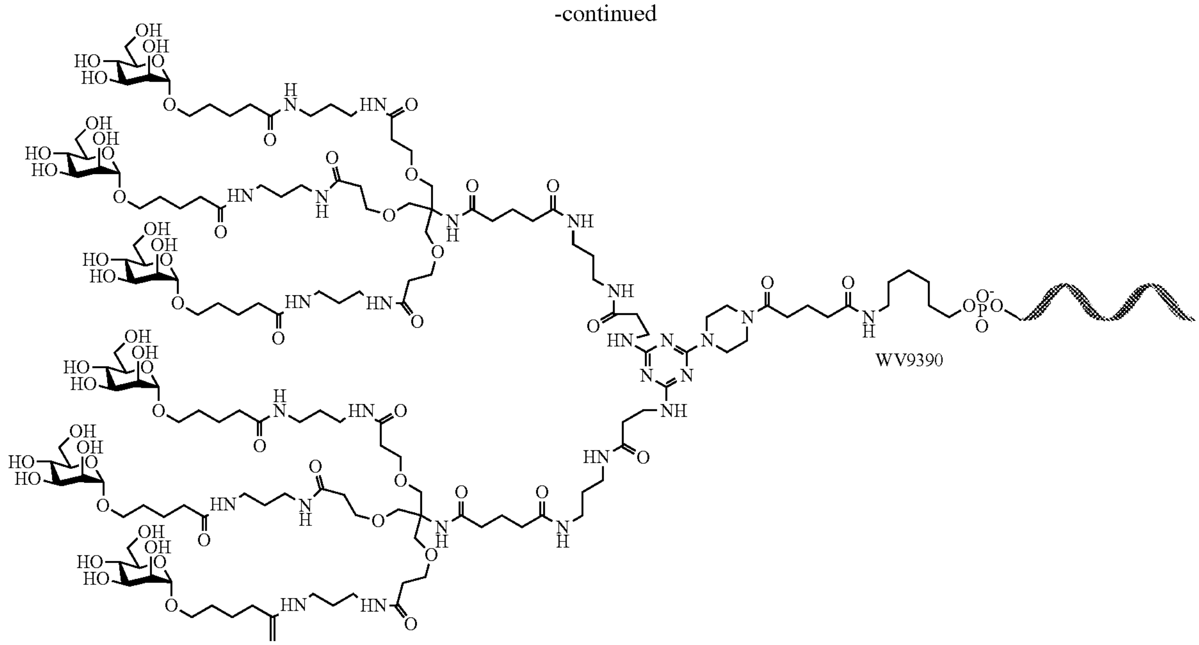

WV9390

To a solution of 5-oxo-5-(4-(4-((2,8,12,19,25-pentaoxo-14,14-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-29-(((2S,3S,4S,5R,6R)-3,4,5-triacetoxy-6-(acetoxymethyl)tetrahydro-2H-pyran-2-yl)oxy)-16-oxa-3,7,13,20,24-pentaazanonacosyl)amino)-6-((3,9,13,20,26-pentaoxo-15,15-bis((3-oxo-3-((3-(5-(((2S,3S,4S,5R,6R)-3,4,5-triacetoxy-6-(acetoxymethyl)tetrahydro-2H-pyran-2-yl)oxy)pentanamido)propyl)amino)propoxy)methyl)-30-(((2S,3S,4S,5R,6R)-3,4,5-triacetoxy-6-(acetoxymethyl)tetrahydro-2H-pyran-2-yl)oxy)-17-oxa-4,8,14,21,25-pentaazatriacontyl)amino)-1,3,5-triazin-2-yl) piperazin-1-yl)pentanoic acid (15 mg, 3.5 μmol) and HATU (1.33 mg, 3.5 μmol) in DMF (1.0 ml) was added DIPEA (4.5 mg, 35 μmol) and vortexed for 2 minutes. To this solution was added WV7557 (12 mg, 1.74 μmol) in water (0.5 ml) and shaken for 60 minutes. 5 ml water was added to it and the solvent was removed under vacuum. The crude product was purified on a RP column (C-8) obtain acetylated product (Mass calculated: 10207, Deconvoluted mass: 10212). This product was dissolved in 5 ml 30% ammonium hydroxide solution and heated at 40 degrees Celsius for 6 hours. Solvent was removed under vacuum and the crude product was purified on a RP column (C-8) to obtain the product. Amount of product obtained (10 mg). Calculated Mass: 10205; Deconvoluted Mass obtained: 10205.

Synthesis of WV 9430

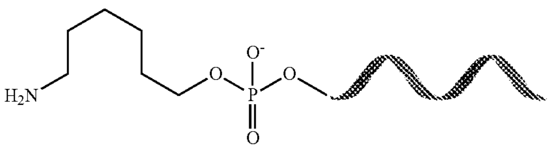

+

WV7557

-continued

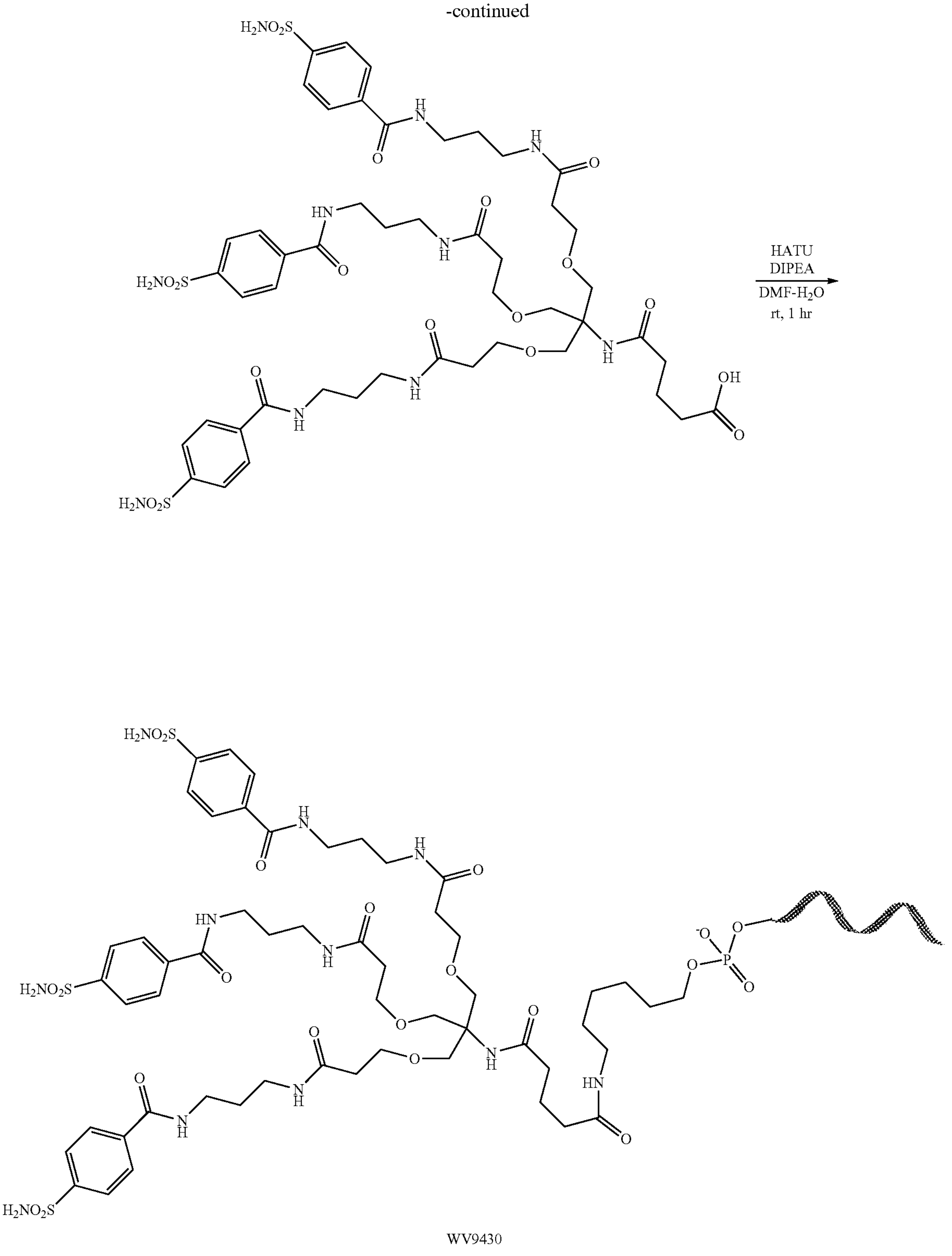

WV9430

To a solution of 1,7,14-trioxo-12,12-bis((3-oxo-3-((3-(4-sulfamoylbenzamido)propyl)amino)propoxy)methyl)-1-(4-sulfamoylphenyl)-10-oxa-2,6,13-triazaoctadecan-18-oic acid (5.14 mg, 1.45 μmol) in DMF was added HATU (1.5 mg, 3.96 μmol) and DIPEA (2 mg, 15 μmol). The reaction mixture was stirred at room temperature for 2 minutes. A solution of WV7557 in 0.4 ml water was added and shaken well. After 30 minutes the reaction mixture was diluted with water (5 ml) and filtered. The filtrate was purified by RP column chromatography (C-18) and desalted to obtain the product WV-9430 (6 mg). Mass calculated: 8032; Deconvoluted Mass: 8031.

Synthesis of WV-9385

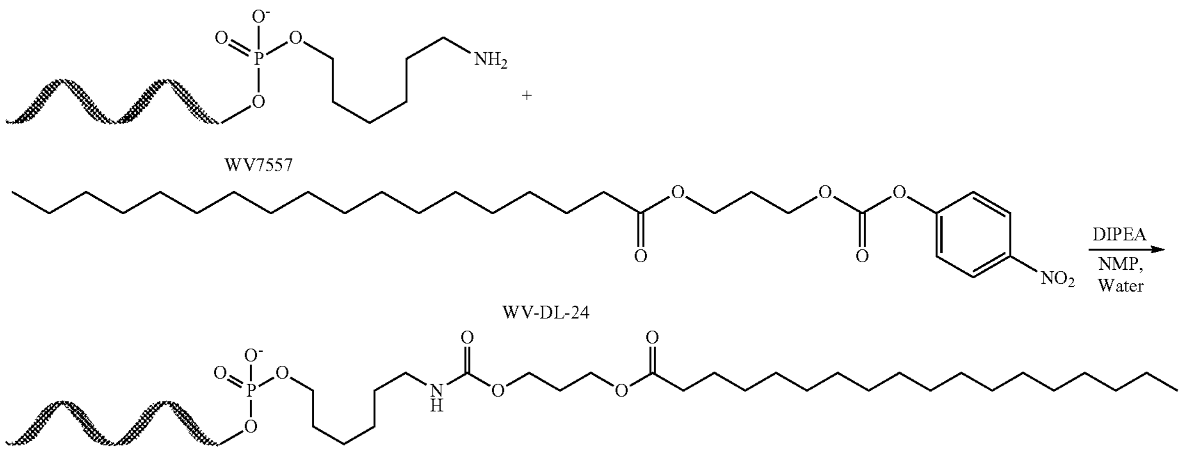

WV7557

WV-DL-24

WV9385

WV7557 (48 mg, 6.9 μmol) was dissolved in 1 ml NMP and 0.5 ml water. DIPEA (14 mg, 103.5 μmol) was added to this solution. Vortexed for 5 minutes. To this solution was added 3-(((4-nitrophenoxy)carbonyl)oxy)propyl stearate (14 mg, 27.6 μmol) in 1 ml NMP. The reaction mixture was filtered and the filtrate was purified by RP column chromatography (C-8) to obtain the product. The purified material was desalted and 11 mg of product was obtained. Mass calculated: 7250; Deconvoluted Mass: 7254.

Synthesis of WV-7560

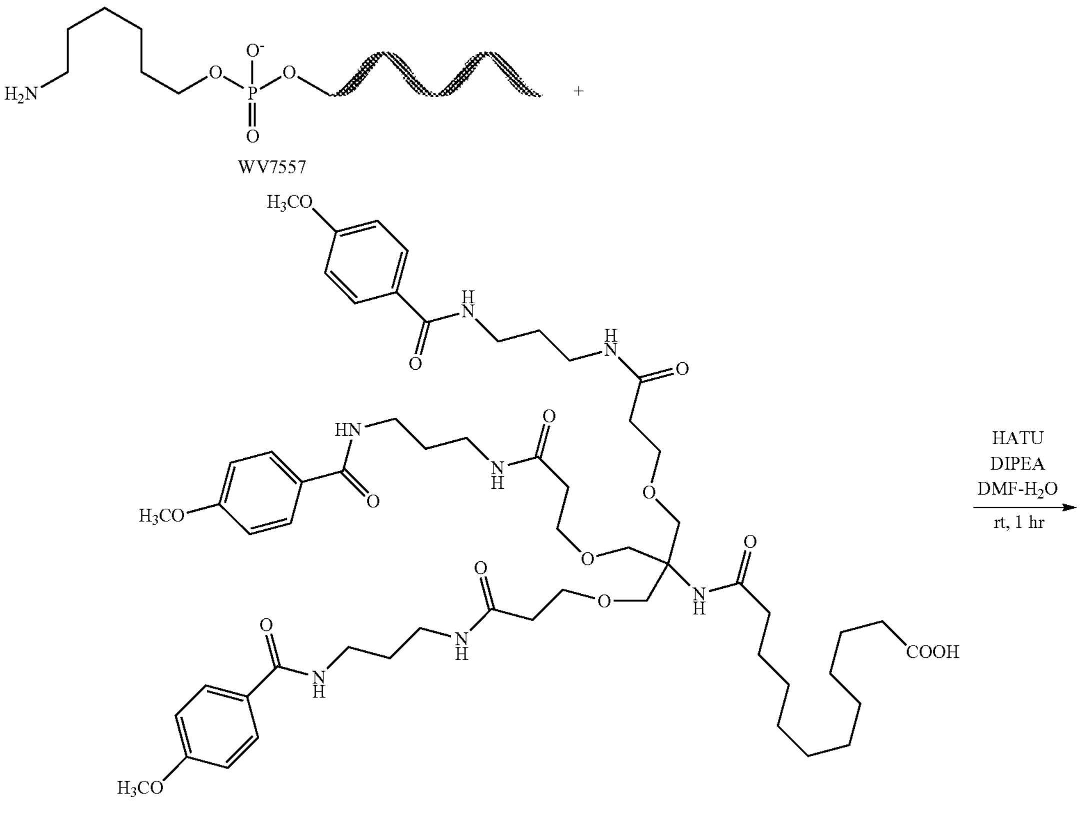

WV7557

-continued

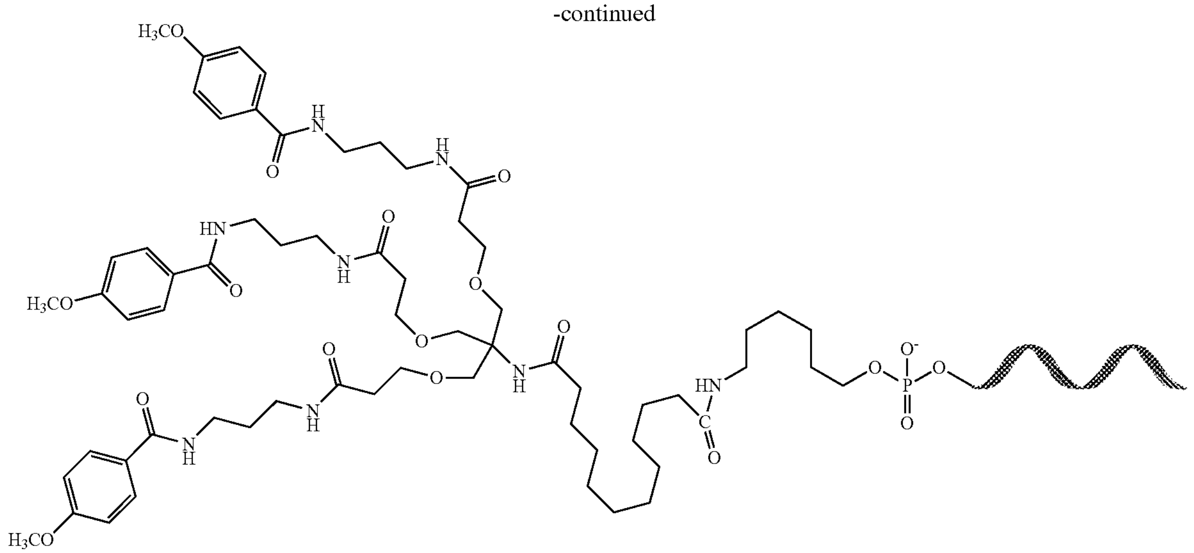

WV7560

12,12-bis((3-((3-(4-methoxybenzamido)propyl)amino)-3-oxopropoxy)methyl)-1-(4-methoxyphenyl)-1,7,14-trioxo-10-oxa-2,6,13-triazapentacosan-25-oic acid (triantennary anisamide) (32.5 mg, 29 µmol), HATU (10 mg, 26.1 µmol) and DIPEA (28 mg, 58 µmol) were dissolved in 2 ml DMF. After 2 minutes WV7557 (100 mg, 15 µmol) in 1 ml water was added and shaken well. After 60 minutes the reaction mixture was diluted with water (5 ml) and filtered. The filtrate was purified by RP column chromatography (C-8) and desalted to obtain the product (55 mg). Mass calculated: 7983; Deconvoluted Mass: 7987.

Synthesis of WV-7408

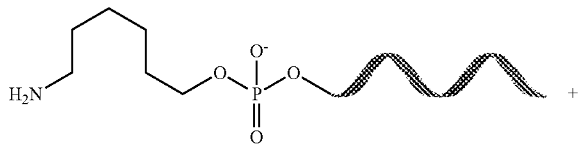

WV3356

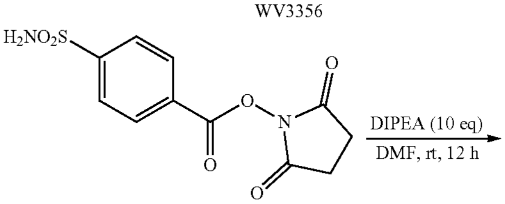

-continued

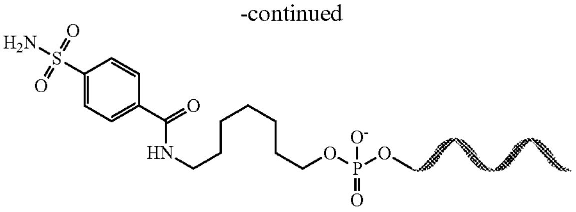

WV7408

A suspension of WV 3356 (40 mg, 5.3 µmol) and DIPEA (7 mg, 53 µmol) in 2 ml DMF was vortexed for five minutes. To this suspension was added a solution of 2,5-dioxopyrrolidin-1-yl 4-sulfamoylbenzoate (8 mg, 26.5 µmol)] in 1 ml DMF. The reaction mixture was shaken for 12 hours. Afterwards, the reaction mixture was diluted with 5 ml water and filtered. The filtrate was purified by RP (C-18) column chromatography and desalted to obtain the product (20 mg). Mass calculated: 7596; Deconvoluted mass: 7594.

Synthesis of WV7409

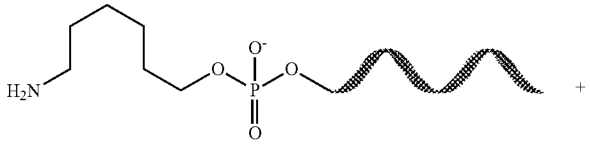

WV3356

-continued

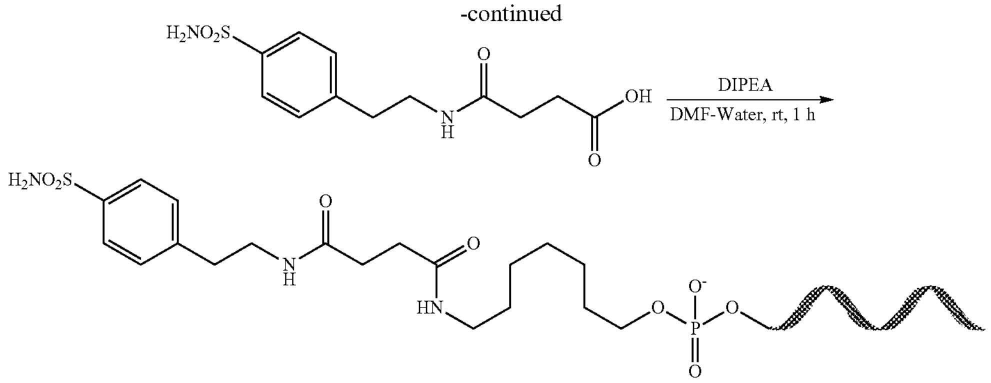

WV-7409

To a solution of 4-oxo-4-((4-sulfamoylphenethyl)amino) butanoic acid (2.16 mg, 7.2 μmol), HATU (2.32 mg, 6.1 μmol) and DIPEA (3.1 mg, 24 μmol) were dissolved in 1 ml DMF and vortexed. After 2 minutes WV3356 (18 mg, 2.4 μmol) in 0.5 ml water was added and shaken well. After 60 minutes the reaction mixture was diluted with water (5 ml) and filtered. The filtrate was purified by RP column chromatography (C-18) and desalted to obtain the product (9 mg). Mass calculated: 7694; Deconvoluted Mass: 7695.

Synthesis of WV-7430

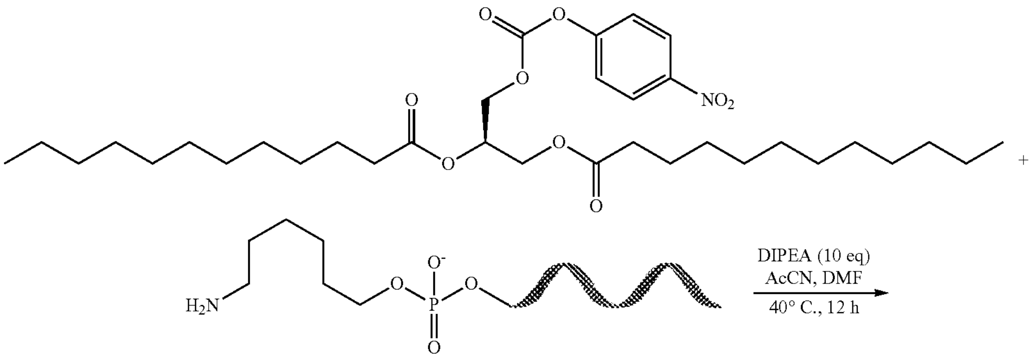

WV3356

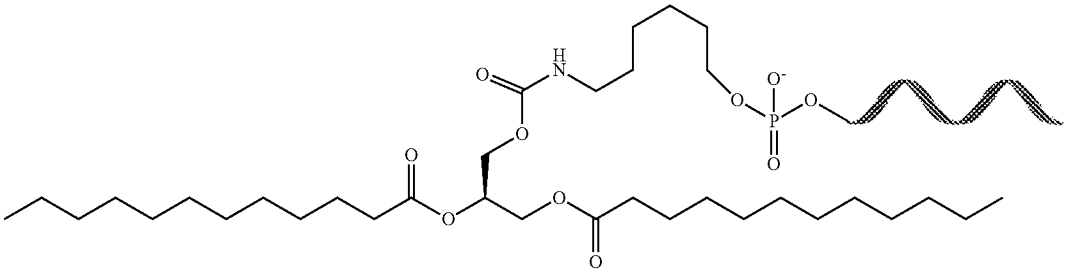

WV7430

To a solution of WV3356 (32 mg, 4.3 μmol) in DMF (2.0 mL) was added DIPEA (5.8 mg, 43 μmol) was added a solution of (R)-3-(((4-nitrophenoxy)carbonyl)oxy)propane-1,2-diyl didodecanoate (11 mg, 17.6 μmol) in acetonitrile (1.0 mL). Reaction mixture was shaken at 40° C. for 12 hours. LC-MS analysis indicated formation of product. The reaction mixture was diluted with water and filtered. The filtrate was purified by RP column chromatography (C-8) to obtain the product. The purified material was desalted and 11 mg of product was obtained. Mass calculated: 7895, Deconvoluted Mass: 7896.

Synthesis of WV-7419

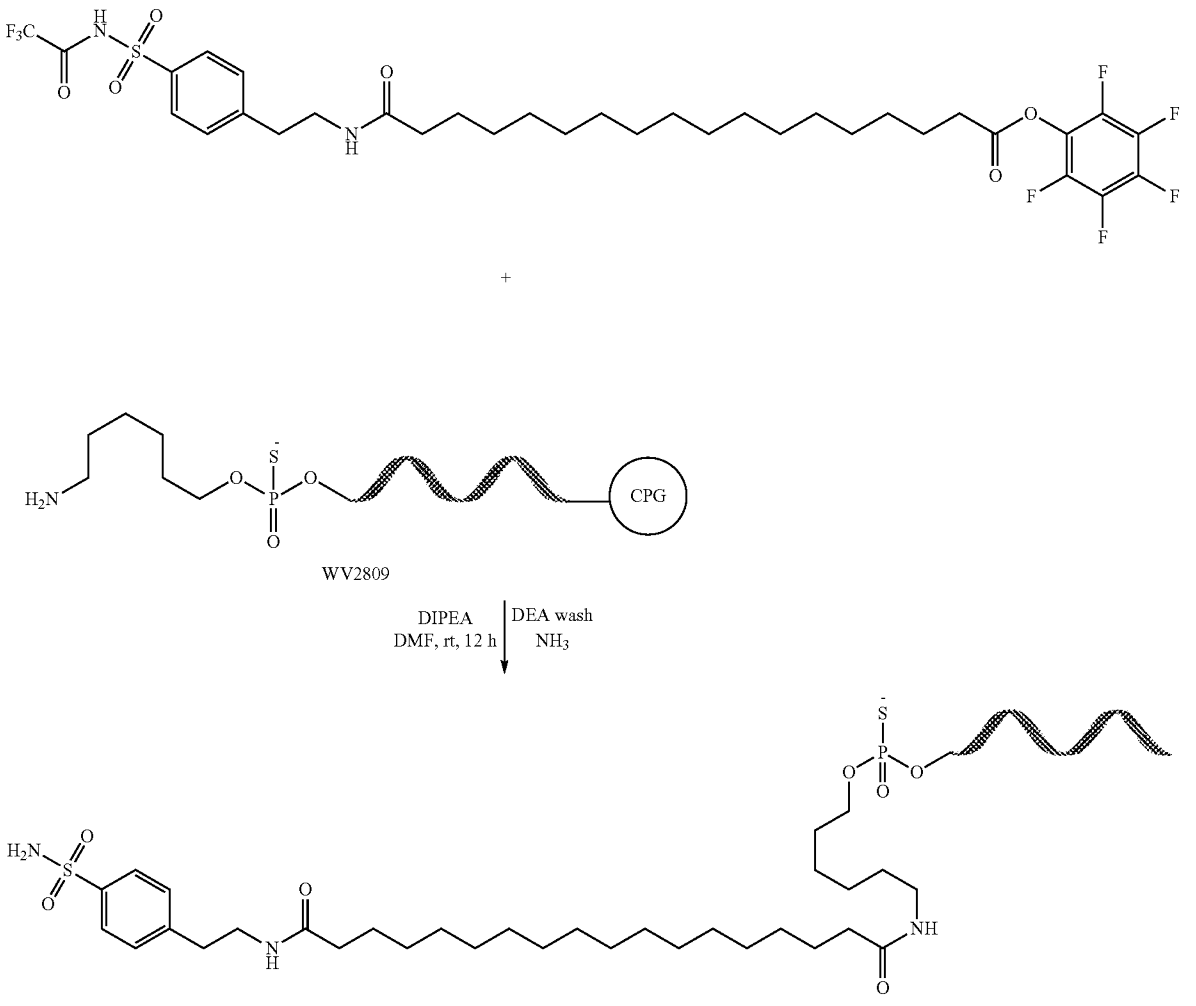

WV7419

To a suspension of WV-2809 (56 mg, 7.5 μmol, 125 mg support) in DMF (2.0 mL) was added DIPEA (19.3 mg, 150 μmol) and vortexed well for 5 minutes. To this suspension was added perfluorophenyl 18-oxo-18-((4-(N-(2,2,2-trifluoroacetyl)sulfamoyl)phenethyl)amino)octadecanoate (12 mg, 15 μmol) and shaken for 12 hours at room temperature. The solid support was washed with acetonitrile (20 ml×3) and dried. This support was treated with 20% DEA in acetonitrile (1 ml) for 10 minutes. The DEA solution was removed by filtration. The solid support was washed with acetonitrile (20 ml×3) and dried. The solid support was heated with 2 ml of 30% ammonium hydroxide for 12 hours. The support was filtered off and the filtrate was lyophilized to remove the solvent. The crude product was purified by RP column chromatography (C-8) and desalted to obtain the product (7 mg). Mass calculated: 7906, Deconvoluted Mass: 7909.

Synthesis of WV-7519

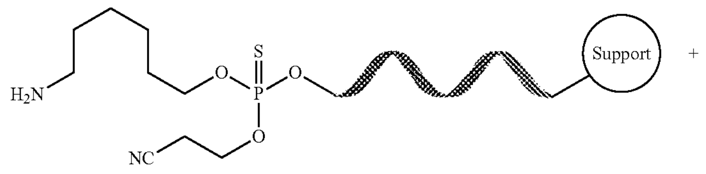

WV2809

-continued

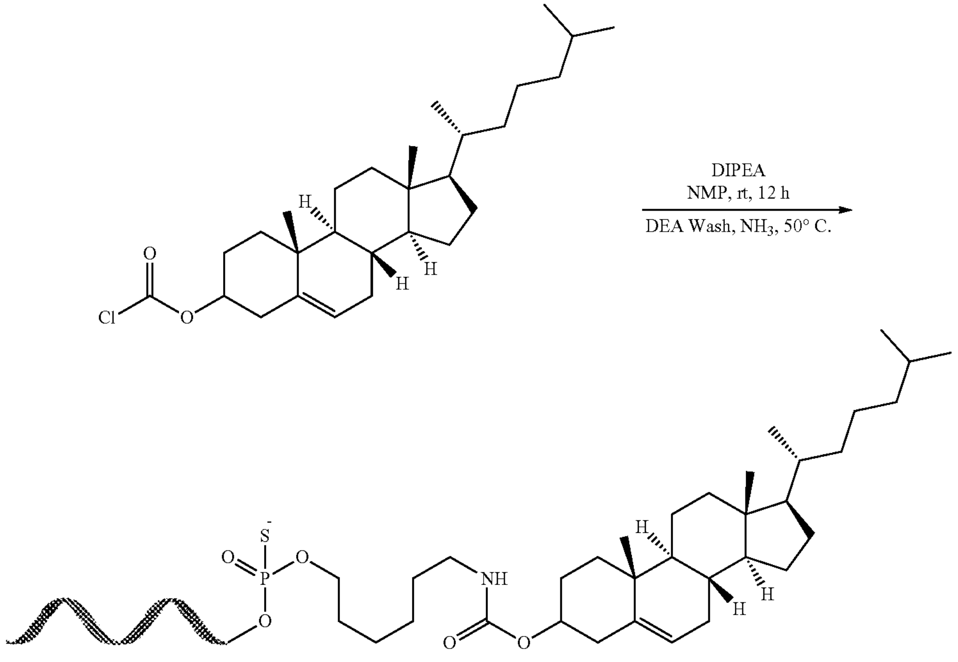

WV7519

To a suspension of WV2809 (60 mg, 8 μmol, 150 mg support) in 2 ml NMP was added DIPEA (11 mg, 80 μmol) and vortexed well for 5 minutes. To this suspension was added (8S,9S,10R,13R,14S,17R)-10,13-dimethyl-17-((R)-6-methylheptan-2-yl)-2,3,4,7,8,9,10,11,12,13,14,15,16,17-tetradecahydro-1H-cyclopenta[a]phenanthren-3-yl carbonochloridate (15 mg, 33 μmol) and shaken for 12 hours at room temperature. The solid support was washed with acetonitrile (20 ml×3) and dried. This support was treated with 20% DEA in acetonitrile (1 ml) for 10 minutes. The DEA solution was removed by filtration. The solid support was washed with acetonitrile (20 ml×3) and dried. The solid support was heated at 50° C. with 2 ml of 30% ammonium hydroxide for 12 hours. The support was filtered off and the filtrate was lyophilized to remove the solvent. The crude product was purified by RP column chromatography (C-8) and desalted to obtain the product (20 mg). Mass calculated: 7840, Deconvoluted mass: 7841.

Synthesis of WV-7422

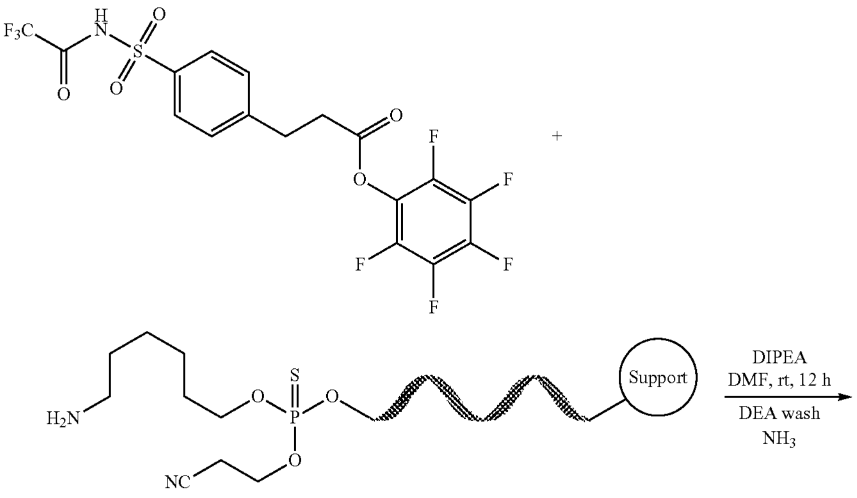

WV2809

-continued

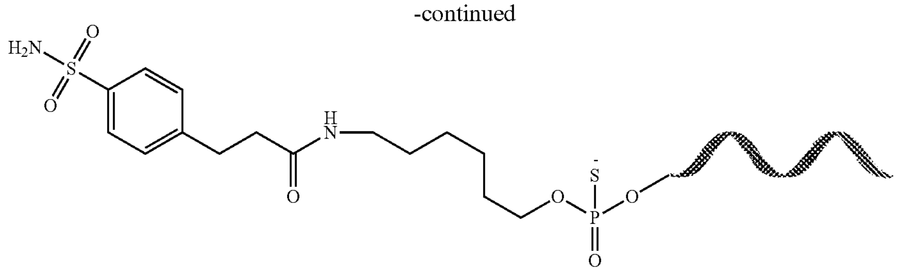

WV7422

To a suspension of WV2809 (56 mg, 7.5 μmol, 125 mg support) in 2 ml DMF was added DIPEA (19.3 mg, 150 μmol) and vortexed well for 5 minutes. To this suspension was added perfluorophenyl 3-(4-(N-(2,2,2-trifluoroacetyl) sulfamoyl)phenyl)propanoate (37 mg, 75 μmol) and shaken for 12 hours at room temperature. The solid support was washed with acetonitrile (20 ml×3) and dried. This support was treated with 20% DEA in acetonitrile (1 ml) for 10 minutes. The DEA solution was removed by filtration. The solid support was washed with acetonitrile (20 ml×3) and dried. The solid support was heated at 50° C. with 2 ml of 30% ammonium hydroxide for 12 hours. The support was filtered off and the filtrate was lyophilized to remove the solvent. The crude product was purified by RP column chromatography (C-8) and desalted to obtain the product (18 mg). Mass calculated: 7638, Deconvoluted Mass: 7641.

Synthesis of WV-7421

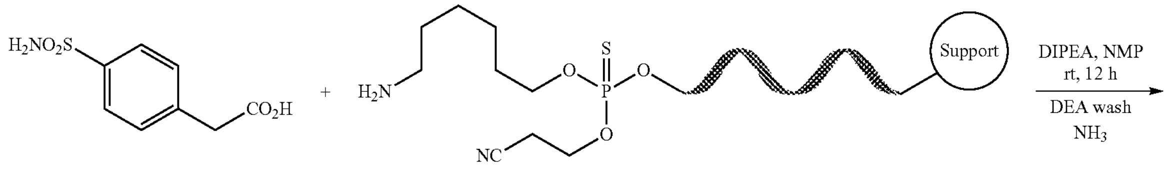

WV2809

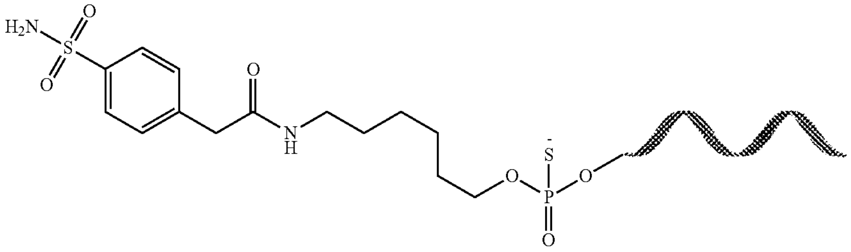

WV7421

2-(4-sulfamoylphenyl) acetic acid (17.2 mg, 80 μmol), HATU (28 mg, 76 molμ) and DIPEA (20.6 mg, 160 μmol) in 2 ml NMP was vortexed well for 2 minutes. To this suspension was added WV2809 (60 mg, 8 μmol, 150 mg support) and shaken well for 12 hours at room temperature. The solid support was washed with acetonitrile (20 ml×3) and dried. This support was treated with 20% DEA in acetonitrile (1 ml) for 10 minutes. The DEA solution was removed by filtration. The solid support was washed with acetonitrile (20 ml×3) and dried. The solid support was heated at 50° C. with 2 ml of 30% ammonium hydroxide for 12 hours. The support was filtered off and the filtrate was lyophilized to remove the solvent. The crude product was purified by RP column chromatography (C-18) and desalted to obtain the product (20 mg). Mass calculated: 7624, Deconvoluted Mass: 7627.

Synthesis of WV-7417

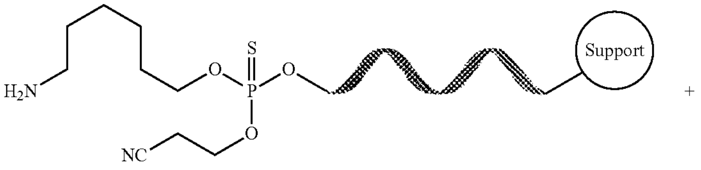

WV2809

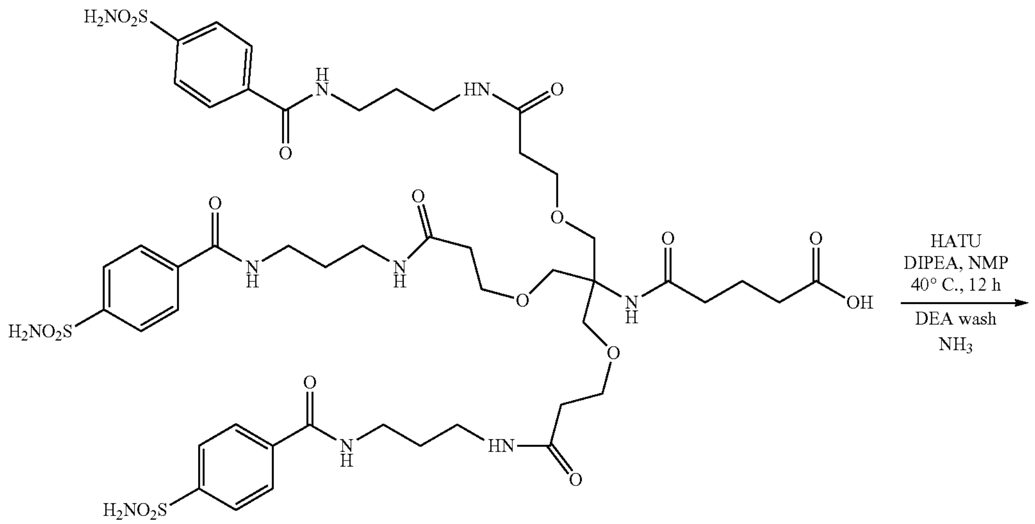

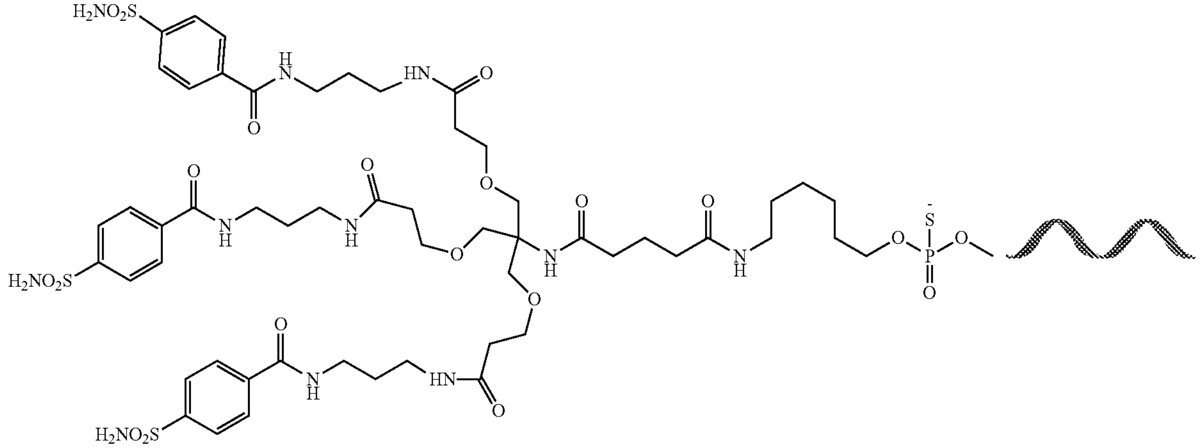

WV7417

A suspension of 1,7,14-trioxo-12,12-bis((3-oxo-3-((3-(4-sulfamoylbenzamido)propyl)amino)propoxy)methyl)-1-(4-sulfamoylphenyl)-10-oxa-2,6,13-triazaoctadecan-18-oic acid (40 mg, 34 μmol), HATU (12 mg, 76 μmol) and DIPEA (44 mg, 340 μmol) in 2 ml NMP was vortexed well for 3 minutes. To this suspension was added WV2809 (60 mg, 8 μmol, 150 mg support) and shaken well for 12 hours at 40° C. The solid support was washed with acetonitrile (20 ml×3) and dried. This support was treated with 20% DEA in acetonitrile (1 ml) for 10 minutes. The DEA solution was removed by filtration. The solid support was washed with acetonitrile (20 ml×3) and dried. The solid support was heated at 50° C. with 2 ml of 30% ammonium hydroxide for 12 hours. The support was filtered off and the filtrate was lyophilized to remove the solvent. The crude product was purified by RP column chromatography (C-18) and desalted to obtain the product (10 mg). Mass calculated: 8579, Deconvoluted Mass: 8577.

Example 17. General Procedure for the Deprotection of Amine

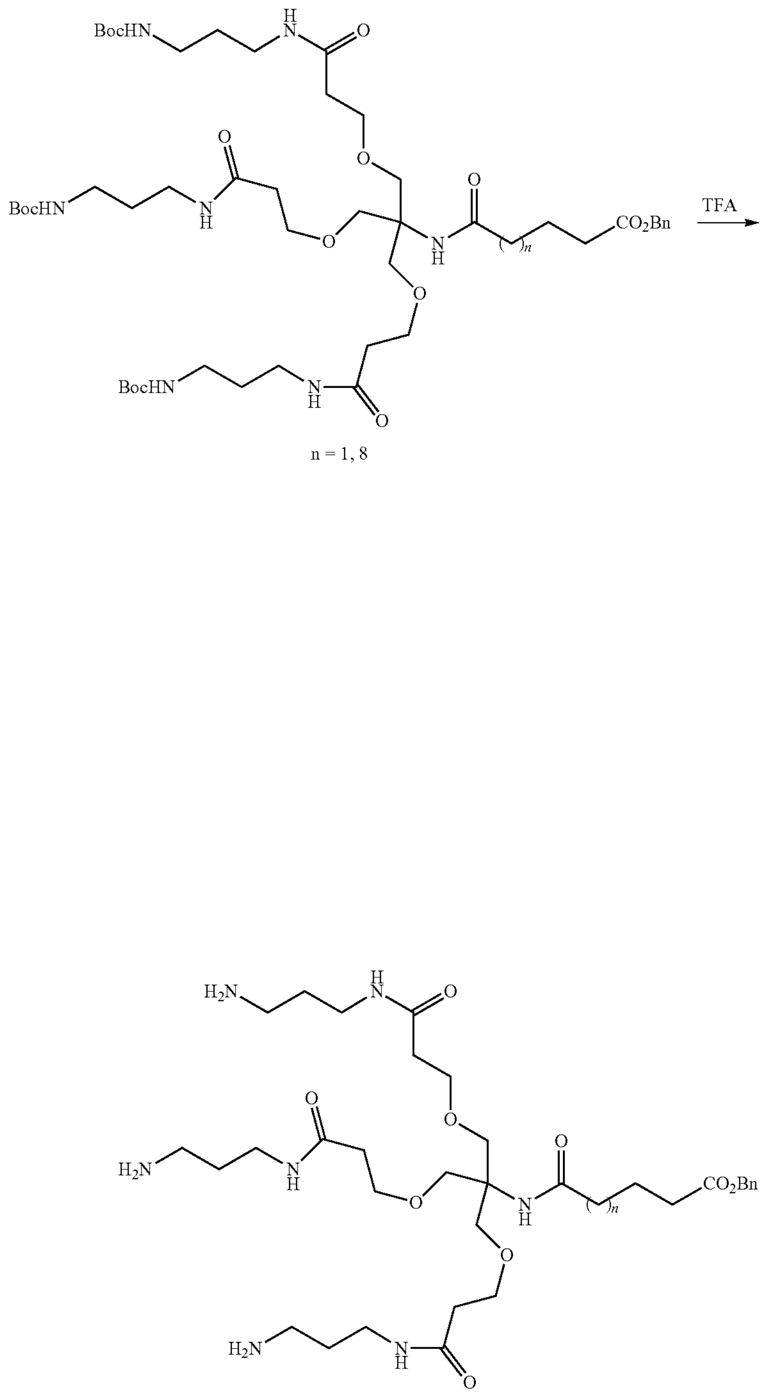

15.2 g of NHBoc amine was dissolved in dry DCM (100 ml) then TFA (50 ml) was added dropwise at RT. Reaction mixture was stirred at RT overnight. Solvents were removed under reduced pressure then co-evaporated with toluene (2×50 mL) then used for the next step without any further purification. NMR in CD3OD confirmed the NHBoc deprotection.

Example 18. General Procedure for the Anisamide Formation

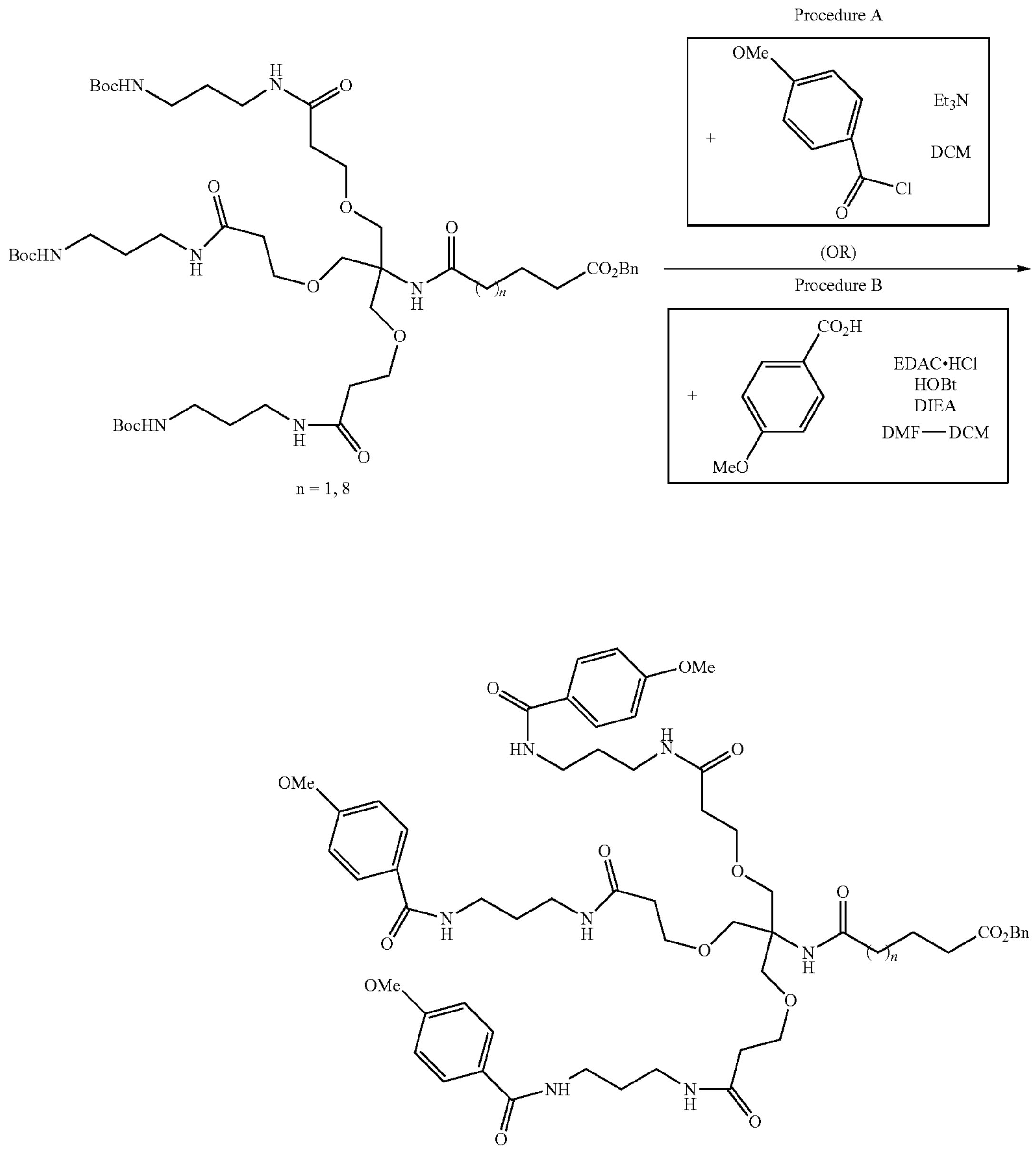

Procedure-A: The crude amine from the previous step was dissolved in a mixture of DCM (100 ml) and $Et_3N$(10 equ.) at RT. During this process, the reaction mixture was cooled with a water bath. Then 4-Methoxybenzoyl chloride (4 equ) was added dropwise to the reaction mixture under argon atmosphere at RT, stirring continued for 3 h. Reaction mixture was diluted with water and extracted with DCM. Organic layer was extracted with aq. $NaHCO_3$, 1N HCl, brine then dried with magnesium sulfate evaporated to dryness. The crude product was purified by silica column chromatography using DCM-MeOH as eluent.

Procedure-B: The crude amine (0.27 equ), acid and HOBt (1 equ) were dissolved in a mixture of DCM and DMF (2:1) in an appropriate sized RBF under argon. EDAC·HCl (1.25 equ) was added portion wise to the reaction mixture under constant stirring. After 15 mins, the reaction mixture was cooled to ~10° C. then DIEA (2.7 equ) was added over a period of 5 mins. Slowly warmed the reaction mixture to ambient temperature and stirred under argon for overnight. TLC indicated completion of the reaction TLC condition, DCM: MeOH (9.5:0.5). Solvents were removed under reduced pressure, then water was added to the residue, and a gummy solid separated out. The clear solution was decanted, and the solid residue was dissolved in EtOAc and washed successively with water, 10% aqueous citric acid, aq. $NaHCO_3$, followed by saturated brine. The organic layer was separated and dried over magnesium sulfate. Solvent was removed under reduced pressure then the crude product was purified with silica column to get the pure product.

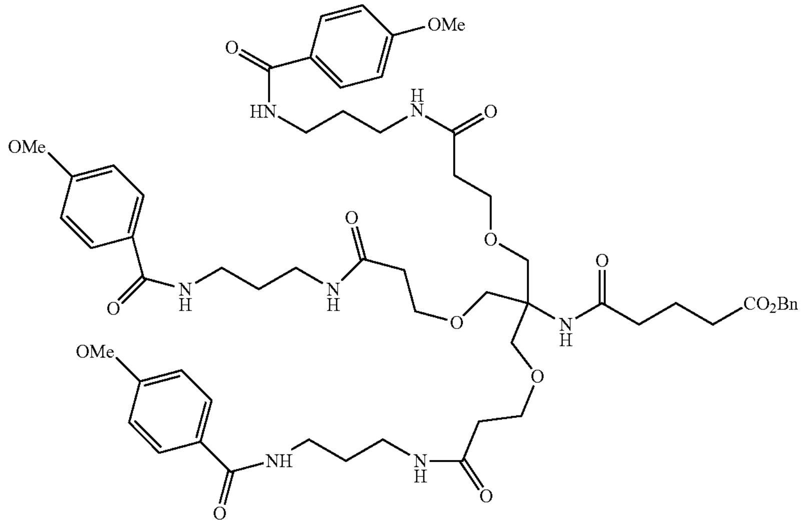 [SMILES: COc1ccc(C(=O)NCCCNC(=O)CCOCC(COCCC(=O)NCCCNC(=O)c2ccc(OC)cc2)(COCCC(=O)NCCCNC(=O)c2ccc(OC)cc2)NC(=O)CCCC(=O)OCc2ccccc2)cc1]
Anisamide was obtained from the amine in 32% yield over 2 steps using the above procedure-B: $^1$H NMR ($CDCl_3$): δ=7.74 (d, 6H), 7.44 (t, 2H), 7.34 (t, 1H), 7.26 (m, 5H), 7.05 (m, 3H), 6.83 (d, 6H), 6.46 (s, 1H), 5.01 (s, 2H), 3.75 (s, 9H), 3.57 (m, 12H), 3.37 (m, 6H), 3.25 (m, 6H), 2.31 (m, 8H), 2.11 (m, 2H), 1.84 (m, 2H), 1.62 (m, 6H) ppm.
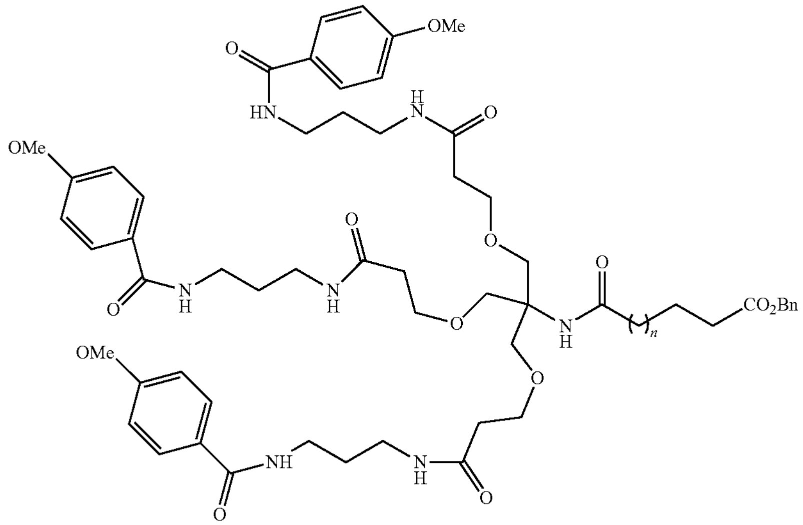
n = 8
Anisamide was obtained from the amine in 57% yield over 2 steps using the above procedure-A: $^1$H NMR ($CDCl_3$): δ=7.75 (m, 3H), 7.73 (d, 6H), 7.43 (t, 3H), 7.25 (m, 5H), 6.80 (d, 6H), 6.51 (brs, 1H), 5.01 (s, 2H), 3.72 (s, 9H), 3.58 (m, 6H), 3.21 (m, 12H), 2.33 (t, 3H), 2.25 (t, 2H), 2.02 (t, 2H), 1.64 (q, 6H), 1.52 (p, 2H), 1.41 (q, 2H), 1.12 (m, 12H) ppm.

General Procedure for Debenzylation.

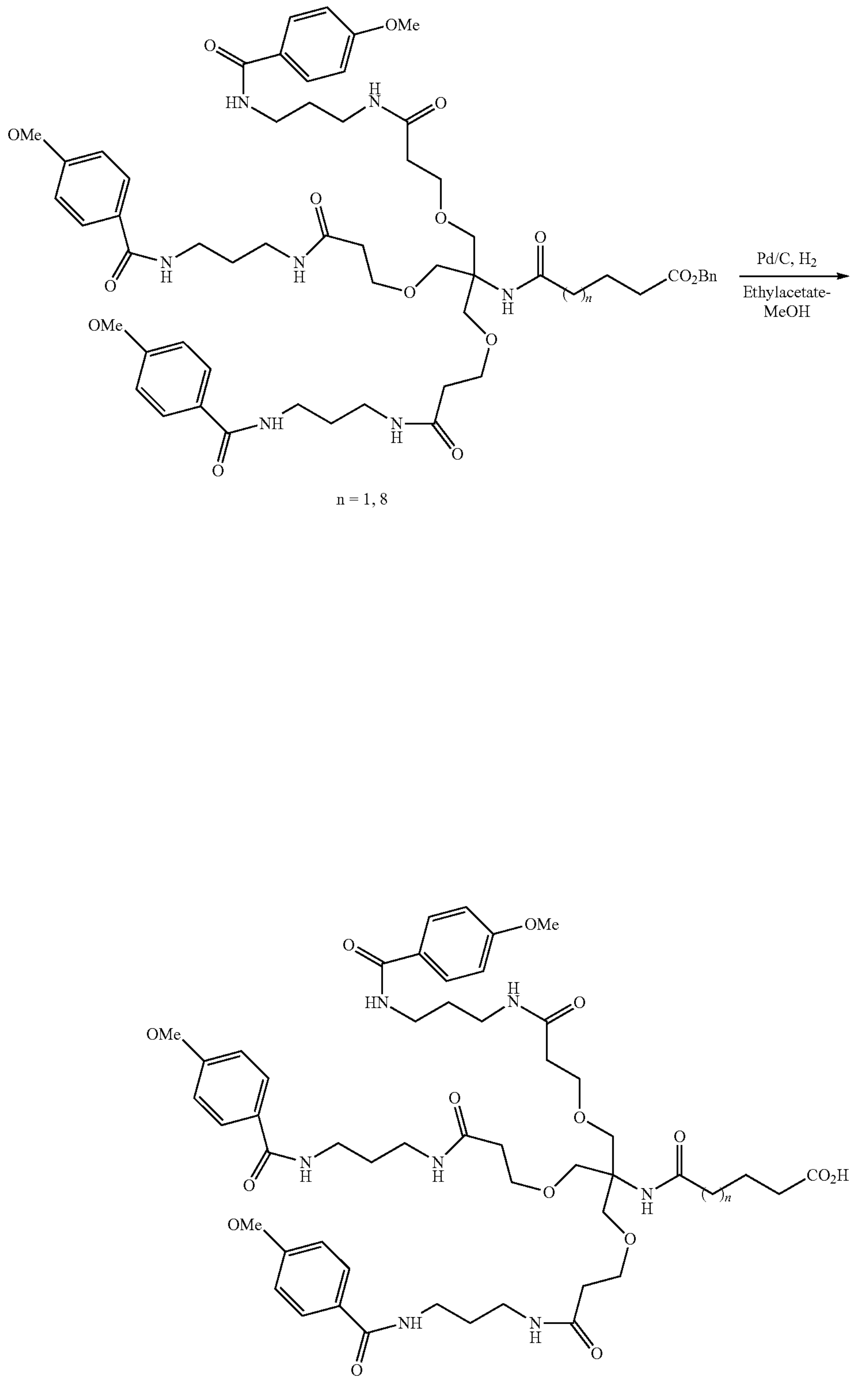

The benzyl ester (10 g) was dissolved in a mixture of ethyl acetate (100 ml) and methanol (25 ml) then Pd/C, 1 g (10% palladium content) was added under argon atmosphere then the reaction mixture was vacuumed and flushed with hydrogen and stirred at RT under $H_2$ atmosphere for 3 h. TLC indicated completion of the reaction, filtered through pad of celite and washed with methanol, evaporated to dryness to yield a foamy white solid.

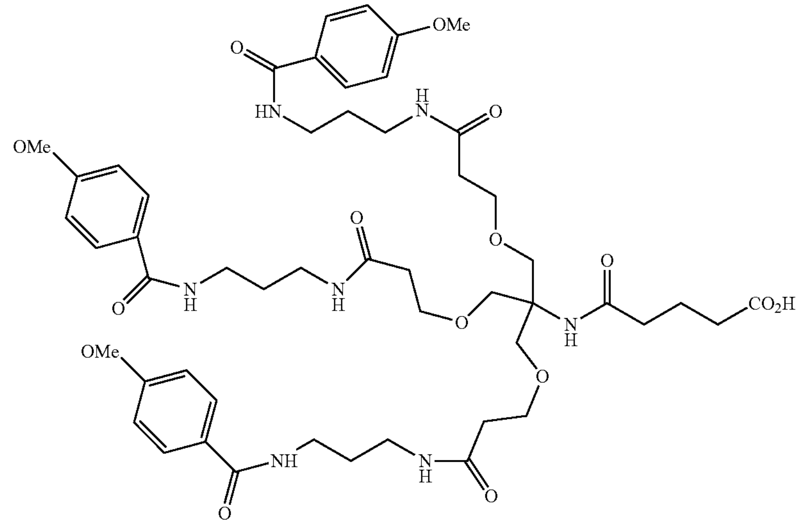 [SMILES: COc1ccc(C(=O)NCCCNC(=O)CCOCC(COCCC(=O)NCCCNC(=O)c2ccc(OC)cc2)(COCCC(=O)NCCCNC(=O)c2ccc(OC)cc2)NC(=O)CCCC(=O)O)cc1]

Yield 98%, $^{1}H$ NMR ($CD_3OD$): δ=8.35 (t, 1H), 8.01 (t, 1H), 7.82 (d, 6H), 7.27 (d, 1H), 6.99 (d, 6H), 3.85 (s, 9H), 3.68 (m, 12H), 3.41 (m, 6H), 3.29 (m, 6H), 2.42 (m, 6H), 2.31 (q, 2H), 2.21 (td, 2H), 1.80 (m, 8H) ppm.

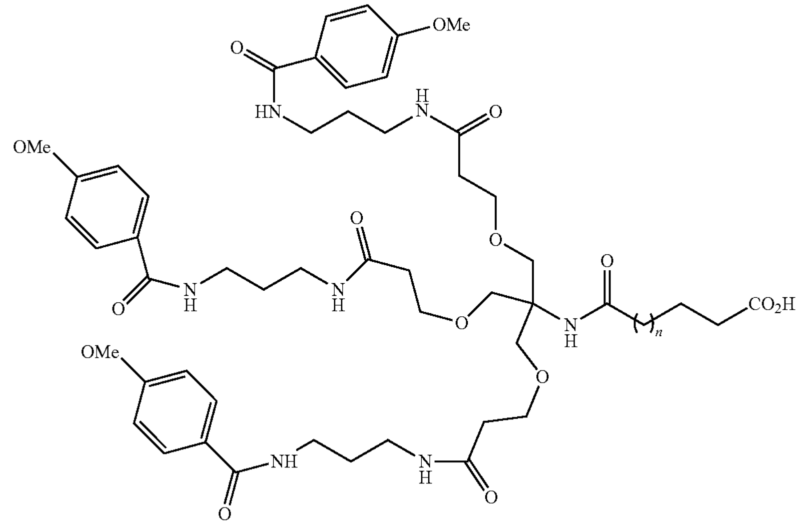

n = 8

Yield 94%, $^{1}H$ NMR ($CD_3OD$): δ=8.36 (t, 2H), 8.02 (t, 2H), 7.82 (d, 6H), 7.23 (d, 1H), 6.98 (d, 6H), 3.85 (s, 9H), 3.70 (s, 6H), 3.67 (t, 6H), 3.41 (q, 4H), 3.28 (m, 8H), 2.42 (t, 6H), 2.27 (t, 2H), 2.13 (t, 2H), 1.79 (p, 6H), 1.54 (dp, 4H), 1.25 (m, 12H) ppm.

Example 19. Timelines for 'Pre-Differentiation' of Patient Myoblasts for Gymnotic Dosing Various technologies, e.g., those described in U.S. Pat. Nos. 9,394,333, 9,744,183, 9,605,019, 9,598,458, US 2015/0211006, US 2017/0037399, WO 2017/015555, WO 2017/192664, WO 2017/015575, WO 2017/062862, WO 2017/160741, WO 2017/192679, and WO 2017/210647, etc., can be utilized in accordance with the present disclosure to assess properties and/or activities of technologies of the present disclosure. In some embodiments, technologies of the present disclosure, e.g., oligonucleotides and compositions and methods of use thereof, demonstrate unexpectedly superior results compared to a suitable reference technology (e.g., a technology based on a stereorandom composition of oligonucleotides having the same base sequence but no neutral and/or cationic internucleotidic linkages at physiological pH). Described below are example technologies that can be useful for assessing properties and/or activities of oligonucleotides described in the present disclosure. Those skilled in the art understand that conditions illustrated below may be varied/modified, and additionally and/or alternatively, other suitable reagents, temperatures, conditions, time periods, amounnts, etc., may be utilized in accordance with the present disclosure.

Maintenance of Patient Derived Myoblast Cell Lines:

DMD Δ52 and DMD Δ45-52 myoblast cells were maintained in complete Skeletal Muscle Growth Medium (Promocell, Heidelberg, Germany) supplemented with 5% FBS, 1× Penicillin-Streptomycin and 1× L-Glutamine. Flasks or plates were coated with Matrigel:DMEM solution (1:100) for a suitable period of time, e.g., 30 mins, after which Matrigel:DMEM solution was removed via aspiration before seeding of cells in complete Skeletal Muscle Growth Medium.

Standard Dosing Procedure (0 Days Pre-Differentiation)

On Day 1: Coat suitable cell growth containers, e.g., 6-well plates or 24-well plates, with Matrigel: DMEM Solution. Incubate at a condition, e.g., 37° C., 5% $CO_2$ for a suitable period of time, e.g., 30 mins. Aspirate, and seed a suitable number of cells to cell growth containers, e.g., 150K cells/well in a total of 1500 μl of complete growth medium in 6-well plate, and 30K cells/well in 500 μl of growth medium in a 24-well plate. Incubate at a suitable condition for a suitable period of time, .e.g., 37° C., 5% $CO_2$ overnight.

On Day 2: Prepare a suitable Differentiation medium, e.g., DMEM+5% Horse Serum+10 μg/ml Insulin. Prepare suitable oligonucleotide dilutions in Differentiation Medium, e.g., serial dilutions of 30 μM, 10 μM, 3.33 μM, 1.11 μM, 0.37 μM. Aspirate growth medium off of adherent cells, and add oligonucleotide: Differentiation Medium solution to cells. Oligonucleotides remain on cells (no media change) until cell harvesting.

On Day 6: Obtain RNA. In a typical procedure, a suitable number of cells, e.g., cells from wells of a 24-well plate, were washed, e.g., with cold PBS, followed by addition of a suitable amount of a reagent for RNA extraction and storage of sample/RNA extraction, e.g., 500 μl/well TRIZOL in 24-well plate and freezing plate at −80° C. or continuing with RNA extraction to obtain RNA.

On Day 8: Obtain protein. In a typical procedure, a suitable number of cells, e.g., cells in wells of 6-well plate, were washe, e.g., with cold PBS. A suitable amount of a suitable lysis buffer was then added—e.g., in a typical procedure, 200 ul/well of RIPA supplemented with protease inhibitors for a 6-well plate. After lysis the sample can be stored, e.g., freezing at −80° C., or continue with protein extraction.

Other suitable procedures may be employed, for example, those described below. As appreciated by those skilled in the art, many parameters, such as reagents, temperatures, conditions, time periods, amounnts, etc., may be modified.

4 Days Pre-Differentiation Dosing Procedure

On Day 1: Coat 6-well plates or 24-well plates with Matrigel: DMEM Solution. Incubate at 37° C., 5% $CO_2$ for 30 mins. Aspirate, seed 150K cells/well in a total of 1500 μl of complete growth medium in 6-well plate, and 30K cells/well in 500 ul of growth medium in a 24-well plate. Incubate at 37° C., 5% $CO_2$ overnight.

On Day 2: Prepare Differentiation medium as follows: DMEM+5% Horse Serum+10 μg/ml Insulin. Aspirate Growth Media and replace with Differentiation Media.

On Day 6: Cells have differentiated for 4 days. Prepare oligonucleotide dilutions in Differentiation Medium, for example serial dilutions of 30 uM, 10 uM, 3.33 uM, 1.11 uM, 0.37 uM. Aspirate Differentiation medium off of adherent cells, and add oligonucleotide: Differentiation Medium solution to cells. Oligonucleotides remain on cells (no media change) until cell harvesting.

On Day 10: Wash cells in 24-well plate with cold PBS, add 500 ul/well TRIZOL in 24-well plate and freeze plate at −80° C. or continue with RNA extraction.

On Day 12: Wash cells in 6-well plate with cold PBS. Add 200 ul/well of RIPA supplemented with protease inhibitors. Freeze plate at −80° C. or continue with protein extraction.

7 Days Pre-Differentiation Dosing Procedure

On Day 1: Coat 6-well plates or 24-well plates with Matrigel: DMEM Solution. Incubate at 37° C., 5% $CO_2$ for 30 mins. Aspirate, seed 150K cells/well in a total of 1500 μl of complete growth medium in 6-well plate, and 30K cells/well in 500 ul of growth medium in a 24-well plate. Incubate at 37° C., 5% $CO_2$ overnight.

On Day 2: Prepare Differentiation medium as follows: DMEM+5% Horse Serum+10 μg/ml Insulin. Aspirate Growth Media and replace with Differentiation Media.

On Day 9: Cells have differentiated for 7 days. Prepare oligonucleotide dilutions in Differentiation Medium, for example serial dilutions of 30 uM, 10 uM, 3.33 uM, 1.11 uM, 0.37 uM. Aspirate Differentiation medium off of adherent cells, and add oligonucleotide: Differentiation Medium solution to cells. Oligonucleotides remain on cells (no media change) until cell harvesting.

On Day 13: Wash cells in 24-well plate with cold PBS, add 500 ul/well TRIZOL in 24-well plate and freeze plate at −80° C. or continue with RNA extraction.

On Day 15: Wash cells in 6-well plate with cold PBS. Add 200 ul/well of RIPA supplemented with protease inhibitors. Freeze plate at −80° C. or continue with protein extraction.

10 days Pre-Differentiation Dosing Procedure

On Day 1: Coat 6-well plates or 24-well plates with Matrigel: DMEM Solution. Incubate at 37° C., 5% $CO_2$ for 30 mins. Aspirate, seed 150K cells/well in a total of 1500 μl of complete growth medium in 6-well plate, and 30K cells/well in 500 ul of growth medium in a 24-well plate. Incubate at 37° C., 5% $CO_2$ overnight.

On Day 2: Prepare Differentiation medium as follows: DMEM+5% Horse Serum+10 μg/ml Insulin. Aspirate Growth Media and replace with Differentiation Media.

On Day 12: Cells have differentiated for 10 days. Prepare oligonucleotide dilutions in Differentiation Medium, for example serial dilutions of 30 uM, 10 uM, 3.33 uM, 1.11 uM, 0.37 uM. Aspirate Differentiation medium off of adherent cells, and add oligonucleotide: Differentiation Medium solution to cells. Oligonucleotides remain on cells (no media change) until cell harvesting.

On Day 16: Wash cells in 24-well plate with cold PBS, add 500 ul/well TRIZOL in 24-well plate and freeze plate at −80° C. or continue with RNA extraction.

On Day 18: Wash cells in 6-well plate with cold PBS. Add 200 ul/well of RIPA supplemented with protease inhibitors. Freeze plate at −80° C. or continue with protein extraction.

Example 20. Multi-Exon Skipping Assay

The assay described herein can be adapted to detect any gene's splice-variants with frequency of each variant (quantification). DMD Exon43-Exon64 is used as an example.

Among other things, a unique feature of this assay is that an unique-molecular-identifier (UMI) is introduced in the reverse transcription primers with an unique PCR handler sequence (this can be any sequence without homology to genomic or transcriptome sequences). Therefore, each cDNA has its unique UMI (bar-code) that can be used in later sequencing analysis to eliminate PCR and sequencing bias toward smaller amplicons.

In a typical procedure, the steps include: Reverse RT primer containing a PCR handle at 5'-end, then 8-16 sequences of randomly incorporated nucleotides that create UMI/bar code and reverse complement sequence in exon 64 (Reverse RT primer in table), was used to prime the reverse transcription by a RT kit (e.g., SuperScript IV, ThermoFisher, Cambridge, MA). Then primary and nested PCR were run to amplify gene-specific fragments used for PacBio long range sequencing or Oxford Nanopore MinION platform.

The NGS sequences (BAM files) were mapped to reference sequence (DMD for example) to identify splice variants (exon junctions). The UMI were counted in each splice variant, and frequency of variant was calculated by UMI counts in each variant divided by total UMI counts in all variants.

Figure 2:
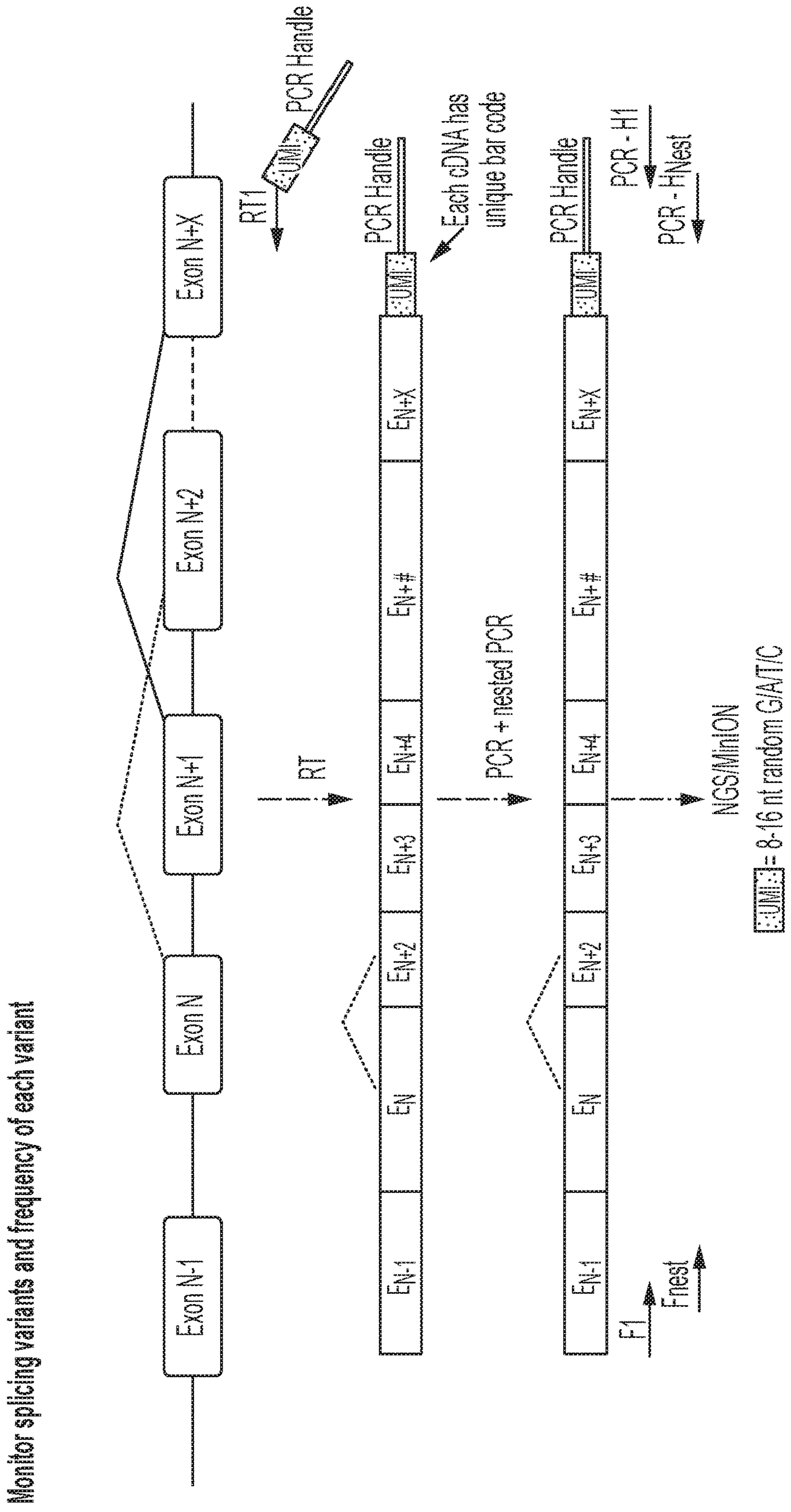
FIG. 2 shows a cartoon of a method for detecting multiple exon skipping.
Figure 3:
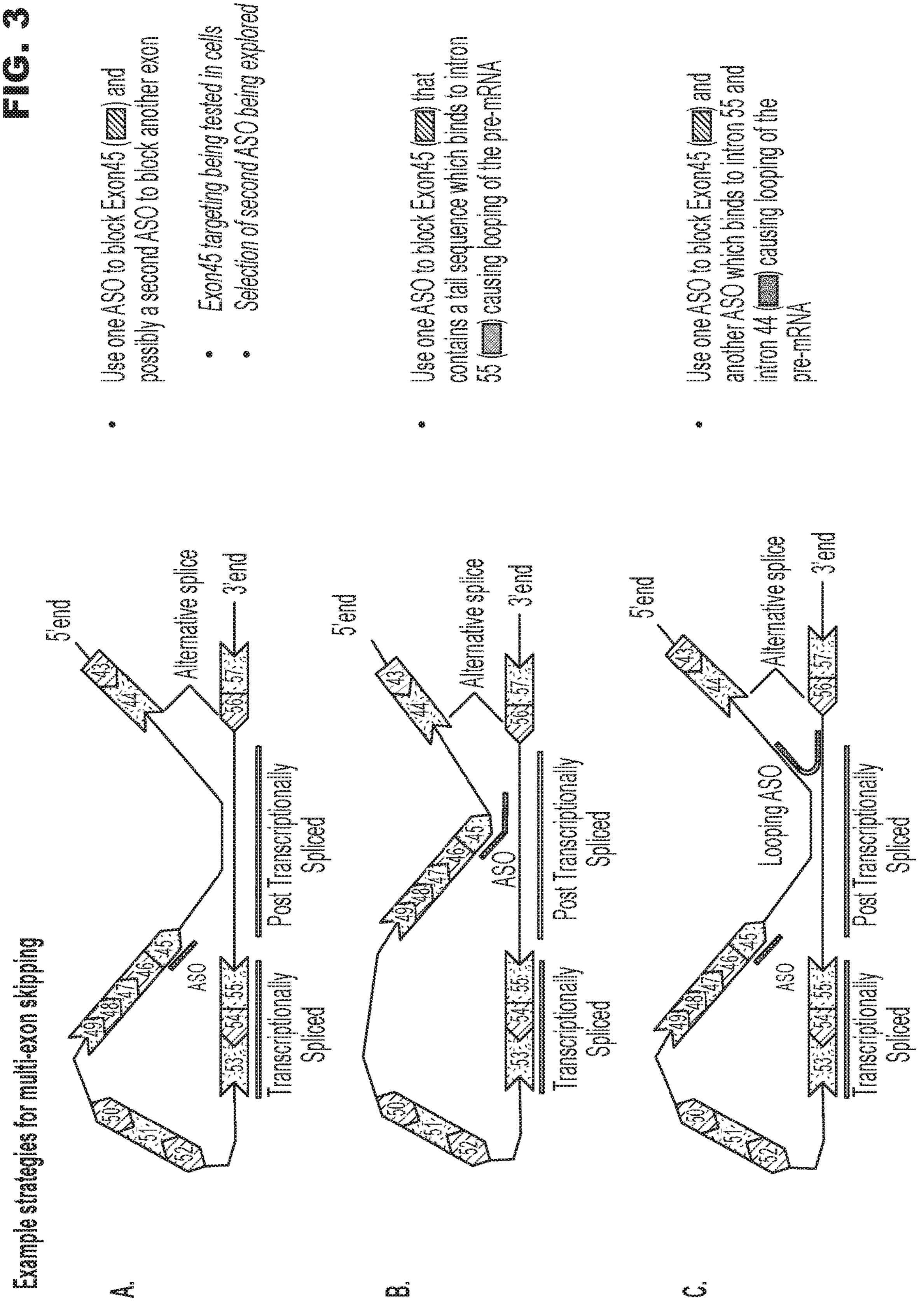
FIG. 3 illustrates various strategies for multiple exon skipping.

An illustration of this process is shown in FIG. 2.

Example Reverse RT Primer:

```
                         (SEQ ID NO: 3279)
5'-CAGTGGTATCAACGCAGAGTACG-NNNNNNNN-
                   ctgagaatctgacacagg-3'
```

5'-capital letter=N1 binding sequence (nested secondary)

N . . . N=UMI underline=gene specific sequence in exon64

Forward Primer (Exon 43):

Fnest=5'-gaagctctctcccagcttgat-3' (SEQ ID NO: 3280)

Among other things, the present disclosure provides the following Example Embodiments:

1. An oligonucleotide composition, comprising a plurality of oligonucleotides of a particular oligonucleotide type defined by:
   1) base sequence;
   2) pattern of backbone linkages;
   3) pattern of backbone chiral centers; and
   4) pattern of backbone phosphorus modifications, wherein:
   oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages; and
   the oligonucleotide composition being characterized in that, when it is contacted with a transcript in a transcript splicing system, splicing of the transcript is altered relative to that observed under a reference condition selected from the group consisting of absence of the composition, presence of a reference composition, and combinations thereof.

2. The composition of any one of the preceding embodiment, wherein the transcript is a Dystrophin transcript.

3. The composition of any one of the preceding embodiments, wherein splicing of the transcript is altered such that the level of skipping of exon 45, 51, or 53, or multiple exons is increased.

4. The composition of any one of the preceding embodiments, wherein each chiral internucleotidic linkage of the oligonucleotides of the plurality is independently a chirally controlled internucleotidic linkage.

5. The composition of any one of the preceding embodiments, wherein each chiral modified internucleotidic linkage independently has a stereopurity of at least 90%, 91%, 92%, 93%, 94%, 95%, 96%, 97%, 98%, or 99% at its chiral linkage phosphorus.

6. The composition of any one of the preceding embodiments, wherein the base sequence is or comprises or comprises 15 contiguous bases of the base sequence of any oligonucleotide in Table $A^1$.

7. The composition of any one of the preceding embodiments, wherein the pattern of backbone linkages comprises at least one non-negatively charged internucleotidic linkage.

8. The composition of any one of the preceding embodiments, wherein the pattern of backbone linkages comprises at least one non-negatively charged internucleotidic linkage which is a neutral internucleotidic linkage.

9. The composition of any one of the preceding embodiments, wherein the pattern of backbone linkages comprises at least one neutral internucleotidic linkage which is or comprises a triazole, neutral triazole, alkyne, or a cyclic guanidine.

10. The composition of any one of the preceding embodiments, wherein the oligonucleotide type comprises any of: cholesterol; L-carnitine (amide and carbamate bond); Folic acid; Gambogic acid; Cleavable lipid (1,2-dilaurin and ester bond); Insulin receptor ligand; CPP; Glucose (tri- and hex-antennary); or Mannose (tri- and hex-antennary, alpha and beta).

11. The composition of any one of the preceding embodiments, wherein the oligonucleotide type is any oligonucleotide listed in Table A1.

12. A composition comprising a plurality of oligonucleotides of a particular oligonucleotide type defined by:
   1) base sequence;
   2) pattern of backbone linkages;
   3) pattern of backbone chiral centers; and
   4) pattern of backbone phosphorus modifications,
   which composition is chirally controlled and it is enriched, relative to a substantially racemic preparation of oligonucleotides having the same base sequence, pattern of backbone linkages and pattern of backbone phosphorus modifications, for oligonucleotides of the particular oligonucleotide type, wherein:
   the oligonucleotide composition is characterized in that, when it is contacted with a transcript in a transcript splicing system, splicing of the transcript is altered in that level of skipping of an exon is increased relative to that observed under a reference condition selected from the group consisting of absence of the composition, presence of a reference composition, and combinations thereof.

13. The composition of any one of the preceding embodiments, wherein the transcript is a Dystrophin transcript.

14. The composition of any one of the preceding embodiments, wherein the exon is DMD exon 45, 51 or 53 or multiple DMD exons, and wherein the splicing of the transcript is altered such that the level of skipping of exon 45, 51, or 53, or multiple exons is increased.

15. The composition of any one of the preceding embodiments, wherein the pattern of backbone chiral centers comprises at least one Sp.

16. The composition of any one of the preceding embodiments, wherein the pattern of backbone chiral centers comprises at least one Rp.

17. The composition of any one of the preceding embodiments, wherein the composition is a chirally pure composition.

18. The composition of any one of the preceding embodiments, wherein each chiral modified internucleotidic linkage independently has a stereopurity of at least 90%, 91%, 92%, 93%, 94%, 95%, 96%, 97%, 98%, or 99% at its chiral linkage phosphorus.

19. The composition of any one of the preceding embodiments, wherein the base sequence is or comprises or comprises 15 contiguous bases of the base sequence of any oligonucleotide in Table A1.

20. The composition of any one of the preceding embodiments, wherein the pattern of backbone linkages comprises at least one non-negatively charged internucleotidic linkage.

21. The composition of any one of the preceding embodiments, wherein the pattern of backbone linkages comprises at least one non-negatively charged internucleotidic linkage which is a neutral internucleotidic linkage.

22. The composition of any one of the preceding embodiments, wherein the pattern of backbone linkages comprises at least one neutral internucleotidic linkage which is or comprises a triazole, neutral triazole, alkyne, or a cyclic guanidine.

23. The composition of any one of the preceding embodiments, wherein the oligonucleotide type comprises any of: cholesterol; L-carnitine (amide and carbamate bond); Folic acid; Gambogic acid; Cleavable lipid (1,2-dilaurin and ester bond); Insulin receptor ligand; CPP; Glucose (tri- and hex-antennary); or Mannose (tri- and hex-antennary, alpha and beta).

24. The composition of any one of the preceding embodiments, wherein the oligonucleotide type is any oligonucleotide listed in Table A1.

25. A composition comprising a plurality of oligonucleotides of a particular oligonucleotide type defined by:

1) base sequence;

2) pattern of backbone linkages; and 3) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 non-negatively charged internucleotidic linkages;

the oligonucleotide composition is characterized in that, when it is contacted with a transcript in a transcript splicing system, splicing of the transcript is altered in that level of skipping of an exon is increased relative to that observed under a reference condition selected from the group consisting of absence of the composition, presence of a reference composition, and combinations thereof.

26. The composition of any one of the preceding embodiments, wherein the transcript is a Dystrophin transcript.

27. The composition of any one of the preceding embodiments, wherein the exon is DMD exon 45, 51, or 53 or multiple DMD exons, and the splicing of the transcript is altered such that the level of skipping of exon 45, 51, or 53, or multiple exons is increased.

28. The composition of any one of the preceding embodiments, wherein each non-negatively charged internucleotidic linkage is independently an internucleotidic linkage at least 50% of which exists in its non-negatively charged form at pH 7.4.

29. The composition of any one of the preceding embodiments, wherein each non-negatively charged internucleotidic linkage is independently a neutral internucleotidic linkage, wherein at least 50% of the internucleotidic linkage exists in its neutral form at pH 7.4.

30. The composition of any one of the preceding embodiments, wherein the neutral form of each non-negatively charged internucleotidic linkage independently has a pKa no less than 8, 9, 10, 11, 12, 13, or 14.

31. The composition of any one of the preceding embodiments, wherein the neutral form of each non-negatively charged internucleotidic linkage, when the units which it connects are replaced with —$CH_3$, independently has a pKa no less than 8, 9, 10, 11, 12, 13, or 14.

32. The composition of any one of the preceding embodiments, wherein the reference condition is absence of the composition.

33. The composition of any one of the preceding embodiments, wherein the reference condition is presence of a reference composition.

34. The composition of any one of the preceding embodiments, wherein the reference composition is an otherwise identical composition wherein the oligonucleotides of the plurality comprise no chirally controlled internucleotidic linkages.

35. The composition of any one of the preceding embodiments, wherein the reference composition is an otherwise identical composition wherein the oligonucleotides of the plurality comprise no non-negatively charged internucleotidic linkages.

36. The composition of any one of the preceding embodiments, wherein the pattern of backbone linkages comprises one or more backbone linkages selected from phosphodiester, phosphorothioate and phosphodithioate linkages.

37. The composition of any one of the preceding embodiments, wherein the oligonucleotides of the plurality each comprise one or more sugar modifications.

38. The composition of any one of the preceding embodiments, wherein the sugar modifications comprise one or more modifications selected from: 2'-O-methyl, 2'-MOE, 2'-F, morpholino and bicyclic sugar moieties.

39. The composition of any one of the preceding embodiments, wherein one or more sugar modifications are 2'-F modifications.

40. The composition of any one of the preceding embodiments, wherein the oligonucleotides of the plurality each comprise a 5'-end region comprising 1, 2, 3, 4, 5, 6, 7, 8, 9, 10 or more nucleoside units comprising a 2'-F modified sugar moiety.

41. The composition of any one of the preceding embodiments, wherein the oligonucleotides of the plurality each comprise a 3'-end region comprising 1, 2, 3, 4, 5, 6, 7, 8, 9, 10 or more nucleoside units comprising a 2'-F modified sugar moiety.

42. The composition of any one of the preceding embodiments, wherein the oligonucleotides of the plurality each comprise a middle region between the 5'-end region and the 3'-region comprising 1, 2, 3, 4, 5, 6, 7, 8, 9, 10 or more nucleotidic units comprising a phosphodiester linkage.

43. The composition of any one of the preceding embodiments, wherein the base sequence is or comprises or comprises 15 contiguous bases of the base sequence of any oligonucleotide in Table A1.

44. The composition of any one of the preceding embodiments, wherein the pattern of backbone linkages comprises at least one non-negatively charged internucleotidic linkage.

45. The composition of any one of the preceding embodiments, wherein the pattern of backbone linkages comprises at least one non-negatively charged internucleotidic linkage which is a neutral internucleotidic linkage.

46. The composition of any one of the preceding embodiments, wherein the pattern of backbone linkages comprises at least one neutral internucleotidic linkage which is or comprises a triazole, neutral triazole, alkyne, or a cyclic guanidine.

47. The composition of any one of the preceding embodiments, wherein the oligonucleotide type comprises any of: cholesterol; L-carnitine (amide and carbamate bond); Folic acid; Gambogic acid; Cleavable lipid (1,2-dilaurin and ester bond); Insulin receptor ligand; CPP; Glucose (tri- and hex-antennary); or Mannose (tri- and hex-antennary, alpha and beta).

48. The composition of any one of the preceding embodiments, wherein the oligonucleotide type is any oligonucleotide listed in Table A1.

49. A composition comprising a plurality of oligonucleotides of a particular oligonucleotide type defined by:

1) base sequence;

2) pattern of backbone linkages; and 3) pattern of backbone phosphorus modifications, wherein:

oligonucleotides of the plurality comprise:

1) a 5'-end region comprising 1, 2, 3, 4, 5, 6, 7, 8, 9, 10 or more nucleoside units comprising a 2'-F modified sugar moiety;

2) a 3'-end region comprising 1, 2, 3, 4, 5, 6, 7, 8, 9, 10 or more nucleoside units comprising a 2'-F modified sugar moiety; and 3) a middle region between the 5'-end region and the 3'-region comprising 1, 2, 3, 4, 5, 6, 7, 8, 9, 10 or more nucleotidic units comprising a phosphodiester linkage.

50. The composition of embodiment 43 or 49, wherein the oligonucleotide composition is characterized in that, when it is contacted with a transcript in a transcript splicing system, splicing of the transcript is altered in that level of skipping of an exon is increased relative to that observed under a reference condition selected from the group consisting of absence of the composition, presence of a reference composition, and combinations thereof.

51. The composition of any one of the preceding embodiments, wherein the transcript is a Dystrophin transcript.

52. The composition of any one of the preceding embodiments, wherein the exon is DMD exon 45, 51, or 53 or multiple DMD exons, and the splicing of the transcript is altered such that the level of skipping of exon 45, 51, or 53, or multiple exons is increased.

53. The composition of any one of the preceding embodiments, wherein the 5'-end region comprises 1 or more nucleoside units not comprising a 2'-F modified sugar moiety.

54. The composition of any one of the preceding embodiments, wherein the 3'-end region comprises 1 or more nucleoside units not comprising a 2'-F modified sugar moiety.

55. The composition of any one of the preceding embodiments, wherein the middle region comprises 1 or more nucleotidic units comprising no phosphodiester linkage.

56. The composition of any one of the preceding embodiments, wherein the first of the 1, 2, 3, 4, 5, 6, 7, 8, 9, 10 or more nucleoside units comprising a 2'-F modified sugar moiety and a modified internucleotidic linkage of the 5'-end is the first, second, third, fourth or fifth nucleoside unit of the oligonucleotide from the 5'-end, and the last of the 1, 2, 3, 4, 5, 6, 7, 8, 9, 10 or more nucleoside units comprising a 2'-F modified sugar moiety and a modified internucleotidic linkage of the 3'-end is the last, second last, third last, fourth last, or fifth last nucleoside unit of the oligonucleotide.

57. The composition of any one of the preceding embodiments, wherein the 5'-end region comprising 2, 3, 4, 5, 6, 7, 8, 9, 10 or more consecutive nucleoside units comprising a 2'-F modified sugar moiety.

58. The composition of any one of the preceding embodiments, wherein the 5'-end region comprising 5, 6, 7, 8, 9, 10 or more consecutive nucleoside units comprising a 2'-F modified sugar moiety.

59. The composition of any one of the preceding embodiments, wherein the 3'-end region comprising 2, 3, 4, 5, 6, 7, 8, 9, 10 or more consecutive nucleoside units comprising a 2'-F modified sugar moiety.

60. The composition of any one of the preceding embodiments, wherein the 3'-end region comprising 5, 6, 7, 8, 9, 10 or more consecutive nucleoside units comprising a 2'-F modified sugar moiety.

61. The composition of any one of the preceding embodiments, wherein each internucleotidic linkage between two nucleoside units comprising a 2'-F modified sugar moiety in the 5'-end region is independently a modified internucleotidic linkage.

62. The composition of any one of the preceding embodiments, wherein each internucleotidic linkage between two nucleoside units comprising a 2'-F modified sugar moiety in the 3'-end region is independently a modified internucleotidic linkage.

63. The composition of embodiment 61 or 62, wherein each modified internucleotidic linkage is independently a chiral internucleotidic linkage.

64. The composition of embodiment 61 or 62, wherein each modified internucleotidic linkage is independently a chirally controlled internucleotidic linkage.

65. The composition of embodiment 61 or 62, wherein each modified internucleotidic linkage is a phosphorothioate internucleotidic linkage.

66. The composition of embodiment 61 or 62, wherein each modified internucleotidic linkage is a chirally controlled phosphorothioate internucleotidic linkage.

67. The composition of embodiment 61 or 62, wherein each modified internucleotidic linkage is a Sp chirally controlled phosphorothioate internucleotidic linkage.

68. The composition of any one of the preceding embodiments, wherein the middle region comprises 1, 2, 3, 4, 5, 6, 7, 8, 9, 10 or more natural phosphate linkages.

69. The composition of any one of the preceding embodiments, wherein the middle region comprises 1, 2, 3, 4, 5, 6, 7, 8, 9, 10 or more natural phosphate linkages each independently between a nucleoside unit comprising a 2'-$OR^1$ modified sugar moiety and a nucleoside unit comprising a 2'-F modified sugar moiety, or between two nucleoside units each independently comprising a 2'-$OR^1$ modified sugar moiety, wherein $R^1$ is optionally substituted $C_{1-6}$ alkyl.

70. The composition of any one of the preceding embodiments, wherein the middle region comprises 1, 2, 3, 4, 5, 6, 7, 8, 9, 10 or more non-negatively charged internucleotidic linkages.

71. The composition of any one of the preceding embodiments, wherein the middle region comprises 1, 2, 3, 4, 5, 6, 7, 8, 9, 10 or more non-negatively charged internucleotidic linkages each independently between a nucleoside unit comprising a 2'-$OR^1$ modified sugar moiety and a nucleoside unit comprising a 2'-F modified sugar moiety, or between two nucleoside units each independently comprising a 2'-$OR^1$ modified sugar moiety, wherein $R^1$ is optionally substituted $C_{1-6}$ alkyl.

72. The composition of embodiment 69 or 71, wherein 2'-$OR^1$ is 2'-$OCH_3$.

73. The composition of embodiment 69 or 71, wherein 2'-$OR^1$ is 2'-$OCH_2CH_2OCH_3$.

74. The composition of any one of the preceding embodiments, wherein the 5'-end region comprises at least 2, 3, 4, 5, 6, 7, 8, 9, or 10 chiral modified internucleotidic linkages.

75. The composition of any one of the preceding embodiments, wherein the 5'-end region comprises at least 2, 3, 4, 5, 6, 7, 8, 9, or 10 consecutive chiral modified internucleotidic linkages.

76. The composition of any one of the preceding embodiments, wherein each internucleotidic linkage in the 5'-end region is a chiral modified internucleotidic linkage.

77. The composition of any one of the preceding embodiments, wherein the 3'-end region comprises at least 2, 3, 4, 5, 6, 7, 8, 9, or 10 chiral modified internucleotidic linkages.

78. The composition of any one of the preceding embodiments, wherein the 3'-end region comprises at least 2, 3, 4, 5, 6, 7, 8, 9, or 10 consecutive chiral modified internucleotidic linkages.

79. The composition of any one of the preceding embodiments, wherein each internucleotidic linkage in the 3'-end region is a chiral modified internucleotidic linkage.

80. The composition of any one of the preceding embodiments, wherein the middle region comprises at least 2, 3, 4, 5, 6, 7, 8, 9, or 10 chiral modified internucleotidic linkages.

81. The composition of any one of the preceding embodiments, wherein the middle region comprises at least 2, 3, 4, 5, 6, 7, 8, 9, or 10 consecutive chiral modified internucleotidic linkages.

82. The composition of any one of embodiments 74-81, wherein each chiral modified internucleotidic linkage is independently a chirally controlled internucleotidic linkage.

83. The composition of any one of embodiments 74-81, wherein each chiral modified internucleotidic linkage is independently a chirally controlled internucleotidic linkage wherein its chirally controlled linkage phosphorus has a Sp configuration.

84. The composition of any one of embodiments 74-83, wherein each chiral modified internucleotidic linkage is independently a chirally controlled phosphorothioate internucleotidic linkage.

85. The composition of any one of the preceding embodiments, wherein the middle region comprises at least 2, 3, 4, 5, 6, 7, 8, 9, or 10 non-negatively charged internucleotidic linkages.

86. The composition of any one of the preceding embodiments, wherein the middle region comprises at least 2, 3, 4, 5, 6, 7, 8, 9, or 10 neutral internucleotidic linkages.

87. The composition of any one of the preceding embodiments, wherein a neutral internucleotidic linkage is a chiral internucleotidic linkage.

88. The composition of any one of the preceding embodiments, wherein a neutral internucleotidic linkage is a chirally controlled internucleotidic linkage independently of Rp or Sp at its linkage phosphorus.

89. The composition of any one of the preceding embodiments, wherein the base sequence comprises a sequence having no more than 5 mismatches from a 20 base long portion of the dystrophin gene or its complement.

90. The composition of any one of the preceding embodiments, wherein the length of the base sequence of the oligonucleotides of the plurality is no more than 50 bases.

91. The composition of any one of the preceding embodiments, wherein the pattern of backbone chiral centers comprises at least 3, 4, 5, 6, 7, 8, 9, 10, 11, 12, 13, 14, 15, 16, 17, 18, 19, 20, 21, 22, 23, 24, or 25 chirally controlled centers independently of Rp or Sp.

92. The composition of any one of the preceding embodiments, wherein the pattern of backbone chiral centers comprises at least 5 chirally controlled centers independently of Rp or Sp.

93. The composition of any one of the preceding embodiments, wherein the pattern of backbone chiral centers comprises at least 6 chirally controlled centers independently of Rp or Sp.

94. The composition of any one of the preceding embodiments, wherein the pattern of backbone chiral centers comprises at least 10 chirally controlled centers independently of Rp or Sp.

95. The composition of any one of the preceding embodiments, wherein the oligonucleotides of the particular oligonucleotide type are capable of mediating skipping of one or more exons of the dystrophin gene.

96. The composition of any one of the preceding embodiments, wherein the oligonucleotides of the plurality are capable of mediating the skipping of exon 45, 51 or 53 of the dystrophin gene.

97. The composition of embodiment 96, wherein the oligonucleotides of the plurality are capable of mediating the skipping of exon 45 of the dystrophin gene.

98. The composition of embodiment 96, wherein the oligonucleotides of the plurality are capable of mediating the skipping of exon 51 of the dystrophin gene.

99. The composition of embodiment 96, wherein the oligonucleotides of the plurality are capable of mediating the skipping of exon 53 of the dystrophin gene.

100. The composition of embodiment 97, wherein the base sequence comprises a sequence having no more than 5 mismatches from the sequence of any oligonucleotide disclosed herein.

101. The composition of embodiment 97, wherein the base sequence comprises or is the sequence of any oligonucleotide disclosed herein.

102. The composition of embodiment 97, wherein the base sequence is that of any oligonucleotide disclosed herein.

103. The composition of embodiment 97, wherein the base sequence comprises a sequence having no more than 5 mismatches from the sequence of any oligonucleotide disclosed herein.

104. The composition of embodiment 97, wherein the base sequence comprises or is any oligonucleotide disclosed herein.

105. The composition of embodiment 97, wherein the base sequence is any oligonucleotide disclosed herein.

106. The composition of any of the preceding embodiments, wherein the oligonucleotides of the plurality are any oligonucleotide disclosed herein.

107. The composition of embodiment 18, wherein oligonucleotides of the particular oligonucleotide type are any oligonucleotide disclosed herein.

108. The composition of any one of the preceding embodiments, wherein the base sequence is or comprises or comprises 15 contiguous bases of the base sequence of any oligonucleotide in Table A1.

109. The composition of any one of the preceding embodiments, wherein the pattern of backbone linkages comprises at least one non-negatively charged internucleotidic linkage.

110. The composition of any one of the preceding embodiments, wherein the oligonucleotides comprise 1, 2, 3, 4, 5, 6, 7, 8, 9, 10 or more non-negatively charged internucleotidic linkages.

111. The composition of any one of the preceding embodiments, wherein the oligonucleotides comprise 1, 2, 3, 4, 5, 6, 7, 8, 9, 10 or more chirally controlled non-negatively charged internucleotidic linkages.

112. The composition of any one of the preceding embodiments, wherein the oligonucleotides comprise 2, 3, 4, 5, 6, 7, 8, 9, 10 or more consecutive non-negatively charged internucleotidic linkages.

113. The composition of any one of the preceding embodiments, wherein the oligonucleotides comprise 2, 3, 4, 5, 6, 7, 8, 9, 10 or more consecutive chirally controlled non-negatively charged internucleotidic linkages.

114. The composition of any one of the preceding embodiments, wherein the oligonucleotides comprise a wing-core-wing, core-wing, or wing-core structure.

115. The composition of any one of the preceding embodiments, wherein a wing comprises 1, 2, 3, 4, 5, 6, 7, 8, 9, 10 or more non-negatively charged internucleotidic linkages.

116. The composition of any one of the preceding embodiments, wherein the oligonucleotides comprise a wing-core-wing, core-wing, or wing-core structure, and wherein a wing comprises 1, 2, 3, 4, 5, 6, 7, 8, 9, 10 or more chirally controlled non-negatively charged internucleotidic linkages.

117. The composition of any one of the preceding embodiments, wherein the oligonucleotides comprise a wing-core-wing, core-wing, or wing-core structure, and wherein a wing comprises 2, 3, 4, 5, 6, 7, 8, 9, 10 or more consecutive non-negatively charged internucleotidic linkages.

118. The composition of any one of the preceding embodiments, wherein the oligonucleotides comprise a wing-core-wing, core-wing, or wing-core structure, and wherein a wing comprises 2, 3, 4, 5, 6, 7, 8, 9, 10 or more consecutive chirally controlled non-negatively charged internucleotidic linkages.

119. The composition of any one of the preceding embodiments, wherein the oligonucleotides comprise or consist of a wing-core-wing structure, and wherein only one wing comprise one or more non-negatively charged internucleotidic linkages.

120. The composition of any one of the preceding embodiments, wherein the oligonucleotides comprise a wing-core-wing, core-wing, or wing-core structure, and wherein a core comprises 1, 2, 3, 4, 5, 6, 7, 8, 9, 10 or more non-negatively charged internucleotidic linkages.

121. The composition of any one of the preceding embodiments, wherein the oligonucleotides comprise a wing-core-wing, core-wing, or wing-core structure, and wherein a core comprises 1, 2, 3, 4, 5, 6, 7, 8, 9, 10 or more chirally controlled non-negatively charged internucleotidic linkages.

122. The composition of any one of the preceding embodiments, wherein the oligonucleotides comprise a wing-core-wing, core-wing, or wing-core structure, and wherein a core comprises 2, 3, 4, 5, 6, 7, 8, 9, 10 or more consecutive non-negatively charged internucleotidic linkages.

123. The composition of any one of the preceding embodiments, wherein the oligonucleotides comprise a wing-core-wing, core-wing, or wing-core structure, and wherein a core comprises 2, 3, 4, 5, 6, 7, 8, 9, 10 or more consecutive chirally controlled non-negatively charged internucleotidic linkages.

124. The composition of any one of the preceding embodiments, wherein 40%, 45%, 50%, 55%, 60%, 65%, 70%, 75%, 80%, 85%, 90%, 95%, or 100% of internucleotidic linkages of a wing is independently a non-negatively charged internucleotidic linkage, a natural phosphate internucleotidic linkage or a Rp chiral internucleotidic linkage.

125. The composition of any one of the preceding embodiments, wherein 40%, 45%, 50%, 55%, 60%, 65%, 70%, 75%, 80%, 85%, 90%, 95%, or 100% of internucleotidic linkages of a wing is independently a non-negatively charged internucleotidic linkage or a natural phosphate internucleotidic linkage.

126. The composition of any one of the preceding embodiments, wherein 40%, 45%, 50%, 55%, 60%, 65%, 70%, 75%, 80%, 85%, 90%, 95%, or 100% of internucleotidic linkages of a wing is independently a non-negatively charged internucleotidic linkage.

127. The composition of any one of embodiments 124-126, wherein the percentage is 50% or more.

128. The composition of any one of embodiments 124-126, wherein the percentage is 60% or more.

129. The composition of any one of embodiments 124-126, wherein the percentage is 75% or more.

130. The composition of any one of embodiments 124-126, wherein the percentage is 80% or more.

131. The composition of any one of embodiments 124-126, wherein the percentage is 90% or more.

132. The composition of any one of the preceding embodiments, wherein the oligonucleotides each comprise a non-negatively charged internucleotidic linkage and a natural phosphate internucleotidic linkage.

133. The composition of any one of the preceding embodiments, wherein the oligonucleotides each comprise a non-negatively charged internucleotidic linkage, a natural phosphate internucleotidic linkage and a Rp chiral internucleotidic linkage.

134. The composition of any one of the preceding embodiments, wherein a wing comprises a non-negatively charged internucleotidic linkage and a natural phosphate internucleotidic linkage.

135. The composition of any one of the preceding embodiments, wherein a wing comprises a non-negatively charged internucleotidic linkage, a natural phosphate internucleotidic linkage and a Rp chiral internucleotidic linkage.

136. The composition of any one of the preceding embodiments, wherein a core comprises 1, 2, 3, 4, 5, 6, 7, 8, 9, 10 or more non-negatively charged internucleotidic linkages.

137. The composition of any one of the preceding embodiments, wherein all non-negatively charged internucleotidic linkages of the same oligonucleotide have the same constitution.

138. The composition of any one of the preceding embodiments, wherein each of the non-negatively charged internucleotidic linkages independently has the structure of formula I-n-1, I-n-2, I-n-3, I-n-4, II, II-a-1, II-a-2, II-b-1, II-b-2, II-c-1, II-c-2, II-d-1, II-d-2, or a salt form thereof.

139. The composition of any one of the preceding embodiments, wherein each of the non-negatively charged internucleotidic linkages independently has the structure of formula I-n-1, I-n-2, I-n-3, I-n-4, II, II-a-1, II-a-2, II-b-1, II-b-2, II-c-1, II-c-2, II-d-1, II-d-2, or a salt form thereof.

140. The composition of any one of the preceding embodiments, wherein each of the non-negatively charged internucleotidic linkages independently has the structure of formula II, II-a-1, II-a-2, II-b-1, II-b-2, II-c-1, II-c-2, II-d-1, II-d-2, or a salt form thereof. 141. The composition of any one of the preceding embodiments, wherein each of the non-negatively charged internucleotidic linkages independently has the structure of formula II, II-a-1, II-a-2, II-b-1, II-b-2, II-c-1, II-c-2, II-d-1, II-d-2, or a salt form thereof.

142. The composition of any one of the preceding embodiments, wherein the pattern of backbone linkages comprises at least one non-negatively charged internucleotidic linkage which is a neutral internucleotidic linkage.

143. The composition of any one of the preceding embodiments, wherein the pattern of backbone linkages comprises at least one neutral internucleotidic linkage which is or comprises a triazole, neutral triazole, alkyne, or a cyclic guanidine.

144. The composition of any one of the preceding embodiments, wherein the oligonucleotide type comprises any of: cholesterol; L-carnitine (amide and carbamate bond); Folic acid; Gambogic acid; Cleavable lipid (1,2-dilaurin and ester bond); Insulin receptor ligand; CPP; Glucose (tri- and hex-antennary); or Mannose (tri- and hex-antennary, alpha and beta).

145. The composition of any one of the preceding embodiments, wherein the oligonucleotide type is any oligonucleotide listed in Table A1.

146. The composition of any one of the preceding embodiments, wherein each of the oligonucleotides comprises a chemical moiety conjugated to the oligonucleotide chain of the oligonucleotide optionally through a linker moiety, wherein the chemical moiety comprises a carbohydrate moiety, a peptide moiety, a receptor ligand moiety, or a moiety having the structure of $—N(R^1)_2$, $—N(R^1)_3$, or $—N═C(N(R^1)_2)_2$.

147. The composition of any one of the preceding embodiments, wherein each of the oligonucleotides comprises a chemical moiety conjugated to the oligonucleotide chain of the oligonucleotide optionally through a linker moiety, wherein the chemical moiety comprises a guanidine moiety.

148. The composition of any one of the preceding embodiments, wherein each of the oligonucleotides comprises a chemical moiety conjugated to the oligonucleotide chain of the oligonucleotide optionally through a linker moiety, wherein the chemical moiety comprises $—N═C(N(CH_3)_2)_2$.

149. The composition of any one of the preceding embodiments, wherein at least 5%, 10%, 20%, 30%, 40%, 50%, 60%, 70%, 80%, or 90% of the oligonucleotides in the composition that have the base sequence of the particular oligonucleotide type are oligonucleotides of the particular oligonucleotide type.

150. The composition of any one of the preceding embodiments, wherein at least 5%, 10%, 20%, 30%, 40%, 50%, 60%, 70%, 80%, or 90% of the oligonucleotides in the composition that have the base sequence, pattern of backbone linkages, and pattern of backbone phosphorus modifications of the particular oligonucleotide type are oligonucleotides of the particular oligonucleotide type.

151. The composition of any one of the preceding embodiments, wherein the oligonucleotides of the particular type are structurally identical.

152. The composition of any one of the preceding embodiments, wherein a non-negatively charged internucleotidic linkage is a phosphoramidate linkage.

153. The composition of any one of the preceding embodiments, wherein a non-negatively charged internucleotidic linkage comprises a guanidine moiety.

154. The composition of any one of the preceding embodiments, wherein a non-negatively charged internucleotidic linkage has the structure of formula I:

I

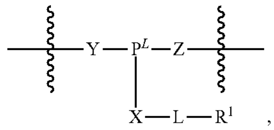

, or a salt form thereof, wherein:

$P^L$ is P(═W), P, or P→B(R')$_3$;

W is O, N(-L-$R^5$), S or Se;

each of $R^1$ and $R^5$ is independently —H, -L-R', halogen, —CN, $—NO_2$, -L-Si(R')$_3$, OR', —SR', or —N(R')$_2$;

each of X, Y and Z is independently —O—, —S—, —N(-L-$R^5$)—, or L;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

155. The composition of any one of the preceding embodiments, wherein each non-negatively charged internucleotidic linkage independently has the structure of formula I or a salt form thereof.

156. The composition of any one of the preceding embodiments, wherein a non-negatively charged internucleotidic linkage has the structure of formula I-n-1 or a salt form thereof:

I-n-1

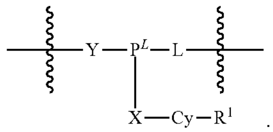

.

157. The composition of any one of the preceding embodiments, wherein each non-negatively charged internucleotidic linkage independently has the structure of formula I-n-1 or a salt form thereof.

158. The composition of any one of the preceding embodiments, wherein a non-negatively charged internucleotidic linkage has the structure of formula I-n-2 or a salt form thereof:

I-n-2

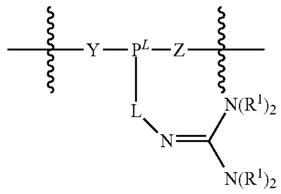

159. The composition of any one of the preceding embodiments, wherein a non-negatively charged internucleotidic linkage has the structure of formula I-n-3 or a salt form thereof:

I-n-3

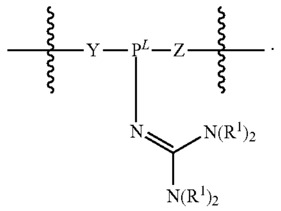

160. The composition of any one of the preceding embodiments, wherein each non-negatively charged internucleotidic linkage independently has the structure of formula I-n-3 or a salt form thereof.

161. The composition of any one of the preceding embodiments, wherein a non-negatively charged internucleotidic linkage has the structure of formula I-n-3 or a salt form thereof, wherein one R' from one —$N(R')_2$ and one R' from the other —$N(R')_2$ are taken together with their intervening atoms to form an optionally substituted, 3-30 membered, monocyclic, bicyclic or polycyclic ring having, in addition to the intervening atoms, 0-10 heteroatoms.

162. The composition of any one of the preceding embodiments, wherein each non-negatively charged internucleotidic linkage independently has the structure of formula I-n-3 or a salt form thereof, wherein one R' from one —$N(R')_2$ and one R' from the other —$N(R')_2$ are taken together with their intervening atoms to form an optionally substituted, 3-30 membered, monocyclic, bicyclic or polycyclic ring having, in addition to the intervening atoms, 0-10 heteroatoms.

163. The composition of any one of the preceding embodiments, wherein a non-negatively charged internucleotidic linkage has the structure of formula I-n-3 or a salt form thereof, wherein one R' from one —$N(R')_2$ and one R' from the other —$N(R')_2$ are taken together with their intervening atoms to form an optionally substituted 5-membered monocyclic ring having no more than two nitrogen atoms.

164. The composition of any one of the preceding embodiments, wherein each non-negatively charged internucleotidic linkage independently has the structure of formula I-n-3 or a salt form thereof, wherein one R' from one —$N(R')_2$ and one R' from the other —$N(R')_2$ are taken together with their intervening atoms to form an optionally substituted 5-membered monocyclic ring having no more than two nitrogen atoms.

165. The composition of any one of embodiments 159-162, wherein the ring formed is a saturated ring.

166. The composition of any one of embodiments 159-162, wherein the ring formed is a partially unsaturated ring.

167. The composition of any one of the preceding embodiments, wherein a non-negatively charged internucleotidic linkage has the structure of formula I-n-4 or a salt form thereof:

I-n-4

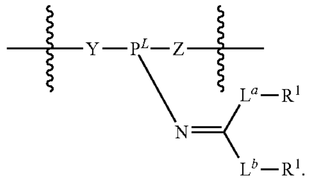

168. The composition of embodiment 167, wherein $L^a$ is a covalent bond.

169. The composition of embodiment 167, wherein $L^a$ is —$N(R^1)$—.

170. The composition of embodiment 167, wherein $L^a$ is —N(R')—.

171. The composition of embodiment 167, wherein $L^a$ is —N(R)—.

172. The composition of embodiment 167, wherein $L^a$ is —S(O)—.

173. The composition of embodiment 167, wherein $L^a$ is —$S(O)_2$—.

174. The composition of embodiment 167, wherein $L^a$ is —$S(O)_2N(R')$—.

175. The composition of any one of embodiments 167-174, wherein $L^b$ is a covalent bond.

176. The composition of any one of embodiments 167-174, wherein $L^b$ is —$N(R^1)$—.

177. The composition of any one of embodiments 167-174, wherein $L^b$ is —N(R')—.

178. The composition of any one of embodiments 167-174, wherein $L^b$ is —N(R)—.

179 The composition of any one of embodiments 167-174, wherein $L^b$ is —S(O)—.

180. The composition of any one of embodiments 167-174, wherein $L^b$ is —$S(O)_2$—.

181. The composition of any one of embodiments 167-174, wherein $L^b$ is —$S(O)_2N(R')$—.

182. The composition of any one of the preceding embodiments, wherein a non-negatively charged internucleotidic linkage has the structure of formula II:

II

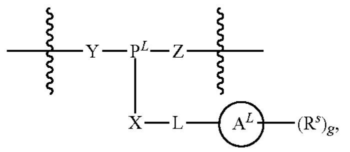

or a salt form thereof, wherein:

$P^L$ is P(═W), P, or P→$B(R')_3$;

W is O, N(-L-$R^5$), S or Se;

each of X, Y and Z is independently —O—, —S—, —N(-L-$R^5$)—, or L;

$R^5$ is —H, -L-R', halogen, —CN, —$NO_2$, -L-Si$(R')_3$, —OR', —SR', or —N$(R')_2$;

Ring $A^L$ is an optionally substituted 3-20 membered monocyclic, bicyclic or polycyclic ring having 0-10 heteroatoms;

each $R^s$ is independently —H, halogen, —CN, —$N_3$, —NO, —$NO_2$, -L-R', -L-Si$(R)_3$, -L-OR', -L-SR', -L-N$(R')_2$, O-L-R', —O-L-Si$(R)_3$, —O-L-OR', —O-L-SR', or —O-L-N$(R')_2$;

g is 0-20;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C$(R')_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S$(O)_2$—, —S$(O)_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B$(R')_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B$(R')_3$]O—, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each R' is independently —R, —C(O)R, —C(O)OR, or —S$(O)_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

183. The composition of any one of the preceding embodiments, wherein each non-negatively charged internucleotidic linkage independently has the structure of formula II, or a salt form thereof.

184. The composition any one of the preceding embodiments, wherein a non-negatively charged internucleotidic linkage has the structure of formula II-a-1:

II-a-1

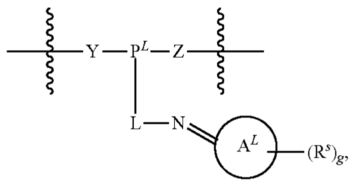

or a salt form thereof.

185. The composition any one of the preceding embodiments, wherein a non-negatively charged internucleotidic linkage has the structure of formula II-a-2:

II-a-2

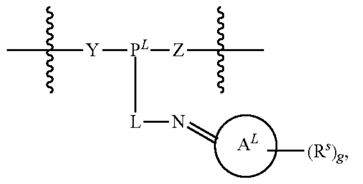

or a salt form thereof.

186. The composition of any one of the preceding embodiments, wherein each non-negatively charged internucleotidic linkage independently has the structure of formula II-a-1 or II-a-2, or a salt form thereof.

187. The composition of any one of embodiments 182-186, wherein a non-negatively charged internucleotidic linkage has the structure of formula II-b-1:

II-b-1

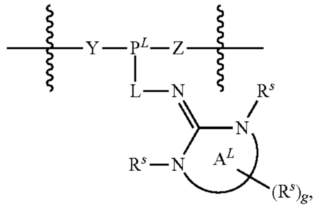

or a salt form thereof, wherein g is 0-18.

188. The composition of any one of embodiments 182-187, wherein a non-negatively charged internucleotidic linkage has the structure of formula II-b-2:

II-b-2

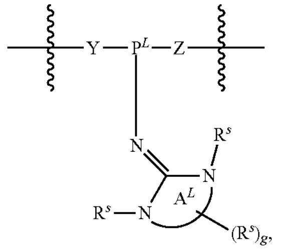

or a salt form thereof, wherein g is 0-18.

189. The composition of any one of the preceding embodiments, wherein each non-negatively charged internucleotidic linkage independently has the structure of formula II-b-1 or II-b-2, or a salt form thereof.

190. The composition of any one of embodiments 182-188, wherein Ring $A^L$ is an optionally substituted 3-20 membered monocyclic ring having 0-10 heteroatoms (in addition to the two nitrogen atoms for formula II-b-1 or II-b-2).

191. The composition of any one of embodiments 182-188, wherein Ring $A^L$ is an optionally substituted 5-membered monocyclic saturated ring.

192. The composition of any one of embodiments 182-191, wherein a non-negatively charged internucleotidic linkage has the structure of formula II-c-1:

II-c-1

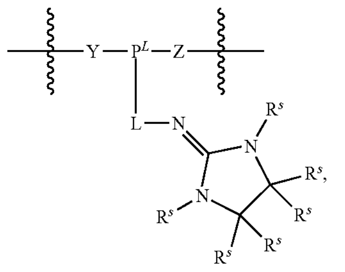

or a salt form thereof, wherein g is 0-4.

193. The composition of any one of embodiments 182-193, wherein a non-negatively charged internucleotidic linkage has the structure of formula II-c-2:

II-c-2

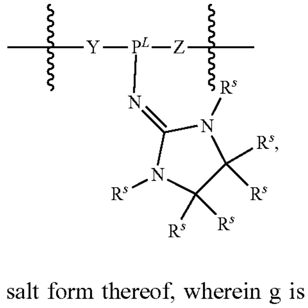

or a salt form thereof, wherein g is 0-4.

194. The composition of any one of the preceding embodiments, wherein each non-negatively charged internucleotidic linkage independently has the structure of formula II-c-1 or II-c-2, or a salt form thereof.

195. The composition of any one of embodiments 182-193, wherein each non-negatively charged internucleotidic linkage has the same structure.

196. The composition of any one of the preceding embodiments, wherein, if applicable, each internucleotidic linkage in the oligonucleotides of the plurality that is not a non-negatively charged internucleotidic linkage independently has the structure of formula I.

197. The composition of any one of the preceding embodiments, wherein each internucleotidic linkage in the oligonucleotides of the plurality independently has the structure of formula I.

198. The composition of any one of the preceding embodiments, wherein one or more $P^L$ is P(=W).

199. The composition of any one of the preceding embodiments, wherein each $P^L$ is independently P(=W).

200. The composition of any one of the preceding embodiments, wherein one or more W is O.

201. The composition of any one of the preceding embodiments, wherein each W is O.

202. The composition of any one of the preceding embodiments, wherein one or more W is S.

203. The composition of any one of the preceding embodiments, wherein one or more W is independently N(-L-$R^5$).

204. The composition of any one of the preceding embodiments, wherein one or more internucleotidic linkage independently has the structure of formula III or salt form thereof:

III

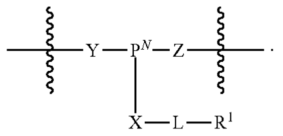

205. The composition of embodiment 204, wherein $P^N$ is P(=N-L-$R^5$).

206. The composition of embodiment 204, wherein $P^N$ is

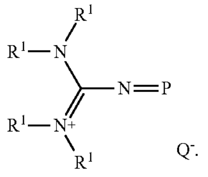

207. The composition of embodiment 204, wherein $P^N$ is

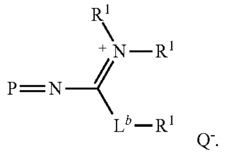

208. The composition of embodiment 207, wherein $L^a$ is a covalent bond.

209. The composition of embodiment 207, wherein $L^a$ is —N($R^1$)—.

210. The composition of embodiment 207, wherein $L^a$ is —N(R')—.

211. The composition of embodiment 207, wherein $L^a$ is —N(R)—.

212. The composition of embodiment 207, wherein $L^a$ is —S(O)—.

213. The composition of embodiment 207, wherein $L^a$ is —$S(O)_2$—.

214. The composition of embodiment 207, wherein $L^a$ is —$S(O)_2N(R')$—.

215. The composition of embodiment 204, wherein $P^N$ is

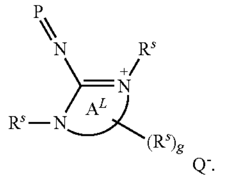

216. The composition of embodiment 204, wherein $P^N$ is

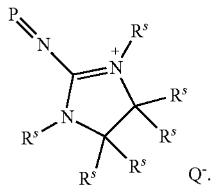

217. The composition of embodiment 204, wherein $P^N$ is

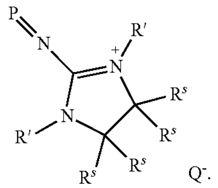

218. The composition of any one of the preceding embodiments, wherein one or more Y is O.

219. The composition of any one of the preceding embodiments, wherein each Y is O.

220. The composition of any one of the preceding embodiments, wherein one or more Z is O.

221. The composition of any one of the preceding embodiments, wherein each Z is O.

222. The composition of any one of the preceding embodiments, wherein one or more X is O.

223. The composition of any one of the preceding embodiments, wherein one or more X is S.

224. The composition of any one of the preceding embodiments, wherein a non-negatively charged internucleotidic linkage has the structure of

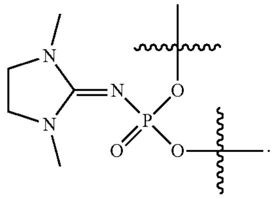

225. The composition of any one of the preceding embodiments, wherein a non-negatively charged internucleotidic linkage has the structure of

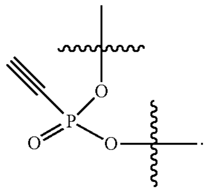

226. The composition of any one of the preceding embodiments, wherein a non-negatively charged internucleotidic linkage has the structure of

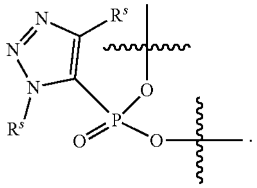

227. The composition of any one of the preceding embodiments, wherein for each internucleotidic linkage of formula I or a salt fore thereof that is not a non-negatively charged internucleotidic linkage, X is independently O or S, and $-L-R^1$ is —H (natural phosphate linkage or phosphorothioate linkage, respectively).

228. The composition of any one of the preceding embodiments, wherein each phosphorothioate linkage, if any, in the oligonucleotides of the plurality is independently a chirally controlled internucleotidic linkage.

229. The composition of any one of the preceding embodiments, wherein at least one non-negatively charged internucleotidic linkage is a chirally controlled internucleotidic linkage.

230. The composition of any one of the preceding embodiments, wherein at least one non-negatively charged internucleotidic linkage is a chirally controlled internucleotidic linkage.

231. The composition of any one of the preceding embodiments, wherein the oligonucleotides of the plurality comprise a targeting moiety wherein the targeting moiety is independently connected to an oligonucleotide backbone through a linker.

232. The composition of embodiment 231, wherein the targeting moiety is a carbohydrate moiety.

233. The composition of embodiment 231 or 232, wherein the targeting moiety comprises or is a GalNac moiety.

234. The composition of any one of the preceding embodiments, wherein the oligonucleotides of the plurality comprise a lipid moiety wherein the lipid moiety is independently connected to an oligonucleotide backbone through a linker.

235. The composition of any one of the preceding embodiments, wherein oligonucleotides of the plurality exist as salts, wherein one or more non-neutral internucleotidic linkages at the condition of the composition independently exist as a salt form.

236. The composition of any one of the preceding embodiments, wherein oligonucleotides of the plurality exist as salts, wherein one or more negatively-charged internucleotidic linkages at the condition of the composition independently exist as a salt form.

237. The composition of any one of the preceding embodiments, wherein oligonucleotides of the plurality exist as salts, wherein one or more negatively-charged internucleotidic linkages at the condition of the composition independently exist as a metal salt.

238. The composition of any one of the preceding embodiments, wherein oligonucleotides of the plurality exist as salts, wherein each negatively-charged internucleotidic linkage at the condition of the composition independently exists as a metal salt.

239. The composition of any one of the preceding embodiments, wherein oligonucleotides of the plurality exist as salts, wherein each negatively-charged internucleotidic linkage at the condition of the composition independently exists as sodium salt.

240. The composition of any one of the preceding embodiments, wherein oligonucleotides of the plurality exist as salts, wherein each negatively-charged internucleotidic linkage is independently a natural phosphate linkage (the neutral form of which is —O—P(O)(OH)—O) or phosphorothioate internucleotidic linkage (the neutral form of which is —O—P(O)(SH)—O).

241. An oligonucleotide composition, comprising a plurality of oligonucleotides of a particular oligonucleotide type defined by:

1) base sequence;
2) pattern of backbone linkages;
3) pattern of backbone chiral centers; and
4) pattern of backbone phosphorus modifications, wherein:

oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages; and oligonucleotides of the plurality comprise at least 1, 2, 3, 4, 5, 6, 7, 8, 9, 10, 11, 12, 13, 14, 15, 16, 17, 18, 19, or 20 non-negatively charged internucleotidic linkages.

242. The composition of any one of the preceding embodiments, wherein at least one non-negatively charged internucleotidic linkage is a neutral internucleotidic linkage.

243. The composition of any one of the preceding embodiments, wherein a neutral internucleotidic linkage is or comprises a triazole, neutral triazole, alkyne, or a cyclic guanidine.

244. The oligonucleotide composition of any one of the preceding embodiments, wherein the oligonucleotide composition is characterized in that, when it is contacted with a transcript in a transcript splicing system, splicing of the transcript is altered relative to that observed under a reference condition selected from the group consisting of absence of the composition, presence of a reference composition, and combinations thereof.

245. The oligonucleotide composition of any one of the preceding embodiments, wherein the transcript is a Dystrophin transcript.

246. The oligonucleotide composition of any one of the preceding embodiments, wherein the splicing of the transcript is altered such that the level of skipping of exon 45, 51, or 53, or multiple exons is increased.

247. The oligonucleotide composition of any one of the preceding embodiments, wherein the oligonucleotide composition is capable of mediating knockdown of a target gene.

248. An oligonucleotide composition, comprising a plurality of oligonucleotides of a particular oligonucleotide type defined by:

1) base sequence;
2) pattern of backbone linkages;
3) pattern of backbone chiral centers; and
4) pattern of backbone phosphorus modifications, wherein:

the oligonucleotides of the plurality comprise cholesterol; L-carnitine (amide and carbamate bond); Folic acid; Cleavable lipid (1,2-dilaurin and ester bond); Insulin receptor ligand; Gambogic acid; CPP; Glucose (tri- and hex-antennary); or Mannose (tri- and hex-antennary, alpha and beta).

249. The composition of embodiment 248, wherein the oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages.

250. The composition of any one of the preceding embodiments, wherein the oligonucleotide composition is characterized in that, when it is contacted with a transcript in a transcript splicing system, splicing of the transcript is altered relative to that observed under a reference condition selected from the group consisting of absence of the composition, presence of a reference composition, and combinations thereof.

251. The composition of any one of the preceding embodiments, wherein the transcript is a Dystrophin transcript.

252. The composition of any one of the preceding embodiments, wherein the splicing of the transcript is altered such that the level of skipping of exon 45, 51, or 53, or multiple exons is increased.

253. The composition of any one of the preceding embodiments, wherein the oligonucleotide composition is capable of mediating knockdown of a target gene.

254. The composition of any one of the preceding embodiments, wherein each heteroatom is independently boron, nitrogen, oxygen, silicon, sulfur, or phosphorus.

255. A pharmaceutical composition comprising an oligonucleotide composition of any one of the preceding embodiments and a pharmaceutically acceptable carrier.

256. A method for altering splicing of a target transcript, comprising administering an oligonucleotide composition of any one of the preceding embodiments.

257. The method of embodiment 256, wherein the splicing of the target transcript is altered relative to absence of the composition.

258. The method of any one of the preceding embodiments, wherein the alteration is that one or more exon is skipped at an increased level relative to absence of the composition.

259. The method of any one of the preceding embodiments, wherein the target transcript is pre-mRNA of dystrophin.

260. The method of any one of the preceding embodiments, wherein exon 45 of dystrophin is skipped at an increased level relative to absence of the composition.

261. The method of any one of the preceding embodiments, wherein exon 51 of dystrophin is skipped at an increased level relative to absence of the composition.

262. The method of any one of embodiments 256-259, wherein exon 53 of dystrophin is skipped at an increased level relative to absence of the composition.

263. The method of any one of the preceding embodiments, wherein a protein encoded by the mRNA with the exon skipped provides one or more functions better than a protein encoded by the corresponding mRNA without the exon skipping.

264. A method for treating muscular dystrophy, Duchenne (Duchenne's) muscular dystrophy (DMD), or Becker (Becker's) muscular dystrophy (BMD), comprising administering to a subject susceptible thereto or suffering therefrom a composition of any one of the preceding embodiments.

265. A method for treating muscular dystrophy, Duchenne (Duchenne's) muscular dystrophy (DMD), or Becker (Becker's) muscular dystrophy (BMD), comprising administering to a subject susceptible thereto or suffering therefrom a composition comprising any oligonucleotide disclosed herein.

266. A method for treating muscular dystrophy, Duchenne (Duchenne's) muscular dystrophy (DMD), or Becker (Becker's) muscular dystrophy (BMD), comprising (a) administering to a subject susceptible thereto or suffering therefrom a composition comprising any oligonucleotide disclosed herein, and (b) administering to the subject additional treatment which is capable of preventing, treating, ameliorating or slowing the progress of muscular dystrophy, Duchenne (Duchenne's) muscular dystrophy (DMD), or Becker (Becker's) muscular dystrophy (BMD).

267. The method of embodiment 266, wherein the additional treatment is a second oligonucleotide.

268. The composition of any of the preceding embodiments, wherein the transcript splicing system comprises a myoblast or myotubule.

269. The composition of any of the preceding embodiments, wherein the transcript splicing system comprises a myoblast cell.

270. The composition of any of the preceding embodiments, wherein the transcript splicing system comprises a myoblast cell, which is contacted with the composition after 0, 4 or 7 days of pre-differentiation.

271. A composition comprising a combination comprising: (a) a first composition of any of the preceding embodiments; (b) a second composition of any of the preceding embodiments; and, optionally (c) a third composition of any of the preceding embodiments, wherein the first, second and third compositions are different.

272. A method for preparing an oligonucleotide or an oligonucleotide composition thereof, comprising providing a compound having the structure of:

Formula 3-I

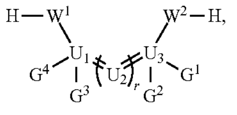

or a salt thereof.

273. A method for preparing an oligonucleotide or an oligonucleotide composition thereof, comprising providing a compound having the structure of:

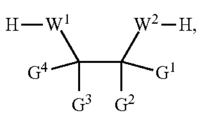

or a salt thereof.

274. A method for preparing an oligonucleotide or an oligonucleotide composition thereof, comprising providing a compound having the structure of

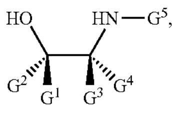

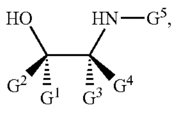

-continued

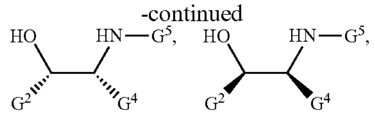

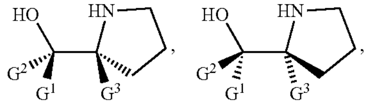

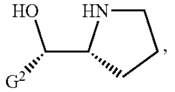

or

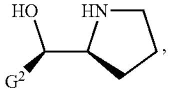

or a salt thereof.

275. The method of any one of embodiments 272-274, wherein the compound is stereochemically pure.

276. The method of any one of embodiments 272-275, wherein the compound is a compound of Tables CA-1, CA-2, CA-3, CA-4, CA-5, CA-6, CA-7, CA-8, CA-9, CA-10, CA-11, or CA-12, or a related diastereomer or enantiomer thereof.

277. The method of any one of embodiments 272-275, wherein the compound is a compound of Table CA-2 or a related diastereomer or enantiomer thereof.

278. The method of any one of embodiments 272-275, wherein the compound is a compound of Table CA-3 or a related diastereomer or enantiomer thereof.

279. The method of any one of embodiments 272-275, wherein the compound is a compound of Table CA-4 or a related diastereomer or enantiomer thereof.

280. The method of any one of embodiments 272-275, wherein the compound is a compound of Table CA-5 or a related diastereomer or enantiomer thereof.

281. The method of any one of embodiments 272-275, wherein the compound is a compound of Table CA-6 or a related diastereomer or enantiomer thereof.

282. The method of any one of embodiments 272-275, wherein the compound is a compound of Table CA-7 or a related diastereomer or enantiomer thereof.

283. The method of any one of embodiments 272-275, wherein the compound is a compound of Table CA-8 or a related diastereomer or enantiomer thereof.

284. The method of any one of embodiments 272-275, wherein the compound is a compound of Table CA-9 or a related diastereomer or enantiomer thereof.

285. The method of any one of embodiments 272-275, wherein the compound is a compound of Table CA-10 or a related diastereomer or enantiomer thereof.

286. The method of any one of embodiments 272-275, wherein the compound is a compound of Table CA-11 or a related diastereomer or enantiomer thereof.

287. The method of any one of embodiments 272-275, wherein the compound is a compound of Table CA-12 or a related diastereomer or enantiomer thereof.

288. A method for preparing an oligonucleotide or an oligonucleotide composition thereof, comprising providing a phosphoramidite compound comprising a chiral auxiliary moiety having the structure of

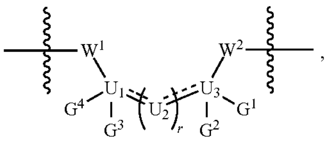

-continued

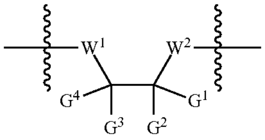
,
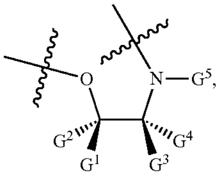
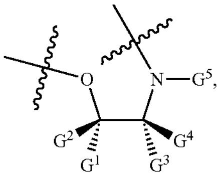
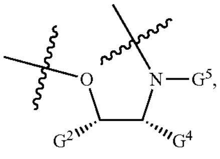
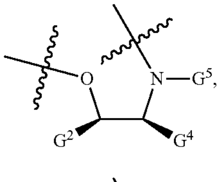
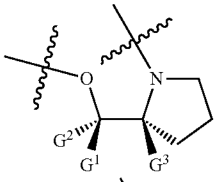
,
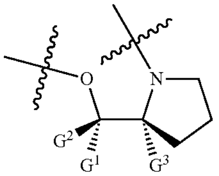
,
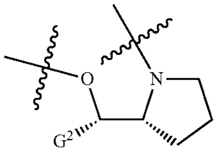
, or
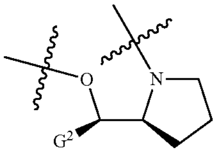
.

289. A method for preparing an oligonucleotide or an oligonucleotide composition thereof, comprising providing a phosphoramidite compound having the structure of:

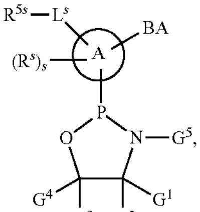
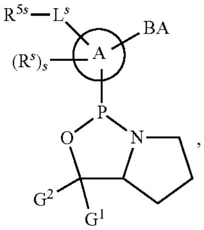
,
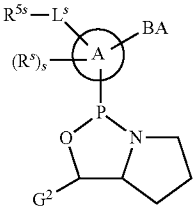
,
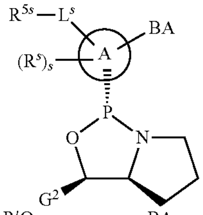
,
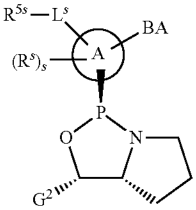
,
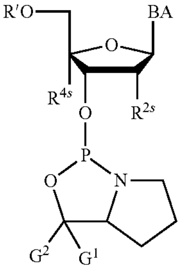
, -continued

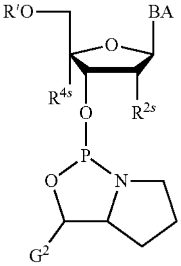
,
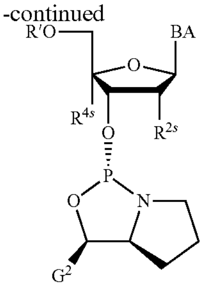
,
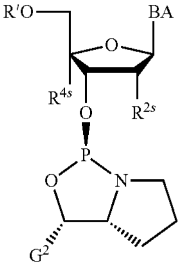
,
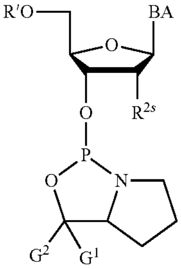
,
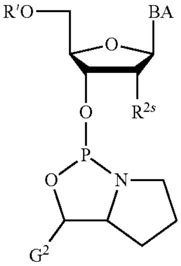
,
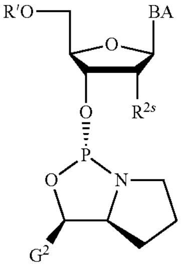
, or
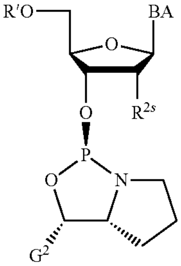
, or a salt thereof.

290. The method of any one of embodiments 272-289, wherein $W^1$ is —$NG^5$-.

291. The method of any one of embodiments 272-290, wherein $G^5$ and one of $G^3$ and $G^4$ are taken together to form an optionally substituted 3-8 membered saturated ring having 0-3 heteroatoms in addition to the nitrogen of —$NG^5$-.

292. The method of any one of embodiments 272-290, wherein $G^5$ and one of $G^3$ and $G^4$ are taken together to form an optionally substituted 5-membered saturated ring having no heteroatoms in addition to the nitrogen of —$NG^5$-.

293. The method of any one of embodiments 272-292, wherein $W^2$ is —O—.

294. The method of any one of embodiments 272-293, wherein $G^2$ comprises an electron-withdrawing group.

295. The method of any one of embodiments 272-293, wherein $G^2$ is methyl substituted with one or more electron-withdrawing groups.

296. The method of any one of embodiments 294-295, wherein an electron-withdrawing group is —CN, —$NO_2$, halogen, —C(O)$R^1$, —C(O)OR', —C(O)N(R')$_2$, —S(O)$R^1$, —$S(O)_2R^1$, —P(W)($R^1$)$_2$, —P(O)($R^1$)$_2$, —P(O)(OR')$_2$, or —P(S)($R^1$)$_2$, or aryl or heteroaryl substituted with one or more of —CN, —$NO_2$, halogen, —C(O)$R^1$, —C(O)OR', —C(O)N(R')$_2$, —S(O)R$^1$, —S(O)$_2$R$^1$, —P(W)(R$^1$)$_2$, —P(O)(R$^1$)$_2$, —P(O)(OR')$_2$, or —P(S)(R$^1$)$_2$.

297. The method of any one of embodiments 294-295, wherein an electron-withdrawing group is —CN, —NO$_2$, halogen, —C(O)R$^1$, —C(O)OR', —C(O)N(R')$_2$, —S(O)R$^1$, —S(O)$_2$R$^1$, —P(W)(R$^1$)$_2$, —P(O)(R$^1$)$_2$, —P(O)(OR')$_2$, or —P(S)(R$^1$)$_2$, or phenyl substituted with one or more of —CN, —NO$_2$, halogen, —C(O)R$^1$, —C(O)OR', —C(O)N(R')$_2$, —S(O)R$^1$, —S(O)$_2$R$^1$, —P(W)(R$^1$)$_2$, —P(O)(R$^1$)$_2$, —P(O)(OR')$_2$, or —P(S)(R$^1$)$_2$.

298. The method of any one of embodiments 294-295, wherein an electron-withdrawing group is —CN, —NO$_2$, halogen, —C(O)R$^1$, —C(O)OR', —C(O)N(R')$_2$, —S(O)R$^1$, —S(O)$_2$R$^1$, —P(W)(R$^1$)$_2$, —P(O)(R$^1$)$_2$, —P(O)(OR')$_2$, or —P(S)(R$^1$)$_2$.

299. The method of any one of embodiments 272-294, wherein G$^2$ is -L'-L"—R', wherein L' is —C(R)$_2$— or optionally substituted —CH$_2$—, and L" is a covalent bond, —P(O)(R')—, —P(O)(R')O—, —P(O)(OR')—, —P(O)(OR')O—, —P(O)[N(R')]—, —P(O)[N(R')]O—, —P(O)[N(R')][N(R')]—, —P(S)(R')—, —S(O)$_2$—, —S(O)$_2$—, —S(O)$_2$O—, —S(O)—, —C(O)—, or —C(O)N(R')—.

300. The method of any one of embodiments 272-294, wherein G$^2$ is -L'-L"—R', wherein L' is —C(R)$_2$— or optionally substituted —CH$_2$—, and L" is —P(O)(R')—, —P(O)(R')O—, —P(O)(OR')—, —P(O)(OR')O—, —P(O)[N(R')]—, —P(O)[N(R')]O—, —P(O)[N(R')][N(R')]—, —P(S)(R')—, —S(O)$_2$—, —S(O)$_2$—, —S(O)$_2$O—, —S(O)—, —C(O)—, or —C(O)N(R')—.

301. The method of any one of embodiments 272-300, wherein G$^2$ is -L'—S(O)$_2$R'.

302. The method of embodiment 301, wherein R' is optionally substituted C$_{1-6}$ aliphatic.

303. The method of embodiment 301, wherein R' is optionally substituted C$_{1-6}$ alkyl.

304. The method of embodiment 301, wherein R' is methyl, isopropyl or t-butyl.

305. The method of embodiment 301, wherein R' is optionally substituted phenyl.

306 The method of embodiment 301, wherein R' is phenyl.

307. The method of embodiment 301, wherein R' is substituted phenyl.

308. The method of any one of embodiments 272-300, wherein G$^2$ is -L'—P(O)(R')$_2$.

309. The method of embodiment 308, wherein one R' is optionally substituted C$_{1-6}$ aliphatic.

310. The method of embodiment 308, wherein one R' is optionally substituted C$_{1-6}$ alkyl.

311. The method of embodiment 308, wherein one R' is optionally substituted phenyl.

312. The method of embodiment 308, wherein one R' is phenyl.

313. The method of embodiment 308, wherein one R' is substituted phenyl.

314. The method of any one of embodiments 309-313, wherein the other R' is optionally substituted C$_{1-6}$ aliphatic.

315. The method of any one of embodiments 309-313, wherein the other R' is optionally substituted C$_{1-6}$ alkyl.

316. The method of any one of embodiments 309-313, wherein the other R' is optionally substituted phenyl.

317. The method of any one of embodiments 309-313, wherein the other R' is phenyl.

318. The method of any one of embodiments 309-313, wherein the other R' is substituted phenyl.

319. The method of any one of embodiments 299-318, wherein L' is —C(R')$_2$—.

320. The method of any one of embodiments 299-318, wherein L' is optionally substituted —CH$_2$—.

321. The method of any one of embodiments 299-318, wherein L' is —CH$_2$—.

322. The method of any one of embodiments 272-321, comprising providing one or more additional compounds, wherein each compound is independently a compound of any one of embodiments 272-321.

323. The method of embodiment 322, wherein an additional compound has a different structure than the compound.

324. The method of embodiment 322, wherein in an additional compound, G$^2$ is -L'—Si(R)$_3$, wherein each R is independently not —H.

325. The method of embodiment 322, wherein in an additional compound, G$^2$ is —CH$_2$SiCH$_3$Ph$_2$.

326. The method of any one of embodiments 272-325, comprising one or more cycles, each of which independently comprises or consisting of:

1) deblocking;
2) coupling;
3) optionally a first capping;
4) modifying; and
5) optionally a second capping.

327. A method for preparing an oligonucleotide or a composition thereof, comprising one or more cycles, each of which independently comprises or consisting of:

1) deblocking;
2) coupling;
3) optionally a first capping;
4) modifying; and
5) optionally a second capping.

328. The method of any one of embodiments 326-327, wherein at least one cycle comprises or consists of 1) to 5).

329. The method of any one of embodiments 326-328, wherein the steps are performed sequentially from 1) to 5).

330. The method of any one of embodiments 326-329, wherein the cycles are performed until a desired length of an oligonucleotide is achieved.

331. The method of any one of embodiments 326-330, wherein deblocking removes a protection group on 5'-OH and provides a free 5'-OH.

332. The method of embodiment 331, wherein the protection group is R'—C(O)—.

333. The method of embodiment 331, wherein the protection group is DMTr.

334. The method of any one of embodiments 331-333, comprising contacting the oligonucleotides to be de-blocked with an acid.

335. The method of any one of embodiments 272-334, comprising a coupling that comprises: 1) providing a phosphoramidite; and 2) reacting the phosphoramidite with an oligonucleotide, wherein a P—O bond is formed between the phosphorus of the phosphoramidite and the 5'-OH of the oligonucleotide.

336. The method of any one of embodiments 272-335, comprising a coupling that comprises: 1) providing a phosphoramidite; and 2) reacting the phosphoramidite with an oligonucleotide, wherein a P—O bond is formed between the phosphorus of the phosphoramidite and the 5'-OH of the oligonucleotide, wherein the phosphoramidite is a compound of any one of embodiments 288-321.

337. The method of any one of embodiments 272-336, comprising a coupling that comprises: 1) providing a phosphoramidite; and 2) reacting the phosphoramidite with an oligonucleotide, wherein a P—O bond is formed between the phosphorus of the phosphoramidite and the 5'-OH of the oligonucleotide, wherein the phosphoramidite is a compound of any one of embodiments 288-293, wherein $G^2$ is -L'—Si(R)$_3$, wherein each R is independently not —H.

338. The method of embodiment 337, wherein $G^2$ is —$CH_2SiCH_3Ph_2$.

339. The method of any one of embodiments 336-338, wherein the coupling forms an internucleotidic linkage with a stereoselectivity of 85%, 90%, 91%, 92%, 93%, 94%, 95%, 96%, 97%, 98%, 99% or more.

340. The method of embodiment 339, wherein the internucleotidic linkage formed is an internucleotidic linkage of formula I or a salt form thereof.

341. The method of embodiment 340, wherein —X-L-$R^1$ is

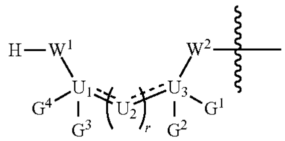,

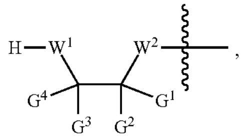, 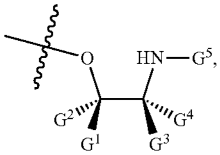,

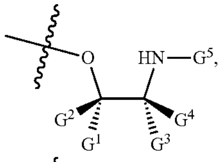, 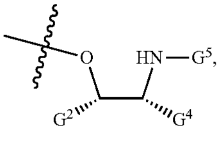,

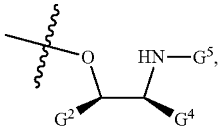, 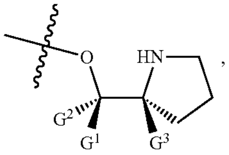,

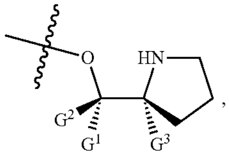, 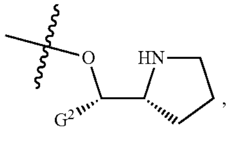, or

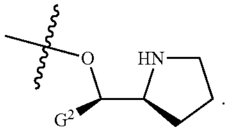.

342. The method of embodiment 340 or 341, wherein $P^L$ is P.

343. The method of any one of embodiments 272-342, comprising a coupling that comprises: 1) providing a phosphoramidite; and 2) reacting the phosphoramidite with an oligonucleotide, wherein a P—O bond is formed between the phosphorus of the phosphoramidite and the 5'-OH of the oligonucleotide, wherein the phosphoramidite is a standard phosphoramidite for oligonucleotide synthesis wherein the phosphorus atom is bonded to a protected nucleoside, —N(i-Pr)$_2$, and 2-cyanoethyl.

344. The method of any one of embodiments 272-343, comprising a first capping comprises: 1) providing an acylating reagent, and 2) contacting an oligonucleotide with the acylating reagent, wherein the first capping caps an amino group of an internucleotidic linkage.

345. The method of any one of embodiments 272-344, comprising a first capping which forms an internucleotidic linkage of formula I or a salt form thereof, wherein —X-L-$R^1$ is

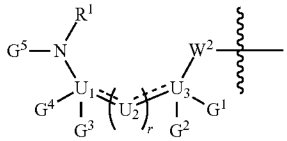,

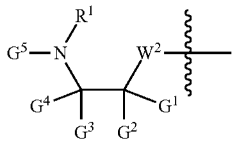, 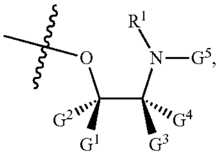,

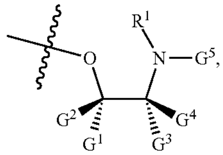, 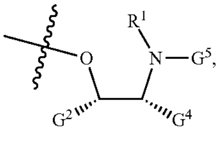,

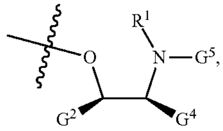, 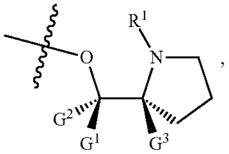,

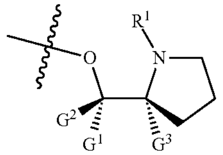, 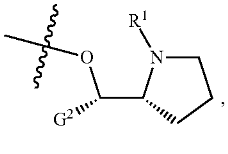, or

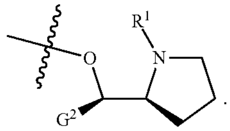.

346. The method of embodiment 345, wherein $P^L$ is P and $R^1$ is —C(O)R.

347. The method of any one of embodiments 272-346, wherein a first capping is performed after each coupling of embodiment 339.

348. The method of any one of embodiments 272-347, comprising a modifying step which is or comprises sulfurization.

349. The method of embodiment 348, wherein the sulfurization installs ═S on a linkage phosphorus.

350. The method of embodiment 348 or 349, wherein the sulfurization forms an internucleotidic linkage of formula I or a salt form thereof, wherein $P^L$ is P(═S).

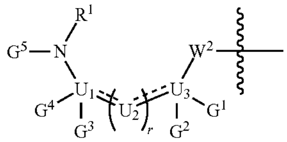,

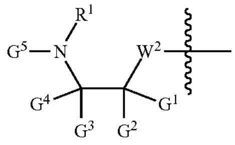, 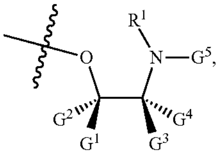,

-continued

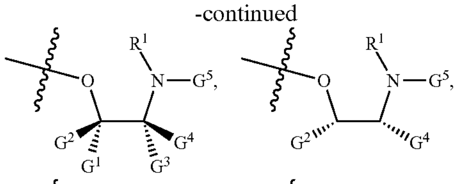

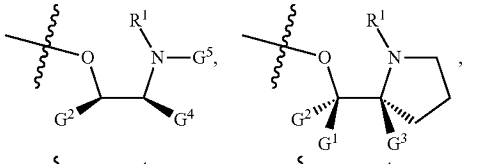

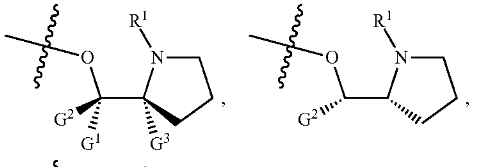

or

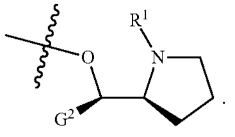

351. The method of embodiment 350, wherein —X-L-$R^1$ is
352. The method of embodiment 351, wherein $R^1$ is —C(O)R.
353. The method of any one of embodiments 272-352, comprising a modifying step which is or comprises oxidation.
354. The method of embodiment 348, wherein the sulfurization installs =O on a linkage phosphorus.
355. The method of any one of embodiments 272-354, comprising a modifying step which installs =N-L-$R^5$ on a linkage phosphorus.
356. The method of any one of embodiments 272-354, comprising a modifying step which converts a linkage phosphorus into

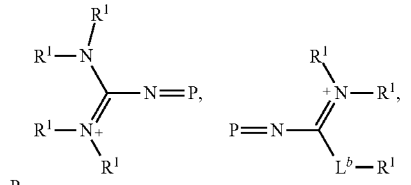

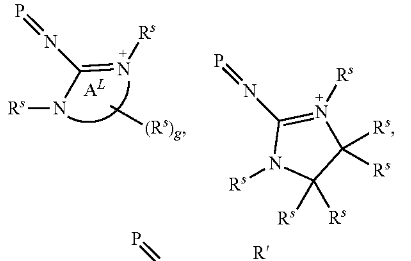

or

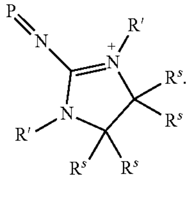

357. The method of any one of embodiments 272-356, comprising a modifying step which comprises contact the oligonucleotide with an azido imidazolinium salt.

358. The method of any one of embodiments 272-356, comprising a modifying step which comprises contact the oligonucleotide with a compound comprising

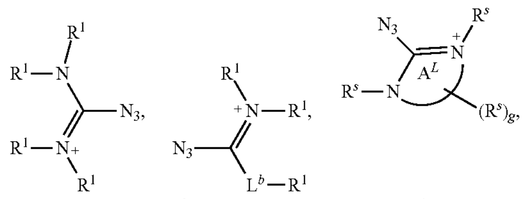

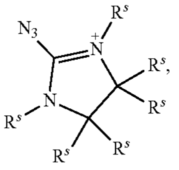

or

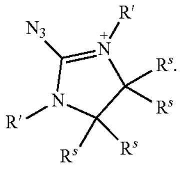

359. The method of any one of embodiments 272-356, comprising a modifying step which comprises contact the oligonucleotide with a compound having the structure of

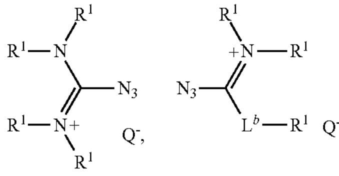

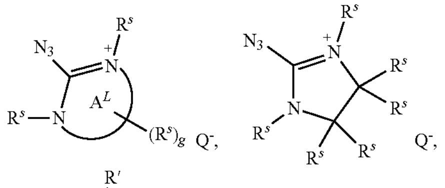

or

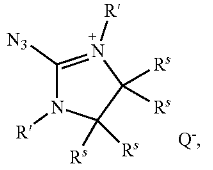

wherein $Q^-$ is an anion.
360. The method of embodiment 359, wherein $Q^-$ is $F^-$, $Cl^-$, $Br^-$, $BF_4^-$, $PF_6^-$, $TfO^-$, $Tf_2N^-$, $AsF_6^-$, $ClO_4^-$, or $SbF_6^-$.
361. The method of embodiment 360, wherein $Q^-$ is $PF_6^-$.
362. The method of any one of embodiments 272-362, wherein a modifying step forms an internucleotidic linkage of formula I or a salt form thereof, wherein $P^L$ is P(=N-L-$R^5$).
363. The method of any one of embodiments 272-362, wherein a modifying step forms an internucleotidic linkage of formula III or a salt form thereof.
364. The method of embodiment 362 or 363, wherein —X-L-$R^1$ is

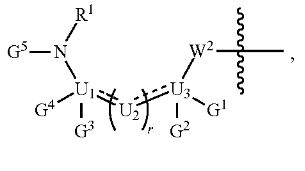

-continued

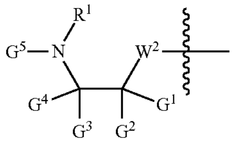,
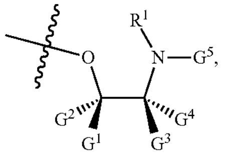
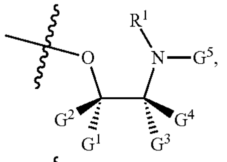
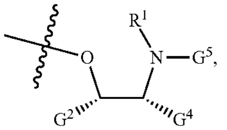
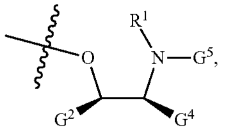
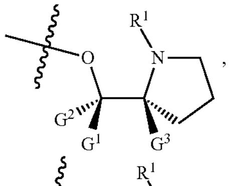,
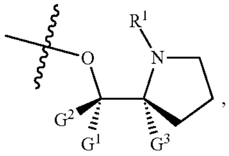,
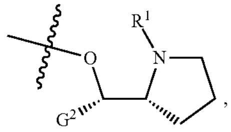, or
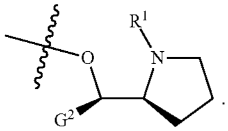.

365. The method of embodiment 364, wherein $R^1$ is —C(O)R.

366. The method of any one of embodiments 272-365, comprising a second capping which caps free 5'-OH.

367. The method of any one of embodiments 272-366, comprising a second capping which caps free 5'-OH, wherein a second capping is performed in each cycle.

368. The method of any one of embodiments 272-366, comprising a second capping which caps free 5'-OH, wherein a second capping is performed in each cycle that is followed by another cycle.

369. The method of any one of embodiments 366-368, wherein a 5'-OH is capped as —OAc.

370. The method of any one of embodiments 272-369, wherein the oligonucleotide is attached to a solid support.

371. The method of embodiment 370, wherein the solid support is CPG.

372. The method of any one of embodiments 370-371, comprising a contact in which the oligonucleotide is contacted with a base.

373. The method of embodiment 372, wherein the contact is performed substantially absent of water.

374. The method of embodiment 372 or 373, wherein the contact is after the oligonucleotide length is achieved before deprotection and cleavage of oligonucleotide.

375. The method of any one of embodiments 372-374, wherein the base is an amine base having the structure of $NR_3$.

376. The method of embodiment 375, wherein the base is triethylamine.

377. The method of embodiment 375, wherein the base is N, N-diethylamine.

378. The method of any one of embodiments 372-377, wherein the contact removes a chiral auxiliary.

379. The method of any one of embodiments 372-378, wherein the contact removes a —X-L-$R^1$ group.

380. The method of embodiment 379, wherein —X-L-$R^1$ is

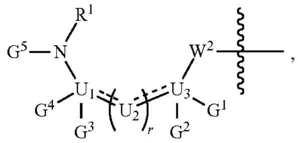,
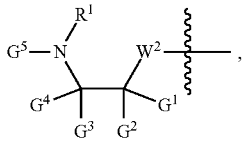,
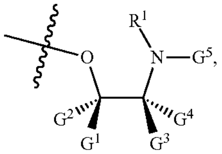
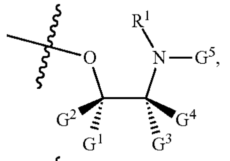
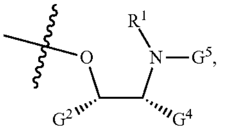
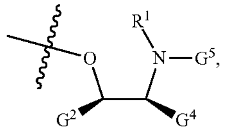
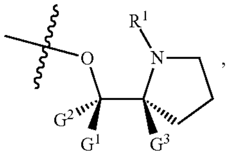,
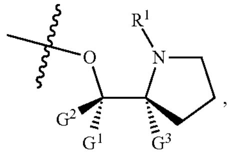,
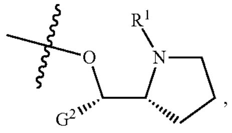, or
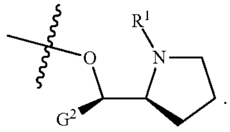.

381. The method of any one of embodiments 372-380, wherein the contact forms an internucleotidic linkage of formula I-n-1, I-n-2, I-n-3, I-n-4, II, II-a-1, II-a-2, II-b-1, II-b-2, II-c-1, II-c-2, II-d-1, or II-d-2, wherein $P^L$ is P(O).

382. The method of any one of embodiments 364-381, wherein $G^2$ comprises an electron-withdrawing group.

383. The method of any one of embodiments 364-382, wherein $G^2$ is methyl substituted with one or more electron-withdrawing groups.

384. The method of any one of embodiments 382-383, wherein an electron-withdrawing group is —CN, —$NO_2$, halogen, —C(O)$R^1$, —C(O)OR', —C(O)N(R')$_2$, S(O)$R^1$, —S(O)$_2R^1$, —P(W)($R^1$)$_2$, —P(O)($R^1$)$_2$, —P(O)(OR')$_2$, or —P(S)($R^1$)$_2$, or aryl or heteroaryl substituted with one or more of —CN, —$NO_2$, halogen, —C(O)$R^1$, —C(O)OR', —C(O)N(R')$_2$, —S(O)$R^1$, —S(O)$_2R^1$, —P(W)($R^1$)$_2$, —P(O)($R^1$)$_2$, —P(O)(OR')$_2$, or —P(S)($R^1$)$_2$.

385. The method of any one of embodiments 382-383, wherein an electron-withdrawing group is —CN, —$NO_2$, halogen, —C(O)$R^1$, —C(O)OR', —C(O)N(R')$_2$, —S(O)$R^1$, —S(O)$_2R^1$, —P(W)($R^1$)$_2$, —P(O)($R^1$)$_2$, —P(O)(OR')$_2$, or —P(S)($R^1$)$_2$, or phenyl substituted with one or more of —CN, —$NO_2$, halogen, —C(O)$R^1$, —C(O)OR', —C(O)N(R')$_2$, —S(O)$R^1$, —S(O)$_2R^1$, —P(W)($R^1$)$_2$, —P(O)($R^1$)$_2$, —P(O)(OR')$_2$, or —P(S)($R^1$)$_2$.

386. The method of any one of embodiments 382-383, wherein an electron-withdrawing group is —CN, —$NO_2$, halogen, —C(O)$R^1$, —C(O)OR', —C(O)N(R')$_2$, —S(O)$R^1$, —S(O)$_2R^1$, —P(W)($R^1$)$_2$, —P(O)($R^1$)$_2$, —P(O)(OR')$_2$, or —P(S)($R^1$)$_2$.

387. The method of any one of embodiments 364-386, wherein $G^2$ is -L'-L"-R', wherein L' is —$C(R)_2$— or optionally substituted —$CH_2$—, and L" is a covalent bond, —P(O)(R')—, —P(O)(R')O—, —P(O)(OR')—, —P(O)(OR')O—, —P(O)[N(R')]—, —P(O)[N(R')]O—, —P(O)[N(R')][N(R')]—, —P(S)(R')—, —$S(O)_2$—, —$S(O)_2$—, —$S(O)_2O$—, —S(O)—, —C(O)—, or —C(O)N(R')—.

388. The method of any one of embodiments 364-386, wherein $G^2$ is -L'-L"-R', wherein L' is —$C(R)_2$— or optionally substituted —$CH_2$—, and L" is —P(O)(R')—, —P(O)(R')O—, —P(O)(OR')—, —P(O)(OR')O—, —P(O)[N(R')]—, —P(O)[N(R')]O—, —P(O)[N(R')][N(R')]—, —P(S)(R')—, —$S(O)_2$—, —$S(O)_2$—, —$S(O)_2O$—, —S(O)—, —C(O)—, or —C(O)N(R')—.

389. The method of any one of embodiments 364-388, wherein $G^2$ is -L'—$S(O)_2R'$.

390. The method of embodiment 389, wherein R' is optionally substituted $C_{1-6}$ aliphatic.

391. The method of embodiment 389, wherein R' is optionally substituted $C_{1-6}$ alkyl.

392. The method of embodiment 389, wherein R' is methyl, isopropyl or t-butyl.

393. The method of embodiment 389, wherein R' is optionally substituted phenyl.

394. The method of embodiment 389, wherein R' is phenyl.

395. The method of embodiment 389, wherein R' is substituted phenyl.

396. The method of any one of embodiments 364-388, wherein $G^2$ is -L'-P(O)$(R')_2$.

397. The method of embodiment 396, wherein one R' is optionally substituted $C_{1-6}$ aliphatic.

398. The method of embodiment 396, wherein one R' is optionally substituted $C_{1-6}$ alkyl.

399. The method of embodiment 396, wherein one R' is optionally substituted phenyl.

400. The method of embodiment 396, wherein one R' is phenyl.

401. The method of embodiment 396, wherein one R' is substituted phenyl.

402. The method of any one of embodiments 397-401, wherein the other R' is optionally substituted $C_{1-6}$ aliphatic.

403. The method of any one of embodiments 397-401, wherein the other R' is optionally substituted $C_{1-6}$ alkyl.

404. The method of any one of embodiments 309-313, wherein the other R' is optionally substituted phenyl.

405. The method of any one of embodiments 309-313, wherein the other R' is phenyl.

406. The method of any one of embodiments 309-313, wherein the other R' is substituted phenyl.

407. The method of any one of embodiments 387-406, wherein L' is —$C(R')_2$—.

408 The method of any one of embodiments 387-406, wherein L' is optionally substituted —$CH_2$—.

409. The method of any one of embodiments 387-406, wherein L' is —$CH_2$—.

410. The method of any one of embodiments 372-409, wherein the contact removes 2'-cyanoethyl.

411. The method of any one of embodiments 372-410, wherein the contact forms a natural phosphate linkage or a salt form thereof.

412. The method of any one of embodiments 272-410, comprising removing of another chiral auxiliary or group that having a different structure than that of any one of embodiments 378-410.

413. The method of any one of embodiments 272-410, comprising removing of

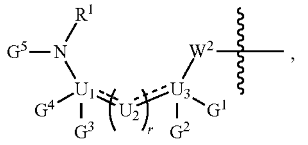

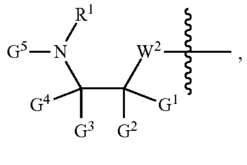

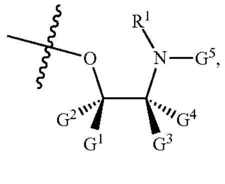

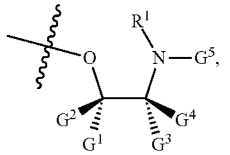

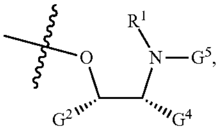

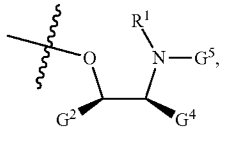

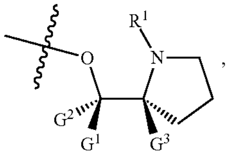

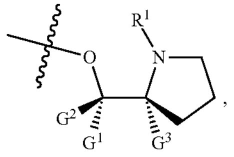

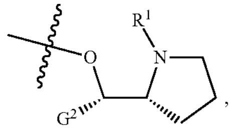

or

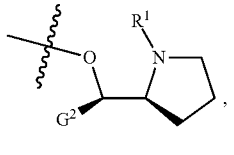

wherein $G^2$ is -L'-$Si(R)_3$, wherein each R is independently not —H.

414. The method of embodiment 413, wherein $G^2$ is —$CH_2SiCH_3Ph_2$.

415. The method of any one of embodiments 412-414, comprising contacting an oligonucleotide with a fluoride.

416. The method of any one of embodiments 412-414, comprising contacting an oligonucleotide with a solution comprising TEA-HF and a base.

417. The method of any one of embodiments 272-416, comprising cleaving oligonucleotide from a solid support.

418. The method of any one of embodiments 272-417, wherein the oligonucleotide or a composition thereof is an oligonucleotide or composition of any one of embodiments 1-254.

419. The compound of any one of embodiments 272-321, or a related diastereomer or enantiomer.

420. An oligonucleotide, wherein the oligonucleotide is, WV-20104, WV-20103, WV-20102, WV-20101, WV-20100, WV-20099, WV-20098, WV-20097, WV-20096, WV-20095, WV-20094, WV-20106, WV-20119, WV-20118, WV-13739, WV-13740, WV-9079, WV-9082, WV-9100, WV-9096, WV-9097, WV-9106, WV-9133, WV-9148, WV-9154, WV-9898, WV-9899, WV-9900, WV-9906, WV-9907, WV-9908, WV-9909, WV-9756, WV-9757, WV-9517, WV-9714, WV-9715, WV-9519, WV-9521, WV-9747, WV-9748, WV-9749, WV-9897, WV-9898, WV-9900, WV-9899, WV-9906, WV-9912, WV-9524, WV-9912, WV-9906, WV-9900, WV-9899, WV-9899, WV-9898, WV-9898, WV-9898, WV-9898, WV-9898, WV-9897, WV-9897, WV-9897, WV-9897, WV-9897, WV-9747, WV-9714, WV-9699, WV-9517, WV-9517, WV-13409, WV-13408, WV-12887, WV-12882, WV-12881, WV-12880, WV-12880, WV-WV12880, WV-12878, WV-12877, WV-12877, WV-12876, WV-12873, WV-12872, WV-12559, WV-12559, WV-12558, WV-12558, WV-12557, WV-12556, WV-12556, WV-12555, WV-12555, WV-12554, WV-12553, WV-12129, WV-12127, WV-12125, WV-12123, WV-11342, WV-11342, WV-11341, WV-11341, WV-11340, WV-10672, WV-10671, WV-10670, WV-10461, WV-10455, WV-9897, WV-9898, WV-13826, WV-13827, WV-13835, WV-12880, WV-14344, WV-13864, WV-13835, WV-14791, WV-14344, WV-13754, WV-13766, WV-11086, WV-11089, WV-17859, WV-17860, WV-20070, WV-20073, WV-20076, WV-20052, WV-20099, WV-20049, WV-20085, WV-20087, WV-20034, WV-20046, WV-20052, WV-20061, WV-20064, WV-20067, WV-20092, WV-20091, WV-20093, WV-20084, WV-9738, WV-9739, WV-9740, WV-9741, WV-15860, WV-15862, WV-11084, WV-11086, WV-11088, WV-11089, WV-14522, WV-14523, WV-17861, WV-17862, WV-13815, WV-13816, WV-13817, WV-13780, WV-17862, WV-17863, WV-17864, WV-17865, WV-17866, WV-20082, WV-20081, WV-20080, WV-20079, WV-20076, WV-20075, WV-20074, WV-20073, WV-20072, WV-20071, WV-20064, WV-20059, WV-20058, WV-20057, WV-20056, WV-20053, WV-20052, WV-20051, WV-20050, WV-20049, WV-20094, WV-20095, or a salt form thereof.

EQUIVALENTS

Having described some illustrative embodiments of the disclosure, it should be apparent to those skilled in the art that the foregoing is merely illustrative and not limiting, having been presented by way of example only. Numerous modifications and other illustrative embodiments are within the scope of one of ordinary skill in the art and are contemplated as falling within the scope of the disclosure. In particular, although many of the examples presented herein involve specific combinations of method acts or system elements, it should be understood that those acts and those elements may be combined in other ways to accomplish the same objectives. Acts, elements, and features discussed only in connection with one embodiment are not intended to be excluded from a similar role in other embodiments. Further, for the one or more means-plus-function limitations, if any, recited in the following claims, the means are not intended to be limited to the means disclosed herein for performing the recited function, but are intended to cover in scope any means, known now or later developed, for performing the recited function.

Use of ordinal terms such as “first”, “second”, “third”, etc., in the claims to modify a claim element does not by itself connote any priority, precedence, or order of one claim element over another or the temporal order in which acts of a method are performed, but are used merely as labels to distinguish one claim element having a certain name from another element having a same name (but for use of the ordinal term) to distinguish the claim elements. Similarly, use of a), b), etc., or i), ii), etc. does not by itself connote any priority, precedence, or order of steps in the claims. Similarly, the use of these terms in the specification does not by itself connote any required priority, precedence, or order.

The foregoing written specification is considered to be sufficient to enable one skilled in the art to practice the invention. The present disclosure is not to be limited in scope by examples provided. Examples are intended as illustration of one or more aspect of an invention and other functionally equivalent embodiments are within the scope of the invention. Various modifications in addition to those shown and described herein will become apparent to those skilled in the art from the foregoing description and fall within the scope of the appended claims. Advantages and objects of the invention are not necessarily encompassed by each embodiment of the invention.

---

SEQUENCE LISTING (3280 sequences)

SEQ ID NO: 1 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (11)..(11): t or u
  modified_base (16)..(18): t or u
  modified_base (20)..(20): t or u
ncaaggaaganggcannncn

SEQ ID NO: 2 - DNA, 19 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (11)..(11): t or u
  modified_base (16)..(18): t or u
ncaaggaaganggcannnc

SEQ ID NO: 3 - DNA, 18 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (11)..(11): t or u
  modified_base (16)..(18): t or u
ncaaggaaganggcannn

SEQ ID NO: 4 - DNA, 17 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (11)..(11): t or u
  modified_base (16)..(17): t or u
ncaaggaaganggcann

SEQ ID NO: 5 - DNA, 16 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (11)..(11): t or u
  modified_base (16)..(16): t or u
ncaaggaaganggcan

SEQ ID NO: 6 - DNA, 15 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (11)..(11): t or u
ncaaggaaganggca

SEQ ID NO: 7 - DNA, 19 bp, Artificial Sequence
  Description of Artificial Sequence: Synthetic oligonucleotide
  Description of Combined DNA/RNA Molecule: Synthetic oligonucleotide
  modified_base (10)..(10): t or u
  modified_base (15)..(17): t or u
  modified_base (19)..(19): t or u
caaggaaganggcannncn

SEQ ID NO: 8 - DNA, 18 bp, Artificial Sequence
  Description of Artificial Sequence: Synthetic oligonucleotide
  Description of Combined DNA/RNA Molecule: Synthetic oligonucleotide
  modified_base (9)..(9): t or u
  modified_base (14)..(16): t or u
  modified_base (18)..(18): t or u
aaggaaganggcannncn

SEQ ID NO: 9 - DNA, 17 bp, Artificial Sequence
  Description of Artificial Sequence: Synthetic oligonucleotide
  Description of Combined DNA/RNA Molecule: Synthetic oligonucleotide
  modified_base (8)..(8): t or u
  modified_base (13)..(15): t or u
  modified_base (17)..(17): t or u
aggaaganggcannncn

SEQ ID NO: 10 - DNA, 16 bp, Artificial Sequence
  Description of Artificial Sequence: Synthetic oligonucleotide
  Description of Combined DNA/RNA Molecule: Synthetic oligonucleotide
  modified_base (7)..(7): t or u
  modified_base (12)..(14): t or u
  modified_base (16)..(16): t or u
ggaaganggcannncn

SEQ ID NO: 11 - DNA, 15 bp, Artificial Sequence
  Description of Artificial Sequence: Synthetic oligonucleotide
  Description of Combined DNA/RNA Molecule: Synthetic oligonucleotide
  modified_base (6)..(6): t or u
  modified_base (11)..(13): t or u
  modified_base (15)..(15): t or u
gaaganggcannncn

SEQ ID NO: 12 - DNA, 18 bp, Artificial Sequence
  Description of Artificial Sequence: Synthetic oligonucleotide
  Description of Combined DNA/RNA Molecule: Synthetic oligonucleotide
  modified_base (10)..(10): t or u
  modified_base (15)..(17): t or u
caaggaaganggcannnc

SEQ ID NO: 13 - DNA, 17 bp, Artificial Sequence
  Description of Artificial Sequence: Synthetic oligonucleotide
  Description of Combined DNA/RNA Molecule: Synthetic oligonucleotide
  modified_base (10)..(10): t or u
  modified_base (15)..(17): t or u
caaggaaganggcannn

SEQ ID NO: 14 - DNA, 17 bp, Artificial Sequence
  Description of Artificial Sequence: Synthetic oligonucleotide
  Description of Combined DNA/RNA Molecule: Synthetic oligonucleotide
  modified_base (9)..(9): t or u
  modified_base (14)..(16): t or u
aaggaaganggcannnc

SEQ ID NO: 15 - DNA, 16 bp, Artificial Sequence
  Description of Artificial Sequence: Synthetic oligonucleotide
  Description of Combined DNA/RNA Molecule: Synthetic oligonucleotide
  modified_base (9)..(9): t or u
  modified_base (14)..(16): t or u
aaggaaganggcannn

SEQ ID NO: 16 - DNA, 15 bp, Artificial Sequence
  Description of Artificial Sequence: Synthetic oligonucleotide
  Description of Combined DNA/RNA Molecule: Synthetic oligonucleotide
  modified_base (8)..(8): t or u
  modified_base (13)..(15): t or u
aggaaganggcannn

SEQ ID NO: 17 - DNA, 15 bp, Artificial Sequence
  Description of Artificial Sequence: Synthetic oligonucleotide
  Description of Combined DNA/RNA Molecule: Synthetic oligonucleotide
  modified_base (9)..(9): t or u
  modified_base (14)..(15): t or u
aaggaaganggcann

SEQ ID NO: 18 - DNA, 20 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
  modified_base (16)..(16): t or u
  modified_base (18)..(19): t or u
cnccggnncngaaggngnnc

SEQ ID NO: 19 - DNA, 21 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
  modified_base (16)..(16): t or u
  modified_base (18)..(19): t or u
cnccggnncngaaggngnncc

SEQ ID NO: 20 - DNA, 19 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (6)..(7): t or u
  modified_base (9)..(9): t or u
  modified_base (15)..(15): t or u
  modified_base (17)..(18): t or u
nccggnncngaaggngnnc

SEQ ID NO: 21 - DNA, 18 bp, Artificial Sequence
  Description of Artificial Sequence: Synthetic oligonucleotide
  Description of Combined DNA/RNA Molecule: Synthetic oligonucleotide
  modified_base (5)..(6): t or u
  modified_base (8)..(8): t or u
  modified_base (14)..(14): t or u
  modified_base (16)..(17): t or u
ccggnncngaaggngnnc

SEQ ID NO: 22 - DNA, 17 bp, Artificial Sequence
  Description of Artificial Sequence: Synthetic oligonucleotide
  Description of Combined DNA/RNA Molecule: Synthetic oligonucleotide
  modified_base (4)..(5): t or u
  modified_base (7)..(7): t or u
  modified_base (13)..(13): t or u
  modified_base (15)..(16): t or u
cggnncngaaggngnnc

SEQ ID NO: 23 - DNA, 16 bp, Artificial Sequence
  Description of Artificial Sequence: Synthetic oligonucleotide
  Description of Combined DNA/RNA Molecule: Synthetic oligonucleotide
  modified_base (3)..(4): t or u
  modified_base (6)..(6): t or u
  modified_base (12)..(12): t or u
  modified_base (14)..(15): t or u
ggnncngaaggngnnc

SEQ ID NO: 24 - DNA, 15 bp, Artificial Sequence
  Description of Artificial Sequence: Synthetic oligonucleotide
  Description of Combined DNA/RNA Molecule: Synthetic oligonucleotide
  modified_base (2)..(3): t or u
  modified_base (5)..(5): t or u
  modified_base (11)..(11): t or u
  modified_base (13)..(14): t or u
gnncngaaggngnnc

SEQ ID NO: 25 - DNA, 19 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
  modified_base (16)..(16): t or u
  modified_base (18)..(19): t or u
cnccggnncngaaggngnn

SEQ ID NO: 26 - DNA, 18 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
  modified_base (16)..(16): t or u
  modified_base (18)..(18): t or u
cnccggnncngaaggngn

SEQ ID NO: 27 - DNA, 17 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
  modified_base (16)..(16): t or u
cnccggnncngaaggng

SEQ ID NO: 28 - DNA, 16 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
  modified_base (16)..(16): t or u
cnccggnncngaaggn

SEQ ID NO: 29 - DNA, 15 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
cnccggnncngaagg

SEQ ID NO: 30 - DNA, 18 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (6)..(7): t or u
  modified_base (9)..(9): t or u
  modified_base (15)..(15): t or u
  modified_base (17)..(18): t or u
nccggnncngaaggngnn

SEQ ID NO: 31 - DNA, 17 bp, Artificial Sequence
  Description of Artificial Sequence: Synthetic oligonucleotide
  Description of Combined DNA/RNA Molecule: Synthetic oligonucleotide
  modified_base (5)..(6): t or u
  modified_base (8)..(8): t or u
  modified_base (14)..(14): t or u
  modified_base (16)..(17): t or u
ccggnncngaaggngnn

SEQ ID NO: 32 - DNA, 17 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (6)..(7): t or u
  modified_base (9)..(9): t or u
  modified_base (15)..(15): t or u
  modified_base (17)..(17): t or u
nccggnncngaaggngn

SEQ ID NO: 33 - DNA, 16 bp, Artificial Sequence
  Description of Artificial Sequence: Synthetic oligonucleotide
  Description of Combined DNA/RNA Molecule: Synthetic oligonucleotide
  modified_base (5)..(6): t or u
  modified_base (8)..(8): t or u
  modified_base (14)..(14): t or u
  modified_base (16)..(16): t or u
ccggnncngaaggngn

SEQ ID NO: 34 - DNA, 16 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (6)..(7): t or u
  modified_base (9)..(9): t or u
  modified_base (15)..(15): t or u
nccggnncngaaggng

SEQ ID NO: 35 - DNA, 15 bp, Artificial Sequence
  Description of Artificial Sequence: Synthetic oligonucleotide
  Description of Combined DNA/RNA Molecule: Synthetic oligonucleotide
  modified_base (4)..(5): t or u
  modified_base (7)..(7): t or u
  modified_base (13)..(13): t or u
  modified_base (15)..(15): t or u
cggnncngaaggngn

SEQ ID NO: 36 - DNA, 15 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (6)..(7): t or u
  modified_base (9)..(9): t or u
  modified_base (15)..(15): t or u
nccggnncngaaggn

SEQ ID NO: 37 - DNA, 15 bp, Artificial Sequence
  Description of Artificial Sequence: Synthetic oligonucleotide
  Description of Combined DNA/RNA Molecule: Synthetic oligonucleotide
  modified_base (5)..(6): t or u
  modified_base (8)..(8): t or u
  modified_base (14)..(14): t or u
ccggnncngaaggng

SEQ ID NO: 38 - DNA, 16 bp, Artificial Sequence
  Description of Artificial Sequence: Synthetic oligonucleotide
  Description of Combined DNA/RNA Molecule: Synthetic oligonucleotide
  modified_base (4)..(5): t or u
  modified_base (7)..(7): t or u
  modified_base (13)..(13): t or u
  modified_base (15)..(16): t or u
cggnncngaaggngnn

SEQ ID NO: 39 - DNA, 15 bp, Artificial Sequence
  Description of Artificial Sequence: Synthetic oligonucleotide
  Description of Combined DNA/RNA Molecule: Synthetic oligonucleotide
  modified_base (3)..(4): t or u
  modified_base (6)..(6): t or u
  modified_base (12)..(12): t or u
  modified_base (14)..(15): t or u
ggnncngaaggngnn

SEQ ID NO: 40 - DNA, 20 bp, Artificial Sequence
  Description of Artificial Sequence: Synthetic oligonucleotide
  Description of Combined DNA/RNA Molecule: Synthetic oligonucleotide
  modified_base (1)..(2): t or u
  modified_base (4)..(4): t or u
  modified_base (10)..(10): t or u
  modified_base (12)..(13): t or u
  modified_base (15)..(16): t or u
  modified_base (18)..(18): t or u
nncngaaggngnncnngnac

SEQ ID NO: 41 - DNA, 19 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (3)..(3): t or u
  modified_base (9)..(9): t or u
  modified_base (11)..(12): t or u
  modified_base (14)..(15): t or u
  modified_base (17)..(17): t or u
ncngaaggngnncnngnac

SEQ ID NO: 42 - DNA, 18 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (8)..(8): t or u
  modified_base (10)..(11): t or u
  modified_base (13)..(14): t or u
  modified_base (16)..(16): t or u
cngaaggngnncnngnac

SEQ ID NO: 43 - DNA, 17 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (7)..(7): t or u
  modified_base (9)..(10): t or u
  modified_base (12)..(13): t or u
  modified_base (15)..(15): t or u
ngaaggngnncnngnac

SEQ ID NO: 44 - DNA, 16 bp, Artificial Sequence
  Description of Artificial Sequence: Synthetic oligonucleotide
  Description of Combined DNA/RNA Molecule: Synthetic oligonucleotide
  modified_base (6)..(6): t or u
  modified_base (8)..(9): t or u
  modified_base (11)..(12): t or u
  modified_base (14)..(14): t or u
gaaggngnncnngnac

SEQ ID NO: 45 - DNA, 15 bp, Artificial Sequence
  Description of Artificial Sequence: Synthetic oligonucleotide
  Description of Combined DNA/RNA Molecule: Synthetic oligonucleotide
  modified_base (5)..(5): t or u
  modified_base (7)..(8): t or u
  modified_base (10)..(11): t or u
  modified_base (13)..(13): t or u
aaggngnncnngnac

SEQ ID NO: 46 - DNA, 19 bp, Artificial Sequence
  Description of Artificial Sequence: Synthetic oligonucleotide
  Description of Combined DNA/RNA Molecule: Synthetic oligonucleotide
  modified_base (1)..(2): t or u
  modified_base (4)..(4): t or u
  modified_base (10)..(10): t or u
  modified_base (12)..(13): t or u
  modified_base (15)..(16): t or u
  modified_base (18)..(18): t or u
nncngaaggngnncnngna

SEQ ID NO: 47 - DNA, 18 bp, Artificial Sequence
  Description of Artificial Sequence: Synthetic oligonucleotide
  Description of Combined DNA/RNA Molecule: Synthetic oligonucleotide
  modified_base (1)..(2): t or u
  modified_base (4)..(4): t or u
  modified_base (10)..(10): t or u
  modified_base (12)..(13): t or u
  modified_base (15)..(16): t or u
  modified_base (18)..(18): t or u
nncngaaggngnncnngn

SEQ ID NO: 48 - DNA, 17 bp, Artificial Sequence
  Description of Artificial Sequence: Synthetic oligonucleotide
  Description of Combined DNA/RNA Molecule: Synthetic oligonucleotide
  modified_base (1)..(2): t or u
  modified_base (4)..(4): t or u
  modified_base (10)..(10): t or u
  modified_base (12)..(13): t or u
  modified_base (15)..(16): t or u
nncngaaggngnncnng

SEQ ID NO: 49 - DNA, 16 bp, Artificial Sequence
  Description of Artificial Sequence: Synthetic oligonucleotide
  Description of Combined DNA/RNA Molecule: Synthetic oligonucleotide
  modified_base (1)..(2): t or u
  modified_base (4)..(4): t or u
  modified_base (10)..(10): t or u
  modified_base (12)..(13): t or u
  modified_base (15)..(16): t or u
nncngaaggngnncnn

SEQ ID NO: 50 - DNA, 15 bp, Artificial Sequence
  Description of Artificial Sequence: Synthetic oligonucleotide
  Description of Combined DNA/RNA Molecule: Synthetic oligonucleotide
  modified_base (1)..(2): t or u
  modified_base (4)..(4): t or u
  modified_base (10)..(10): t or u
  modified_base (12)..(13): t or u
  modified_base (15)..(15): t or u
nncngaaggngnncn

SEQ ID NO: 51 - DNA, 18 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (3)..(3): t or u
  modified_base (9)..(9): t or u
  modified_base (11)..(12): t or u
  modified_base (14)..(15): t or u
  modified_base (17)..(17): t or u
ncngaaggngnncnngna

SEQ ID NO: 52 - DNA, 17 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (3)..(3): t or u
  modified_base (9)..(9): t or u
  modified_base (11)..(12): t or u
  modified_base (14)..(15): t or u
  modified_base (17)..(17): t or u
ncngaaggngnncnngn

SEQ ID NO: 53 - DNA, 16 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (3)..(3): t or u
  modified_base (9)..(9): t or u
  modified_base (11)..(12): t or u
  modified_base (14)..(15): t or u
ncngaaggngnncnng

SEQ ID NO: 54 - DNA, 15 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (3)..(3): t or u
  modified_base (9)..(9): t or u
  modified_base (11)..(12): t or u
  modified_base (14)..(15): t or u
ncngaaggngnncnn

SEQ ID NO: 55 - DNA, 17 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (8)..(8): t or u
  modified_base (10)..(11): t or u
  modified_base (13)..(14): t or u
  modified_base (16)..(16): t or u
cngaaggngnncnngna

SEQ ID NO: 56 - DNA, 16 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (8)..(8): t or u
  modified_base (10)..(11): t or u
  modified_base (13)..(14): t or u
  modified_base (16)..(16): t or u
cngaaggngnncnngn

SEQ ID NO: 57 - DNA, 15 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (8)..(8): t or u
  modified_base (10)..(11): t or u
  modified_base (13)..(14): t or u
cngaaggngnncnng

SEQ ID NO: 58 - DNA, 15 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (7)..(7): t or u
  modified_base (9)..(10): t or u
  modified_base (12)..(13): t or u
  modified_base (15)..(15): t or u
ngaaggngnncnngn

SEQ ID NO: 59 - DNA, 16 bp, Artificial Sequence
  Description of Artificial Sequence: Synthetic oligonucleotide
  Description of Combined DNA/RNA Molecule: Synthetic oligonucleotide
  modified_base (1)..(1): t or u
  modified_base (7)..(7): t or u
  modified_base (9)..(10): t or u
  modified_base (12)..(13): t or u
  modified_base (15)..(15): t or u
ngaaggngnncnngna

SEQ ID NO: 60 - DNA, 20 bp, Artificial Sequence
  Description of Artificial Sequence: Synthetic oligonucleotide
gcctcagtctgcttcgcacc

SEQ ID NO: 61 - RNA, 20 nt, Artificial Sequence
  Description of Artificial Sequence: Synthetic oligonucleotide
ucaaggaagauggcauuucu

SEQ ID NO: 62 - DNA, 20 bp, Artificial Sequence
  Description of Artificial Sequence: Synthetic oligonucleotide
ggccaaacctcggcttacct

SEQ ID NO: 63 - RNA, 20 nt, Artificial Sequence
  Description of Artificial Sequence: Synthetic oligonucleotide
ggccaaaccucggcuuaccu

SEQ ID NO: 64 - DNA, 20 bp, Artificial Sequence
  Description of Artificial Sequence: Synthetic oligonucleotide
ggccaaacctcggcttacct

SEQ ID NO: 65 - DNA, 20 bp, Artificial Sequence
  Description of Artificial Sequence: Synthetic oligonucleotide
ggccaaacctcggcttacct

SEQ ID NO: 66 - DNA, 20 bp, Artificial Sequence
  Description of Artificial Sequence: Synthetic oligonucleotide
  Description of Combined DNA/RNA Molecule: Synthetic oligonucleotide
ggccaaaccucggcttacct

SEQ ID NO: 67 - DNA, 20 bp, Artificial Sequence
  Description of Artificial Sequence: Synthetic oligonucleotide
  Description of Combined DNA/RNA Molecule: Synthetic oligonucleotide
ggccaaacctcggcttaccu

SEQ ID NO: 68 - DNA, 20 bp, Artificial Sequence
  Description of Artificial Sequence: Synthetic oligonucleotide
  Description of Combined DNA/RNA Molecule: Synthetic oligonucleotide
ggccaaaccucggctuaccu

SEQ ID NO: 69 - DNA, 20 bp, Artificial Sequence
  Description of Artificial Sequence: Synthetic oligonucleotide
  Description of Combined DNA/RNA Molecule: Synthetic oligonucleotide
ggccaaacctcggcutaccu

SEQ ID NO: 70 - DNA, 20 bp, Artificial Sequence
  Description of Artificial Sequence: Synthetic oligonucleotide
  Description of Combined DNA/RNA Molecule: Synthetic oligonucleotide
ggccaaacctcggctuaccu

SEQ ID NO: 71 - RNA, 20 nt, Artificial Sequence
  Description of Artificial Sequence: Synthetic oligonucleotide
ggccaaaccucggcuuaccu

SEQ ID NO: 72 - DNA, 20 bp, Artificial Sequence
  Description of Artificial Sequence: Synthetic oligonucleotide
  Description of Combined DNA/RNA Molecule: Synthetic oligonucleotide
ggccaaacctcggcutaccu

SEQ ID NO: 73 - DNA, 20 bp, Artificial Sequence
  Description of Artificial Sequence: Synthetic oligonucleotide
  Description of Combined DNA/RNA Molecule: Synthetic oligonucleotide
ggccaaacctcggctuaccu

SEQ ID NO: 74 - DNA, 20 bp, Artificial Sequence
  Description of Artificial Sequence: Synthetic oligonucleotide
  Description of Combined DNA/RNA Molecule: Synthetic oligonucleotide
ggccaaaccucggcttaccu

SEQ ID NO: 75 - DNA, 20 bp, Artificial Sequence
  Description of Artificial Sequence: Synthetic oligonucleotide
  Description of Combined DNA/RNA Molecule: Synthetic oligonucleotide
ggccaaaccucggcutaccu

SEQ ID NO: 76 - DNA, 20 bp, Artificial Sequence
  Description of Artificial Sequence: Synthetic oligonucleotide
tcaaggaagatggcatttct

SEQ ID NO: 77 - RNA, 20 nt, Artificial Sequence
  Description of Artificial Sequence: Synthetic oligonucleotide
ucaaggaagauggcauuucu

SEQ ID NO: 78 - DNA, 20 bp, Artificial Sequence
  Description of Artificial Sequence: Synthetic oligonucleotide
tcaaggaagatggcatttct

SEQ ID NO: 79 - DNA, 20 bp, Artificial Sequence
  Description of Artificial Sequence: Synthetic oligonucleotide
tcaaggaagatggcatttct

SEQ ID NO: 80 - DNA, 20 bp, Artificial Sequence
  Description of Artificial Sequence: Synthetic oligonucleotide
  Description of Combined DNA/RNA Molecule: Synthetic oligonucleotide
tcaaggaagauggcatttct

SEQ ID NO: 81 - DNA, 20 bp, Artificial Sequence
  Description of Artificial Sequence: Synthetic oligonucleotide
  Description of Combined DNA/RNA Molecule: Synthetic oligonucleotide
ucaaggaagatggcatuucu

SEQ ID NO: 82 - DNA, 20 bp, Artificial Sequence
  Description of Artificial Sequence: Synthetic oligonucleotide
  Description of Combined DNA/RNA Molecule: Synthetic oligonucleotide
tcaaggaagatggcautucu

SEQ ID NO: 83 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatutcu

SEQ ID NO: 84 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauutcu

SEQ ID NO: 85 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauttcu

SEQ ID NO: 86 - DNA, 20 bp, Artificial Sequence
  Description of Artificial Sequence: Synthetic oligonucleotide
  Description of Combined DNA/RNA Molecule: Synthetic oligonucleotide
tcaaggaagatggcatttcu

SEQ ID NO: 87 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauttcu

SEQ ID NO: 88 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatttcu

SEQ ID NO: 89 - DNA, 20 bp, Artificial Sequence
  Description of Artificial Sequence: Synthetic oligonucleotide
  Description of Combined DNA/RNA Molecule: Synthetic oligonucleotide
tcaaggaagatggcatttcu

SEQ ID NO: 90 - DNA, 20 bp, Artificial Sequence
  Description of Artificial Sequence: Synthetic oligonucleotide
  Description of Combined DNA/RNA Molecule: Synthetic oligonucleotide
ggccaaaccucggcttacct

SEQ ID NO: 91 - DNA, 20 bp, Artificial Sequence
  Description of Artificial Sequence: Synthetic oligonucleotide
  Description of Combined DNA/RNA Molecule: Synthetic oligonucleotide
ggccaaacctcggcttaccu

SEQ ID NO: 92 - DNA, 20 bp, Artificial Sequence
  Description of Artificial Sequence: Synthetic oligonucleotide
  Description of Combined DNA/RNA Molecule: Synthetic oligonucleotide
ggccaaaccucggctuaccu

SEQ ID NO: 93 - DNA, 20 bp, Artificial Sequence
  Description of Artificial Sequence: Synthetic oligonucleotide
  Description of Combined DNA/RNA Molecule: Synthetic oligonucleotide
ggccaaacctcggcutaccu

SEQ ID NO: 94 - DNA, 20 bp, Artificial Sequence
  Description of Artificial Sequence: Synthetic oligonucleotide
  Description of Combined DNA/RNA Molecule: Synthetic oligonucleotide
ggccaaacctcggctuaccu

SEQ ID NO: 95 - RNA, 20 nt, Artificial Sequence
  Description of Artificial Sequence: Synthetic oligonucleotide
ggccaaaccucggcuuaccu

SEQ ID NO: 96 - DNA, 20 bp, Artificial Sequence
  Description of Artificial Sequence: Synthetic oligonucleotide
  Description of Combined DNA/RNA Molecule: Synthetic oligonucleotide
ggccaaacctcggcutaccu

SEQ ID NO: 97 - DNA, 20 bp, Artificial Sequence
  Description of Artificial Sequence: Synthetic oligonucleotide
  Description of Combined DNA/RNA Molecule: Synthetic oligonucleotide
ggccaaacctcggctuaccu

SEQ ID NO: 98 - DNA, 20 bp, Artificial Sequence
  Description of Artificial Sequence: Synthetic oligonucleotide
  Description of Combined DNA/RNA Molecule: Synthetic oligonucleotide
ggccaaaccucggcttaccu

SEQ ID NO: 99 - DNA, 20 bp, Artificial Sequence
  Description of Artificial Sequence: Synthetic oligonucleotide
  Description of Combined DNA/RNA Molecule: Synthetic oligonucleotide
ggccaaaccucggcutaccu

SEQ ID NO: 100 - DNA, 20 bp, Artificial Sequence
  Description of Artificial Sequence: Synthetic oligonucleotide
  Description of Combined DNA/RNA Molecule: Synthetic oligonucleotide
tcaaggaagauggcatttct

SEQ ID NO: 101 - DNA, 20 bp, Artificial Sequence
  Description of Artificial Sequence: Synthetic oligonucleotide
  Description of Combined DNA/RNA Molecule: Synthetic oligonucleotide
ucaaggaagatggcatuucu

SEQ ID NO: 102 - DNA, 20 bp, Artificial Sequence
  Description of Artificial Sequence: Synthetic oligonucleotide
  Description of Combined DNA/RNA Molecule: Synthetic oligonucleotide
tcaaggaagatggcautucu

SEQ ID NO: 103 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatutcu

SEQ ID NO: 104 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauutcu

SEQ ID NO: 105 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauttcu

SEQ ID NO: 106 - DNA, 20 bp, Artificial Sequence
  Description of Artificial Sequence: Synthetic oligonucleotide
  Description of Combined DNA/RNA Molecule: Synthetic oligonucleotide
tcaaggaagatggcatttcu

SEQ ID NO: 107 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauttcu

SEQ ID NO: 108 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatttcu

SEQ ID NO: 109 - DNA, 20 bp, Artificial Sequence
  Description of Artificial Sequence: Synthetic oligonucleotide
  Description of Combined DNA/RNA Molecule: Synthetic oligonucleotide
tcaaggaagatggcatttcu

SEQ ID NO: 110 - RNA, 20 nt, Artificial Sequence
  Description of Artificial Sequence: Synthetic oligonucleotide
ggccaaaccucggcuuaccu

SEQ ID NO: 111 - RNA, 20 nt, Artificial Sequence
  Description of Artificial Sequence: Synthetic oligonucleotide
ggccaaaccucggcuuaccu

SEQ ID NO: 112 - RNA, 20 nt, Artificial Sequence
  Description of Artificial Sequence: Synthetic oligonucleotide
ggccaaaccucggcuuaccu

SEQ ID NO: 113 - RNA, 20 nt, Artificial Sequence
  Description of Artificial Sequence: Synthetic oligonucleotide
ggccaaaccucggcuuaccu

SEQ ID NO: 114 - RNA, 20 nt, Artificial Sequence
  Description of Artificial Sequence: Synthetic oligonucleotide
ggccaaaccucggcuuaccu

SEQ ID NO: 115 - RNA, 20 nt, Artificial Sequence
  Description of Artificial Sequence: Synthetic oligonucleotide
ggccaaaccucggcuuaccu

SEQ ID NO: 116 - RNA, 20 nt, Artificial Sequence
  Description of Artificial Sequence: Synthetic oligonucleotide
ggccaaaccucggcuuaccu

SEQ ID NO: 117 - RNA, 20 nt, Artificial Sequence
  Description of Artificial Sequence: Synthetic oligonucleotide
ggccaaaccucggcuuaccu

SEQ ID NO: 118 - RNA, 20 nt, Artificial Sequence
  Description of Artificial Sequence: Synthetic oligonucleotide
ggccaaaccucggcuuaccu

SEQ ID NO: 119 - RNA, 20 nt, Artificial Sequence
  Description of Artificial Sequence: Synthetic oligonucleotide
ggccaaaccucggcuuaccu

SEQ ID NO: 120 - RNA, 20 nt, Artificial Sequence
  Description of Artificial Sequence: Synthetic oligonucleotide
ucaaggaagauggcauuucu

SEQ ID NO: 121 - RNA, 20 nt, Artificial Sequence
  Description of Artificial Sequence: Synthetic oligonucleotide
ucaaggaagauggcauuucu

SEQ ID NO: 122 - RNA, 20 nt, Artificial Sequence
  Description of Artificial Sequence: Synthetic oligonucleotide
ucaaggaagauggcauuucu

SEQ ID NO: 123 - RNA, 20 nt, Artificial Sequence
  Description of Artificial Sequence: Synthetic oligonucleotide
ucaaggaagauggcauuucu

SEQ ID NO: 124 - RNA, 20 nt, Artificial Sequence
  Description of Artificial Sequence: Synthetic oligonucleotide
ucaaggaagauggcauuucu

SEQ ID NO: 125 - RNA, 20 nt, Artificial Sequence
  Description of Artificial Sequence: Synthetic oligonucleotide
ucaaggaagauggcauuucu

SEQ ID NO: 126 - RNA, 20 nt, Artificial Sequence
  Description of Artificial Sequence: Synthetic oligonucleotide
ucaaggaagauggcauuucu

SEQ ID NO: 127 - RNA, 20 nt, Artificial Sequence
  Description of Artificial Sequence: Synthetic oligonucleotide
ucaaggaagauggcauuucu

SEQ ID NO: 128 - RNA, 20 nt, Artificial Sequence
  Description of Artificial Sequence: Synthetic oligonucleotide
ucaaggaagauggcauuucu

SEQ ID NO: 129 - RNA, 20 nt, Artificial Sequence
  Description of Artificial Sequence: Synthetic oligonucleotide
ucaaggaagauggcauuucu

SEQ ID NO: 130 - RNA, 20 nt, Artificial Sequence
  Description of Artificial Sequence: Synthetic oligonucleotide
ggccaaaccucggcuuaccu

SEQ ID NO: 131 - RNA, 20 nt, Artificial Sequence
  Description of Artificial Sequence: Synthetic oligonucleotide
ggccaaaccucggcuuaccu

SEQ ID NO: 132 - RNA, 20 nt, Artificial Sequence
  Description of Artificial Sequence: Synthetic oligonucleotide
ggccaaaccucggcuuaccu

SEQ ID NO: 133 - RNA, 20 nt, Artificial Sequence
  Description of Artificial Sequence: Synthetic oligonucleotide
ggccaaaccucggcuuaccu

SEQ ID NO: 134 - RNA, 20 nt, Artificial Sequence
  Description of Artificial Sequence: Synthetic oligonucleotide
ggccaaaccucggcuuaccu

SEQ ID NO: 135 - RNA, 20 nt, Artificial Sequence
  Description of Artificial Sequence: Synthetic oligonucleotide
ggccaaaccucggcuuaccu

SEQ ID NO: 136 - RNA, 20 nt, Artificial Sequence
  Description of Artificial Sequence: Synthetic oligonucleotide
ggccaaaccucggcuuaccu

SEQ ID NO: 137 - RNA, 20 nt, Artificial Sequence
  Description of Artificial Sequence: Synthetic oligonucleotide
ggccaaaccucggcuuaccu

SEQ ID NO: 138 - RNA, 20 nt, Artificial Sequence
  Description of Artificial Sequence: Synthetic oligonucleotide
agaaaugccaucuuccuuga

SEQ ID NO: 139 - RNA, 20 nt, Artificial Sequence
  Description of Artificial Sequence: Synthetic oligonucleotide
ucaaggaagauggcauuucu

SEQ ID NO: 140 - RNA, 20 nt, Artificial Sequence
  Description of Artificial Sequence: Synthetic oligonucleotide
ucaaggaagauggcauuucu

SEQ ID NO: 141 - RNA, 20 nt, Artificial Sequence
  Description of Artificial Sequence: Synthetic oligonucleotide
ucaaggaagauggcauuucu

SEQ ID NO: 142 - RNA, 20 nt, Artificial Sequence
  Description of Artificial Sequence: Synthetic oligonucleotide
ucaaggaagauggcauuucu

SEQ ID NO: 143 - RNA, 20 nt, Artificial Sequence
  Description of Artificial Sequence: Synthetic oligonucleotide
ucaaggaagauggcauuucu

SEQ ID NO: 144 - RNA, 20 nt, Artificial Sequence
  Description of Artificial Sequence: Synthetic oligonucleotide
ucaaggaagauggcauuucu

SEQ ID NO: 145 - RNA, 20 nt, Artificial Sequence
  Description of Artificial Sequence: Synthetic oligonucleotide
ucaaggaagauggcauuucu

SEQ ID NO: 146 - RNA, 20 nt, Artificial Sequence
  Description of Artificial Sequence: Synthetic oligonucleotide
ucaaggaagauggcauuucu

SEQ ID NO: 147 - RNA, 20 nt, Artificial Sequence
  Description of Artificial Sequence: Synthetic oligonucleotide
ucaaggaagauggcauuucu

SEQ ID NO: 148 - RNA, 20 nt, Artificial Sequence
  Description of Artificial Sequence: Synthetic oligonucleotide
ucaaggaagauggcauuucu

SEQ ID NO: 149 - RNA, 20 nt, Artificial Sequence
  Description of Artificial Sequence: Synthetic oligonucleotide
ucaaggaagauggcauuucu

SEQ ID NO: 150 - RNA, 20 nt, Artificial Sequence
  Description of Artificial Sequence: Synthetic oligonucleotide
ucaaggaagauggcauuucu

SEQ ID NO: 151 - RNA, 20 nt, Artificial Sequence
  Description of Artificial Sequence: Synthetic oligonucleotide
ucaaggaagauggcauuucu

SEQ ID NO: 152 - RNA, 20 nt, Artificial Sequence
  Description of Artificial Sequence: Synthetic oligonucleotide
ucaaggaagauggcauuucu

SEQ ID NO: 153 - RNA, 20 nt, Artificial Sequence
  Description of Artificial Sequence: Synthetic oligonucleotide
ucaaggaagauggcauuucu

SEQ ID NO: 154 - RNA, 20 nt, Artificial Sequence
  Description of Artificial Sequence: Synthetic oligonucleotide
ucaaggaagauggcauuucu

SEQ ID NO: 155 - RNA, 20 nt, Artificial Sequence
  Description of Artificial Sequence: Synthetic oligonucleotide
ucaaggaagauggcauuucu

SEQ ID NO: 156 - RNA, 20 nt, Artificial Sequence
  Description of Artificial Sequence: Synthetic oligonucleotide
ucaaggaagauggcauuucu

SEQ ID NO: 157 - RNA, 20 nt, Artificial Sequence
  Description of Artificial Sequence: Synthetic oligonucleotide
ucaaggaagauggcauuucu

SEQ ID NO: 158 - RNA, 20 nt, Artificial Sequence
  Description of Artificial Sequence: Synthetic oligonucleotide
ucaaggaagauggcauuucu

SEQ ID NO: 159 - RNA, 20 nt, Artificial Sequence
  Description of Artificial Sequence: Synthetic oligonucleotide
ucaaggaagauggcauuucu

SEQ ID NO: 160 - RNA, 20 nt, Artificial Sequence
  Description of Artificial Sequence: Synthetic oligonucleotide
ucaaggaagauggcauuucu

SEQ ID NO: 161 - RNA, 20 nt, Artificial Sequence
  Description of Artificial Sequence: Synthetic oligonucleotide
ucaaggaagauggcauuucu

SEQ ID NO: 162 - RNA, 30 nt, Artificial Sequence
  Description of Artificial Sequence: Synthetic oligonucleotide
cuccaacaucaaggaagauggcauuucuag

SEQ ID NO: 163 - RNA, 25 nt, Artificial Sequence
  Description of Artificial Sequence: Synthetic oligonucleotide
accagaguaacagucugaguaggag

SEQ ID NO: 164 - RNA, 25 nt, Artificial Sequence
  Description of Artificial Sequence: Synthetic oligonucleotide
caccagaguaacagucugaguagga

SEQ ID NO: 165 - RNA, 25 nt, Artificial Sequence
  Description of Artificial Sequence: Synthetic oligonucleotide
ucaccagaguaacagucugaguagg

SEQ ID NO: 166 - RNA, 25 nt, Artificial Sequence
  Description of Artificial Sequence: Synthetic oligonucleotide
gucaccagaguaacagucugaguag

SEQ ID NO: 167 - RNA, 25 nt, Artificial Sequence
  Description of Artificial Sequence: Synthetic oligonucleotide
guugugucaccagaguaacagucug

SEQ ID NO: 168 - RNA, 25 nt, Artificial Sequence
  Description of Artificial Sequence: Synthetic oligonucleotide
gguugugucaccagaguaacagucu

SEQ ID NO: 169 - RNA, 25 nt, Artificial Sequence
  Description of Artificial Sequence: Synthetic oligonucleotide
agguugugucaccagaguaacaguc

SEQ ID NO: 170 - RNA, 25 nt, Artificial Sequence
  Description of Artificial Sequence: Synthetic oligonucleotide
cagguugugucaccagaguaacagu

SEQ ID NO: 171 - RNA, 25 nt, Artificial Sequence
  Description of Artificial Sequence: Synthetic oligonucleotide
acagguugugucaccagaguaacag

SEQ ID NO: 172 - RNA, 25 nt, Artificial Sequence
  Description of Artificial Sequence: Synthetic oligonucleotide
ccacagguugugucaccagaguaac

SEQ ID NO: 173 - RNA, 25 nt, Artificial Sequence
  Description of Artificial Sequence: Synthetic oligonucleotide
accacagguugugucaccagaguaa

SEQ ID NO: 174 - RNA, 25 nt, Artificial Sequence
  Description of Artificial Sequence: Synthetic oligonucleotide
aaccacagguugugucaccagagua

SEQ ID NO: 175 - RNA, 25 nt, Artificial Sequence
  Description of Artificial Sequence: Synthetic oligonucleotide
uaaccacagguugugucaccagagu

SEQ ID NO: 176 - RNA, 25 nt, Artificial Sequence
  Description of Artificial Sequence: Synthetic oligonucleotide
guaaccacagguugugucaccagag

SEQ ID NO: 177 - RNA, 25 nt, Artificial Sequence
  Description of Artificial Sequence: Synthetic oligonucleotide
aguaaccacagguugugucaccaga

SEQ ID NO: 178 - RNA, 25 nt, Artificial Sequence
  Description of Artificial Sequence: Synthetic oligonucleotide
uaguaaccacagguugugucaccag

SEQ ID NO: 179 - RNA, 25 nt, Artificial Sequence
  Description of Artificial Sequence: Synthetic oligonucleotide
uuaguaaccacagguugugucacca

SEQ ID NO: 180 - RNA, 25 nt, Artificial Sequence
  Description of Artificial Sequence: Synthetic oligonucleotide
cuuaguaaccacagguugugucacc

SEQ ID NO: 181 - RNA, 25 nt, Artificial Sequence
  Description of Artificial Sequence: Synthetic oligonucleotide
ccuuaguaaccacagguugugucac

SEQ ID NO: 182 - RNA, 25 nt, Artificial Sequence
  Description of Artificial Sequence: Synthetic oligonucleotide
uccuuaguaaccacagguuguguca

SEQ ID NO: 183 - RNA, 25 nt, Artificial Sequence
  Description of Artificial Sequence: Synthetic oligonucleotide
guuuccuuaguaaccacagguugug

SEQ ID NO: 184 - RNA, 25 nt, Artificial Sequence
  Description of Artificial Sequence: Synthetic oligonucleotide
aguuuccuuaguaaccacagguugu

SEQ ID NO: 185 - RNA, 25 nt, Artificial Sequence
  Description of Artificial Sequence: Synthetic oligonucleotide
caguuuccuuaguaaccacagguug

SEQ ID NO: 186 - RNA, 25 nt, Artificial Sequence
  Description of Artificial Sequence: Synthetic oligonucleotide
gcaguuuccuuaguaaccacagguu

SEQ ID NO: 187 - RNA, 25 nt, Artificial Sequence
  Description of Artificial Sequence: Synthetic oligonucleotide
ggcaguuuccuuaguaaccacaggu

SEQ ID NO: 188 - RNA, 25 nt, Artificial Sequence
  Description of Artificial Sequence: Synthetic oligonucleotide
uggcaguuuccuuaguaaccacagg

SEQ ID NO: 189 - RNA, 25 nt, Artificial Sequence
  Description of Artificial Sequence: Synthetic oligonucleotide
auggcaguuuccuuaguaaccacag

SEQ ID NO: 190 - RNA, 25 nt, Artificial Sequence
  Description of Artificial Sequence: Synthetic oligonucleotide
agauggcaguuuccuuaguaaccac

SEQ ID NO: 191 - RNA, 25 nt, Artificial Sequence
  Description of Artificial Sequence: Synthetic oligonucleotide
gagauggcaguuuccuuaguaacca

SEQ ID NO: 192 - RNA, 25 nt, Artificial Sequence
  Description of Artificial Sequence: Synthetic oligonucleotide
ggagauggcaguuuccuuaguaacc

SEQ ID NO: 193 - RNA, 25 nt, Artificial Sequence
  Description of Artificial Sequence: Synthetic oligonucleotide
uggagauggcaguuuccuuaguaac

SEQ ID NO: 194 - RNA, 25 nt, Artificial Sequence
  Description of Artificial Sequence: Synthetic oligonucleotide
uuggagauggcaguuuccuuaguaa

SEQ ID NO: 195 - RNA, 25 nt, Artificial Sequence
  Description of Artificial Sequence: Synthetic oligonucleotide
uuuggagauggcaguuuccuuagua

SEQ ID NO: 196 - RNA, 25 nt, Artificial Sequence
  Description of Artificial Sequence: Synthetic oligonucleotide
aguuuggagauggcaguuuccuuag

SEQ ID NO: 197 - RNA, 25 nt, Artificial Sequence
  Description of Artificial Sequence: Synthetic oligonucleotide
uaguuuggagauggcaguuuccuua

SEQ ID NO: 198 - RNA, 25 nt, Artificial Sequence
  Description of Artificial Sequence: Synthetic oligonucleotide
cuaguuuggagauggcaguuuccuu

SEQ ID NO: 199 - RNA, 25 nt, Artificial Sequence
  Description of Artificial Sequence: Synthetic oligonucleotide
ucuaguuuggagauggcaguuuccu

SEQ ID NO: 200 - RNA, 25 nt, Artificial Sequence
  Description of Artificial Sequence: Synthetic oligonucleotide
uucuaguuuggagauggcaguuucc

SEQ ID NO: 201 - RNA, 25 nt, Artificial Sequence
  Description of Artificial Sequence: Synthetic oligonucleotide
cauuucuaguuuggagauggcaguu

SEQ ID NO: 202 - RNA, 25 nt, Artificial Sequence
  Description of Artificial Sequence: Synthetic oligonucleotide
gcauuucuaguuuggagauggcagu

SEQ ID NO: 203 - RNA, 25 nt, Artificial Sequence
  Description of Artificial Sequence: Synthetic oligonucleotide
auggcauuucuaguuuggagauggc

SEQ ID NO: 204 - RNA, 25 nt, Artificial Sequence
  Description of Artificial Sequence: Synthetic oligonucleotide
gaagauggcauuucuaguuuggaga

SEQ ID NO: 205 - RNA, 25 nt, Artificial Sequence
  Description of Artificial Sequence: Synthetic oligonucleotide
aggaagauggcauuucuaguuugga

SEQ ID NO: 206 - RNA, 25 nt, Artificial Sequence
  Description of Artificial Sequence: Synthetic oligonucleotide
aaggaagauggcauuucuaguuugg

SEQ ID NO: 207 - RNA, 25 nt, Artificial Sequence
  Description of Artificial Sequence: Synthetic oligonucleotide
caaggaagauggcauuucuaguuug

SEQ ID NO: 208 - RNA, 25 nt, Artificial Sequence
  Description of Artificial Sequence: Synthetic oligonucleotide
caucaaggaagauggcauuucuagu

SEQ ID NO: 209 - RNA, 25 nt, Artificial Sequence
  Description of Artificial Sequence: Synthetic oligonucleotide
acaucaaggaagauggcauuucuag

SEQ ID NO: 210 - RNA, 25 nt, Artificial Sequence
  Description of Artificial Sequence: Synthetic oligonucleotide
aacaucaaggaagauggcauuucua

SEQ ID NO: 211 - RNA, 25 nt, Artificial Sequence
  Description of Artificial Sequence: Synthetic oligonucleotide
caacaucaaggaagauggcauuucu

SEQ ID NO: 212 - RNA, 25 nt, Artificial Sequence
  Description of Artificial Sequence: Synthetic oligonucleotide
cuccaacaucaaggaagauggcauu

SEQ ID NO: 213 - RNA, 25 nt, Artificial Sequence
  Description of Artificial Sequence: Synthetic oligonucleotide
accuccaacaucaaggaagauggca

SEQ ID NO: 214 - RNA, 25 nt, Artificial Sequence
  Description of Artificial Sequence: Synthetic oligonucleotide
guaccuccaacaucaaggaagaugg

SEQ ID NO: 215 - RNA, 25 nt, Artificial Sequence
  Description of Artificial Sequence: Synthetic oligonucleotide
agguaccuccaacaucaaggaagau

SEQ ID NO: 216 - RNA, 25 nt, Artificial Sequence
  Description of Artificial Sequence: Synthetic oligonucleotide
agagcagguaccuccaacaucaagg

SEQ ID NO: 217 - RNA, 25 nt, Artificial Sequence
  Description of Artificial Sequence: Synthetic oligonucleotide
cagagcagguaccuccaacaucaag

SEQ ID NO: 218 - RNA, 25 nt, Artificial Sequence
  Description of Artificial Sequence: Synthetic oligonucleotide
cugccagagcagguaccuccaacau

SEQ ID NO: 219 - RNA, 25 nt, Artificial Sequence
  Description of Artificial Sequence: Synthetic oligonucleotide
ucugccagagcagguaccuccaaca

SEQ ID NO: 220 - RNA, 25 nt, Artificial Sequence
  Description of Artificial Sequence: Synthetic oligonucleotide
aucugccagagcagguaccuccaac

SEQ ID NO: 221 - RNA, 25 nt, Artificial Sequence
  Description of Artificial Sequence: Synthetic oligonucleotide
aaucugccagagcagguaccuccaa

SEQ ID NO: 222 - RNA, 25 nt, Artificial Sequence
  Description of Artificial Sequence: Synthetic oligonucleotide
aaaucugccagagcagguaccucca

SEQ ID NO: 223 - RNA, 25 nt, Artificial Sequence
  Description of Artificial Sequence: Synthetic oligonucleotide
gaaaucugccagagcagguaccucc

SEQ ID NO: 224 - RNA, 25 nt, Artificial Sequence
  Description of Artificial Sequence: Synthetic oligonucleotide
ugaaaucugccagagcagguaccuc

SEQ ID NO: 225 - RNA, 25 nt, Artificial Sequence
  Description of Artificial Sequence: Synthetic oligonucleotide
uugaaaucugccagagcagguaccu

SEQ ID NO: 226 - RNA, 25 nt, Artificial Sequence
  Description of Artificial Sequence: Synthetic oligonucleotide
cccgguugaaaucugccagagcagg

SEQ ID NO: 227 - RNA, 25 nt, Artificial Sequence
  Description of Artificial Sequence: Synthetic oligonucleotide
ccaagcccgguugaaaucugccaga

SEQ ID NO: 228 - RNA, 25 nt, Artificial Sequence
  Description of Artificial Sequence: Synthetic oligonucleotide
uccaagcccgguugaaaucugccag

SEQ ID NO: 229 - RNA, 25 nt, Artificial Sequence
  Description of Artificial Sequence: Synthetic oligonucleotide
guccaagcccgguugaaaucugcca

SEQ ID NO: 230 - RNA, 25 nt, Artificial Sequence
  Description of Artificial Sequence: Synthetic oligonucleotide
ucuguccaagcccgguugaaaucug

SEQ ID NO: 231 - RNA, 25 nt, Artificial Sequence
  Description of Artificial Sequence: Synthetic oligonucleotide
uucuguccaagcccgguugaaaucu

SEQ ID NO: 232 - RNA, 25 nt, Artificial Sequence
  Description of Artificial Sequence: Synthetic oligonucleotide
guucuguccaagcccgguugaaauc

SEQ ID NO: 233 - RNA, 25 nt, Artificial Sequence
  Description of Artificial Sequence: Synthetic oligonucleotide
aguucuguccaagcccgguugaaau

SEQ ID NO: 234 - RNA, 25 nt, Artificial Sequence
  Description of Artificial Sequence: Synthetic oligonucleotide
aaguucuguccaagcccgguugaaa

SEQ ID NO: 235 - RNA, 25 nt, Artificial Sequence
  Description of Artificial Sequence: Synthetic oligonucleotide
uaaguucuguccaagcccgguugaa

SEQ ID NO: 236 - RNA, 25 nt, Artificial Sequence
  Description of Artificial Sequence: Synthetic oligonucleotide
guaaguucuguccaagcccgguuga

SEQ ID NO: 237 - RNA, 25 nt, Artificial Sequence
  Description of Artificial Sequence: Synthetic oligonucleotide
gguaaguucuguccaagcccgguug

SEQ ID NO: 238 - RNA, 25 nt, Artificial Sequence
  Description of Artificial Sequence: Synthetic oligonucleotide
cgguaaguucuguccaagcccgguu

SEQ ID NO: 239 - RNA, 25 nt, Artificial Sequence
  Description of Artificial Sequence: Synthetic oligonucleotide
ucgguaaguucuguccaagcccggu

SEQ ID NO: 240 - RNA, 25 nt, Artificial Sequence
  Description of Artificial Sequence: Synthetic oligonucleotide
gucgguaaguucuguccaagcccgg

SEQ ID NO: 241 - RNA, 25 nt, Artificial Sequence
  Description of Artificial Sequence: Synthetic oligonucleotide
agucgguaaguucuguccaagcccg

SEQ ID NO: 242 - RNA, 25 nt, Artificial Sequence
  Description of Artificial Sequence: Synthetic oligonucleotide
cagucgguaaguucuguccaagccc

SEQ ID NO: 243 - RNA, 25 nt, Artificial Sequence
  Description of Artificial Sequence: Synthetic oligonucleotide
aaagccagucgguaaguucugucca

SEQ ID NO: 244 - RNA, 25 nt, Artificial Sequence
  Description of Artificial Sequence: Synthetic oligonucleotide
gaaagccagucgguaaguucugucc

SEQ ID NO: 245 - RNA, 25 nt, Artificial Sequence
  Description of Artificial Sequence: Synthetic oligonucleotide
gucacccaccaucacccucugugau

SEQ ID NO: 246 - RNA, 25 nt, Artificial Sequence
  Description of Artificial Sequence: Synthetic oligonucleotide
ggucacccaccaucacccucuguga

SEQ ID NO: 247 - RNA, 25 nt, Artificial Sequence
  Description of Artificial Sequence: Synthetic oligonucleotide
aaggucacccaccaucacccucugu

SEQ ID NO: 248 - RNA, 25 nt, Artificial Sequence
  Description of Artificial Sequence: Synthetic oligonucleotide
caaggucacccaccaucacccucug

SEQ ID NO: 249 - RNA, 25 nt, Artificial Sequence
  Description of Artificial Sequence: Synthetic oligonucleotide
ucaaggucacccaccaucacccucu

SEQ ID NO: 250 - RNA, 25 nt, Artificial Sequence
  Description of Artificial Sequence: Synthetic oligonucleotide
cucaaggucacccaccaucacccuc

SEQ ID NO: 251 - RNA, 25 nt, Artificial Sequence
  Description of Artificial Sequence: Synthetic oligonucleotide
cuugaucaagcagagaaagccaguc

SEQ ID NO: 252 - RNA, 25 nt, Artificial Sequence
  Description of Artificial Sequence: Synthetic oligonucleotide
auaacuugaucaagcagagaaagcc

SEQ ID NO: 253 - RNA, 20 nt, Artificial Sequence
  Description of Artificial Sequence: Synthetic oligonucleotide
aguaacagucugaguaggag

SEQ ID NO: 254 - RNA, 20 nt, Artificial Sequence
  Description of Artificial Sequence: Synthetic oligonucleotide
gaguaacagucugaguagga

SEQ ID NO: 255 - RNA, 20 nt, Artificial Sequence
  Description of Artificial Sequence: Synthetic oligonucleotide
agaguaacagucugaguagg

SEQ ID NO: 256 - RNA, 20 nt, Artificial Sequence
  Description of Artificial Sequence: Synthetic oligonucleotide
cagaguaacagucugaguag

SEQ ID NO: 257 - RNA, 20 nt, Artificial Sequence
  Description of Artificial Sequence: Synthetic oligonucleotide
gucaccagaguaacagucug

SEQ ID NO: 258 - RNA, 20 nt, Artificial Sequence
  Description of Artificial Sequence: Synthetic oligonucleotide
ugucaccagaguaacagucu

SEQ ID NO: 259 - RNA, 20 nt, Artificial Sequence
  Description of Artificial Sequence: Synthetic oligonucleotide
gugucaccagaguaacaguc

SEQ ID NO: 260 - RNA, 20 nt, Artificial Sequence
  Description of Artificial Sequence: Synthetic oligonucleotide
ugugucaccagaguaacagu

SEQ ID NO: 261 - RNA, 20 nt, Artificial Sequence
  Description of Artificial Sequence: Synthetic oligonucleotide
uugugucaccagaguaacag

SEQ ID NO: 262 - RNA, 20 nt, Artificial Sequence
  Description of Artificial Sequence: Synthetic oligonucleotide
gguugugucaccagaguaac

SEQ ID NO: 263 - RNA, 20 nt, Artificial Sequence
  Description of Artificial Sequence: Synthetic oligonucleotide
agguugugucaccagaguaa

SEQ ID NO: 264 - RNA, 20 nt, Artificial Sequence
  Description of Artificial Sequence: Synthetic oligonucleotide
cagguugugucaccagagua

SEQ ID NO: 265 - RNA, 20 nt, Artificial Sequence
  Description of Artificial Sequence: Synthetic oligonucleotide
acagguugugucaccagagu

SEQ ID NO: 266 - RNA, 20 nt, Artificial Sequence
  Description of Artificial Sequence: Synthetic oligonucleotide
cacagguugugucaccagag

SEQ ID NO: 267 - RNA, 20 nt, Artificial Sequence
  Description of Artificial Sequence: Synthetic oligonucleotide
ccacagguugugucaccaga

SEQ ID NO: 268 - RNA, 20 nt, Artificial Sequence
  Description of Artificial Sequence: Synthetic oligonucleotide
accacagguugugucaccag

SEQ ID NO: 269 - RNA, 20 nt, Artificial Sequence
  Description of Artificial Sequence: Synthetic oligonucleotide
aaccacagguugugucacca

SEQ ID NO: 270 - RNA, 20 nt, Artificial Sequence
  Description of Artificial Sequence: Synthetic oligonucleotide
uaaccacagguugugucacc

SEQ ID NO: 271 - RNA, 20 nt, Artificial Sequence
  Description of Artificial Sequence: Synthetic oligonucleotide
guaaccacagguugugucac

SEQ ID NO: 272 - RNA, 20 nt, Artificial Sequence
  Description of Artificial Sequence: Synthetic oligonucleotide
aguaaccacagguuguguca

SEQ ID NO: 273 - RNA, 20 nt, Artificial Sequence
  Description of Artificial Sequence: Synthetic oligonucleotide
cuuaguaaccacagguugug

SEQ ID NO: 274 - RNA, 20 nt, Artificial Sequence
  Description of Artificial Sequence: Synthetic oligonucleotide
ccuuaguaaccacagguugu

SEQ ID NO: 275 - RNA, 20 nt, Artificial Sequence
  Description of Artificial Sequence: Synthetic oligonucleotide
uccuuaguaaccacagguug

SEQ ID NO: 276 - RNA, 20 nt, Artificial Sequence
  Description of Artificial Sequence: Synthetic oligonucleotide
uuccuuaguaaccacagguu

SEQ ID NO: 277 - RNA, 20 nt, Artificial Sequence
  Description of Artificial Sequence: Synthetic oligonucleotide
uuuccuuaguaaccacaggu

SEQ ID NO: 278 - RNA, 20 nt, Artificial Sequence
  Description of Artificial Sequence: Synthetic oligonucleotide
guuuccuuaguaaccacagg

SEQ ID NO: 279 - RNA, 20 nt, Artificial Sequence
  Description of Artificial Sequence: Synthetic oligonucleotide
aguuuccuuaguaaccacag

SEQ ID NO: 280 - RNA, 20 nt, Artificial Sequence
  Description of Artificial Sequence: Synthetic oligonucleotide
gcaguuuccuuaguaaccac

SEQ ID NO: 281 - RNA, 20 nt, Artificial Sequence
  Description of Artificial Sequence: Synthetic oligonucleotide
ggcaguuuccuuaguaacca

SEQ ID NO: 282 - RNA, 20 nt, Artificial Sequence
  Description of Artificial Sequence: Synthetic oligonucleotide
uggcaguuuccuuaguaacc

SEQ ID NO: 283 - RNA, 20 nt, Artificial Sequence
  Description of Artificial Sequence: Synthetic oligonucleotide
auggcaguuuccuuaguaac

SEQ ID NO: 284 - RNA, 20 nt, Artificial Sequence
  Description of Artificial Sequence: Synthetic oligonucleotide
gauggcaguuuccuuaguaa

SEQ ID NO: 285 - RNA, 20 nt, Artificial Sequence
  Description of Artificial Sequence: Synthetic oligonucleotide
agauggcaguuuccuuagua

SEQ ID NO: 286 - RNA, 20 nt, Artificial Sequence
  Description of Artificial Sequence: Synthetic oligonucleotide
ggagauggcaguuuccuuag

SEQ ID NO: 287 - RNA, 20 nt, Artificial Sequence
  Description of Artificial Sequence: Synthetic oligonucleotide
uggagauggcaguuuccuua

SEQ ID NO: 288 - RNA, 20 nt, Artificial Sequence
  Description of Artificial Sequence: Synthetic oligonucleotide
uuggagauggcaguuuccuu

SEQ ID NO: 289 - RNA, 20 nt, Artificial Sequence
  Description of Artificial Sequence: Synthetic oligonucleotide
uuuggagauggcaguuuccu

SEQ ID NO: 290 - RNA, 20 nt, Artificial Sequence
  Description of Artificial Sequence: Synthetic oligonucleotide
guuuggagauggcaguuucc

SEQ ID NO: 291 - RNA, 20 nt, Artificial Sequence
  Description of Artificial Sequence: Synthetic oligonucleotide
cuaguuuggagauggcaguu

SEQ ID NO: 292 - RNA, 20 nt, Artificial Sequence
  Description of Artificial Sequence: Synthetic oligonucleotide
ucuaguuuggagauggcagu

SEQ ID NO: 293 - RNA, 20 nt, Artificial Sequence
  Description of Artificial Sequence: Synthetic oligonucleotide
auuucuaguuuggagauggc

SEQ ID NO: 294 - RNA, 20 nt, Artificial Sequence
  Description of Artificial Sequence: Synthetic oligonucleotide
uggcauuucuaguuuggaga

SEQ ID NO: 295 - RNA, 20 nt, Artificial Sequence
  Description of Artificial Sequence: Synthetic oligonucleotide
gauggcauuucuaguuugga

SEQ ID NO: 296 - RNA, 20 nt, Artificial Sequence
  Description of Artificial Sequence: Synthetic oligonucleotide
agauggcauuucuaguuugg

SEQ ID NO: 297 - RNA, 20 nt, Artificial Sequence
  Description of Artificial Sequence: Synthetic oligonucleotide
aagauggcauuucuaguuug

SEQ ID NO: 298 - RNA, 20 nt, Artificial Sequence
  Description of Artificial Sequence: Synthetic oligonucleotide
aggaagauggcauuucuagu

SEQ ID NO: 299 - RNA, 20 nt, Artificial Sequence
  Description of Artificial Sequence: Synthetic oligonucleotide
aaggaagauggcauuucuag

SEQ ID NO: 300 - RNA, 20 nt, Artificial Sequence
  Description of Artificial Sequence: Synthetic oligonucleotide
caaggaagauggcauuucua

SEQ ID NO: 301 - RNA, 20 nt, Artificial Sequence
  Description of Artificial Sequence: Synthetic oligonucleotide
ucaaggaagauggcauuucu

SEQ ID NO: 302 - RNA, 20 nt, Artificial Sequence
  Description of Artificial Sequence: Synthetic oligonucleotide
acaucaaggaagauggcauu

SEQ ID NO: 303 - RNA, 20 nt, Artificial Sequence
  Description of Artificial Sequence: Synthetic oligonucleotide
caacaucaaggaagauggca

SEQ ID NO: 304 - RNA, 20 nt, Artificial Sequence
  Description of Artificial Sequence: Synthetic oligonucleotide
uccaacaucaaggaagaugg

SEQ ID NO: 305 - RNA, 20 nt, Artificial Sequence
  Description of Artificial Sequence: Synthetic oligonucleotide
ccuccaacaucaaggaagau

SEQ ID NO: 306 - RNA, 20 nt, Artificial Sequence
  Description of Artificial Sequence: Synthetic oligonucleotide
agguaccuccaacaucaagg

SEQ ID NO: 307 - RNA, 20 nt, Artificial Sequence
  Description of Artificial Sequence: Synthetic oligonucleotide
cagguaccuccaacaucaag

SEQ ID NO: 308 - RNA, 20 nt, Artificial Sequence
  Description of Artificial Sequence: Synthetic oligonucleotide
agagcagguaccuccaacau

SEQ ID NO: 309 - RNA, 20 nt, Artificial Sequence
  Description of Artificial Sequence: Synthetic oligonucleotide
cagagcagguaccuccaaca

SEQ ID NO: 310 - RNA, 20 nt, Artificial Sequence
  Description of Artificial Sequence: Synthetic oligonucleotide
ccagagcagguaccuccaac

SEQ ID NO: 311 - RNA, 20 nt, Artificial Sequence
  Description of Artificial Sequence: Synthetic oligonucleotide
gccagagcagguaccuccaa

SEQ ID NO: 312 - RNA, 20 nt, Artificial Sequence
  Description of Artificial Sequence: Synthetic oligonucleotide
ugccagagcagguaccucca

SEQ ID NO: 313 - RNA, 20 nt, Artificial Sequence
  Description of Artificial Sequence: Synthetic oligonucleotide
cugccagagcagguaccucc

SEQ ID NO: 314 - RNA, 20 nt, Artificial Sequence
  Description of Artificial Sequence: Synthetic oligonucleotide
ucugccagagcagguaccuc

SEQ ID NO: 315 - RNA, 20 nt, Artificial Sequence
  Description of Artificial Sequence: Synthetic oligonucleotide
aucugccagagcagguaccu

SEQ ID NO: 316 - RNA, 20 nt, Artificial Sequence
  Description of Artificial Sequence: Synthetic oligonucleotide
uugaaaucugccagagcagg

SEQ ID NO: 317 - RNA, 20 nt, Artificial Sequence
  Description of Artificial Sequence: Synthetic oligonucleotide
cccgguugaaaucugccaga

SEQ ID NO: 318 - RNA, 20 nt, Artificial Sequence
  Description of Artificial Sequence: Synthetic oligonucleotide
gcccgguugaaaucugccag

SEQ ID NO: 319 - RNA, 20 nt, Artificial Sequence
  Description of Artificial Sequence: Synthetic oligonucleotide
agcccgguugaaaucugcca

SEQ ID NO: 320 - RNA, 20 nt, Artificial Sequence
  Description of Artificial Sequence: Synthetic oligonucleotide
ccaagcccgguugaaaucug

SEQ ID NO: 321 - RNA, 20 nt, Artificial Sequence
  Description of Artificial Sequence: Synthetic oligonucleotide
uccaagcccgguugaaaucu

SEQ ID NO: 322 - RNA, 20 nt, Artificial Sequence
  Description of Artificial Sequence: Synthetic oligonucleotide
guccaagcccgguugaaauc

SEQ ID NO: 323 - RNA, 20 nt, Artificial Sequence
  Description of Artificial Sequence: Synthetic oligonucleotide
uguccaagcccgguugaaau

SEQ ID NO: 324 - RNA, 20 nt, Artificial Sequence
  Description of Artificial Sequence: Synthetic oligonucleotide
cuguccaagcccgguugaaa

SEQ ID NO: 325 - RNA, 20 nt, Artificial Sequence
  Description of Artificial Sequence: Synthetic oligonucleotide
ucuguccaagcccgguugaa

SEQ ID NO: 326 - RNA, 20 nt, Artificial Sequence
  Description of Artificial Sequence: Synthetic oligonucleotide
uucuguccaagcccgguuga

SEQ ID NO: 327 - RNA, 20 nt, Artificial Sequence
  Description of Artificial Sequence: Synthetic oligonucleotide
guucuguccaagcccgguug

SEQ ID NO: 328 - RNA, 20 nt, Artificial Sequence
  Description of Artificial Sequence: Synthetic oligonucleotide
aguucuguccaagcccgguu

SEQ ID NO: 329 - RNA, 20 nt, Artificial Sequence
  Description of Artificial Sequence: Synthetic oligonucleotide
aaguucuguccaagcccggu

SEQ ID NO: 330 - RNA, 20 nt, Artificial Sequence
  Description of Artificial Sequence: Synthetic oligonucleotide
uaaguucuguccaagcccgg

SEQ ID NO: 331 - RNA, 20 nt, Artificial Sequence
  Description of Artificial Sequence: Synthetic oligonucleotide
guaaguucuguccaagcccg

SEQ ID NO: 332 - RNA, 20 nt, Artificial Sequence
  Description of Artificial Sequence: Synthetic oligonucleotide
gguaaguucuguccaagccc

SEQ ID NO: 333 - RNA, 20 nt, Artificial Sequence
  Description of Artificial Sequence: Synthetic oligonucleotide
cagucgguaaguucugucca

SEQ ID NO: 334 - RNA, 20 nt, Artificial Sequence
  Description of Artificial Sequence: Synthetic oligonucleotide
ccagucgguaaguucugucc

SEQ ID NO: 335 - RNA, 20 nt, Artificial Sequence
  Description of Artificial Sequence: Synthetic oligonucleotide
ccaccaucacccucugugau

SEQ ID NO: 336 - RNA, 20 nt, Artificial Sequence
  Description of Artificial Sequence: Synthetic oligonucleotide
cccaccaucacccucuguga

SEQ ID NO: 337 - RNA, 20 nt, Artificial Sequence
  Description of Artificial Sequence: Synthetic oligonucleotide
cacccaccaucacccucugu

SEQ ID NO: 338 - RNA, 20 nt, Artificial Sequence
  Description of Artificial Sequence: Synthetic oligonucleotide
ucacccaccaucacccucug

SEQ ID NO: 339 - RNA, 20 nt, Artificial Sequence
  Description of Artificial Sequence: Synthetic oligonucleotide
gucacccaccaucacccucu

SEQ ID NO: 340 - RNA, 20 nt, Artificial Sequence
  Description of Artificial Sequence: Synthetic oligonucleotide
ggucacccaccaucacccuc

SEQ ID NO: 341 - RNA, 20 nt, Artificial Sequence
  Description of Artificial Sequence: Synthetic oligonucleotide
ucaagcagagaaagccaguc

SEQ ID NO: 342 - RNA, 20 nt, Artificial Sequence
  Description of Artificial Sequence: Synthetic oligonucleotide
uugaucaagcagagaaagcc

SEQ ID NO: 343 - RNA, 20 nt, Artificial Sequence
  Description of Artificial Sequence: Synthetic oligonucleotide
ucaaggaagauggcauuucu

SEQ ID NO: 344 - RNA, 20 nt, Artificial Sequence
  Description of Artificial Sequence: Synthetic oligonucleotide
ucaaggaagauggcauuucu

SEQ ID NO: 345 - RNA, 20 nt, Artificial Sequence
  Description of Artificial Sequence: Synthetic oligonucleotide
ucaaggaagauggcauuucu

SEQ ID NO: 346 - RNA, 20 nt, Artificial Sequence
  Description of Artificial Sequence: Synthetic oligonucleotide
ucaaggaagauggcauuucu

SEQ ID NO: 347 - RNA, 20 nt, Artificial Sequence
  Description of Artificial Sequence: Synthetic oligonucleotide
ucaaggaagauggcauuucu

SEQ ID NO: 348 - RNA, 20 nt, Artificial Sequence
  Description of Artificial Sequence: Synthetic oligonucleotide
ucaaggaagauggcauuucu

SEQ ID NO: 349 - RNA, 20 nt, Artificial Sequence
  Description of Artificial Sequence: Synthetic oligonucleotide
ucaaggaagauggcauuucu

SEQ ID NO: 350 - RNA, 20 nt, Artificial Sequence
  Description of Artificial Sequence: Synthetic oligonucleotide
ucaaggaagauggcauuucu

SEQ ID NO: 351 - RNA, 20 nt, Artificial Sequence
  Description of Artificial Sequence: Synthetic oligonucleotide
ucaaggaagauggcauuucu

SEQ ID NO: 352 - RNA, 20 nt, Artificial Sequence
  Description of Artificial Sequence: Synthetic oligonucleotide
ucaaggaagauggcauuucu

SEQ ID NO: 353 - RNA, 20 nt, Artificial Sequence
  Description of Artificial Sequence: Synthetic oligonucleotide
ucaaggaagauggcauuucu

SEQ ID NO: 354 - RNA, 20 nt, Artificial Sequence
  Description of Artificial Sequence: Synthetic oligonucleotide
ucaaggaagauggcauuucu

SEQ ID NO: 355 - RNA, 20 nt, Artificial Sequence
  Description of Artificial Sequence: Synthetic oligonucleotide
ucaaggaagauggcauuucu

SEQ ID NO: 356 - RNA, 20 nt, Artificial Sequence
  Description of Artificial Sequence: Synthetic oligonucleotide
ucaaggaagauggcauuucu

SEQ ID NO: 357 - RNA, 20 nt, Artificial Sequence
  Description of Artificial Sequence: Synthetic oligonucleotide
ucaaggaagauggcauuucu

SEQ ID NO: 358 - RNA, 20 nt, Artificial Sequence
  Description of Artificial Sequence: Synthetic oligonucleotide
ucaaggaagauggcauuucu

SEQ ID NO: 359 - RNA, 20 nt, Artificial Sequence
  Description of Artificial Sequence: Synthetic oligonucleotide
ucaaggaagauggcauuucu

SEQ ID NO: 360 - RNA, 20 nt, Artificial Sequence
  Description of Artificial Sequence: Synthetic oligonucleotide
ucaaggaagauggcauuucu

SEQ ID NO: 361 - RNA, 20 nt, Artificial Sequence
  Description of Artificial Sequence: Synthetic oligonucleotide
ucaaggaagauggcauuucu

SEQ ID NO: 362 - RNA, 20 nt, Artificial Sequence
  Description of Artificial Sequence: Synthetic oligonucleotide
ucaaggaagauggcauuucu

SEQ ID NO: 363 - RNA, 20 nt, Artificial Sequence
  Description of Artificial Sequence: Synthetic oligonucleotide
ucaaggaagauggcauuucu

SEQ ID NO: 364 - RNA, 20 nt, Artificial Sequence
  Description of Artificial Sequence: Synthetic oligonucleotide
ucaaggaagauggcauuucu

SEQ ID NO: 365 - RNA, 20 nt, Artificial Sequence
  Description of Artificial Sequence: Synthetic oligonucleotide
ucaaggaagauggcauuucu

SEQ ID NO: 366 - RNA, 20 nt, Artificial Sequence
  Description of Artificial Sequence: Synthetic oligonucleotide
ucaaggaagauggcauuucu

SEQ ID NO: 367 - RNA, 20 nt, Artificial Sequence
  Description of Artificial Sequence: Synthetic oligonucleotide
ucaaggaagauggcauuucu

SEQ ID NO: 368 - RNA, 20 nt, Artificial Sequence
  Description of Artificial Sequence: Synthetic oligonucleotide
ucaaggaagauggcauuucu

SEQ ID NO: 369 - RNA, 20 nt, Artificial Sequence
  Description of Artificial Sequence: Synthetic oligonucleotide
ucaaggaagauggcauuucu

SEQ ID NO: 370 - RNA, 20 nt, Artificial Sequence
  Description of Artificial Sequence: Synthetic oligonucleotide
ucaaggaagauggcauuucu

SEQ ID NO: 371 - RNA, 20 nt, Artificial Sequence
  Description of Artificial Sequence: Synthetic oligonucleotide
ucaaggaagauggcauuucu

SEQ ID NO: 372 - RNA, 20 nt, Artificial Sequence
  Description of Artificial Sequence: Synthetic oligonucleotide
ucaaggaagauggcauuucu

SEQ ID NO: 373 - RNA, 20 nt, Artificial Sequence
  Description of Artificial Sequence: Synthetic oligonucleotide
ucaaggaagauggcauuucu

SEQ ID NO: 374 - RNA, 20 nt, Artificial Sequence
  Description of Artificial Sequence: Synthetic oligonucleotide
ucaaggaagauggcauuucu

SEQ ID NO: 375 - RNA, 20 nt, Artificial Sequence
  Description of Artificial Sequence: Synthetic oligonucleotide
ucaaggaagauggcauuucu

SEQ ID NO: 376 - RNA, 20 nt, Artificial Sequence
  Description of Artificial Sequence: Synthetic oligonucleotide
ucaaggaagauggcauuucu

SEQ ID NO: 377 - RNA, 20 nt, Artificial Sequence
  Description of Artificial Sequence: Synthetic oligonucleotide
ucaaggaagauggcauuucu

SEQ ID NO: 378 - RNA, 20 nt, Artificial Sequence
  Description of Artificial Sequence: Synthetic oligonucleotide
ucaaggaagauggcauuucu

SEQ ID NO: 379 - RNA, 20 nt, Artificial Sequence
  Description of Artificial Sequence: Synthetic oligonucleotide
ucaaggaagauggcauuucu

SEQ ID NO: 380 - RNA, 20 nt, Artificial Sequence
  Description of Artificial Sequence: Synthetic oligonucleotide
ucaaggaagauggcauuucu

SEQ ID NO: 381 - RNA, 20 nt, Artificial Sequence
  Description of Artificial Sequence: Synthetic oligonucleotide
ucaaggaagauggcauuucu

SEQ ID NO: 382 - RNA, 20 nt, Artificial Sequence
  Description of Artificial Sequence: Synthetic oligonucleotide
ucaaggaagauggcauuucu

SEQ ID NO: 383 - RNA, 20 nt, Artificial Sequence
  Description of Artificial Sequence: Synthetic oligonucleotide
ucaaggaagauggcauuucu

SEQ ID NO: 384 - RNA, 20 nt, Artificial Sequence
  Description of Artificial Sequence: Synthetic oligonucleotide
ucaaggaagauggcauuucu

SEQ ID NO: 385 - RNA, 20 nt, Artificial Sequence
  Description of Artificial Sequence: Synthetic oligonucleotide
ucaaggaagauggcauuucu

SEQ ID NO: 386 - RNA, 20 nt, Artificial Sequence
  Description of Artificial Sequence: Synthetic oligonucleotide
ucaaggaagauggcauuucu

SEQ ID NO: 387 - RNA, 20 nt, Artificial Sequence
  Description of Artificial Sequence: Synthetic oligonucleotide
ucaaggaagauggcauuucu

SEQ ID NO: 388 - RNA, 20 nt, Artificial Sequence
  Description of Artificial Sequence: Synthetic oligonucleotide
ucaaggaagauggcauuucu

SEQ ID NO: 389 - RNA, 20 nt, Artificial Sequence
  Description of Artificial Sequence: Synthetic oligonucleotide
ucaaggaagauggcauuucu

SEQ ID NO: 390 - RNA, 20 nt, Artificial Sequence
  Description of Artificial Sequence: Synthetic oligonucleotide
ucaaggaagauggcauuucu

SEQ ID NO: 391 - RNA, 20 nt, Artificial Sequence
  Description of Artificial Sequence: Synthetic oligonucleotide
ucaaggaagauggcauuucu

SEQ ID NO: 392 - RNA, 20 nt, Artificial Sequence
  Description of Artificial Sequence: Synthetic oligonucleotide
ucaaggaagauggcauuucu

SEQ ID NO: 393 - RNA, 20 nt, Artificial Sequence
  Description of Artificial Sequence: Synthetic oligonucleotide
ucaaggaagauggcauuucu

SEQ ID NO: 394 - RNA, 20 nt, Artificial Sequence
  Description of Artificial Sequence: Synthetic oligonucleotide
ucaaggaagauggcauuucu

SEQ ID NO: 395 - RNA, 20 nt, Artificial Sequence
  Description of Artificial Sequence: Synthetic oligonucleotide
ucaaggaagauggcauuucu

SEQ ID NO: 396 - RNA, 20 nt, Artificial Sequence
  Description of Artificial Sequence: Synthetic oligonucleotide
ucaaggaagauggcauuucu

SEQ ID NO: 397 - RNA, 20 nt, Artificial Sequence
  Description of Artificial Sequence: Synthetic oligonucleotide
ucaaggaagauggcauuucu

SEQ ID NO: 398 - RNA, 25 nt, Artificial Sequence
  Description of Artificial Sequence: Synthetic oligonucleotide
caaagaagauggcauuucuaguuug

SEQ ID NO: 399 - RNA, 20 nt, Artificial Sequence
  Description of Artificial Sequence: Synthetic oligonucleotide
gcaaagaagauggcauuucu

SEQ ID NO: 400 - RNA, 20 nt, Artificial Sequence
  Description of Artificial Sequence: Synthetic oligonucleotide
gcaaagaagauggcauuucu

SEQ ID NO: 401 - RNA, 20 nt, Artificial Sequence
  Description of Artificial Sequence: Synthetic oligonucleotide
ucaaggaagauggcauuucu

SEQ ID NO: 402 - RNA, 20 nt, Artificial Sequence
  Description of Artificial Sequence: Synthetic oligonucleotide
ucaaggaagauggcauuucu

SEQ ID NO: 403 - RNA, 20 nt, Artificial Sequence
  Description of Artificial Sequence: Synthetic oligonucleotide
ucaaggaagauggcauuucu

SEQ ID NO: 404 - RNA, 20 nt, Artificial Sequence
  Description of Artificial Sequence: Synthetic oligonucleotide
ucaaggaagauggcauuucu

SEQ ID NO: 405 - RNA, 20 nt, Artificial Sequence
  Description of Artificial Sequence: Synthetic oligonucleotide
ucaaggaagauggcauuucu

SEQ ID NO: 406 - RNA, 20 nt, Artificial Sequence
  Description of Artificial Sequence: Synthetic oligonucleotide
ucaaggaagauggcauuucu

SEQ ID NO: 407 - RNA, 20 nt, Artificial Sequence
  Description of Artificial Sequence: Synthetic oligonucleotide
ucaaggaagauggcauuucu

SEQ ID NO: 408 - RNA, 20 nt, Artificial Sequence
  Description of Artificial Sequence: Synthetic oligonucleotide
ucaaggaagauggcauuucu

SEQ ID NO: 409 - RNA, 20 nt, Artificial Sequence
  Description of Artificial Sequence: Synthetic oligonucleotide
ucaaggaagauggcauuucu

SEQ ID NO: 410 - RNA, 20 nt, Artificial Sequence
  Description of Artificial Sequence: Synthetic oligonucleotide
ucaaggaagauggcauuucu

SEQ ID NO: 411 - RNA, 20 nt, Artificial Sequence
  Description of Artificial Sequence: Synthetic oligonucleotide
ucaaggaagauggcauuucu

SEQ ID NO: 412 - RNA, 20 nt, Artificial Sequence
  Description of Artificial Sequence: Synthetic oligonucleotide
ggccaaaccucggcuuaccu

SEQ ID NO: 413 - RNA, 25 nt, Artificial Sequence
  Description of Artificial Sequence: Synthetic oligonucleotide
ggccaaaccucggcuuaccugaaau

SEQ ID NO: 414 - RNA, 20 nt, Artificial Sequence
  Description of Artificial Sequence: Synthetic oligonucleotide
ucaaggaagauggcauuucu

SEQ ID NO: 415 - RNA, 20 nt, Artificial Sequence
  Description of Artificial Sequence: Synthetic oligonucleotide
ucaaggaagauggcauuucu

SEQ ID NO: 416 - RNA, 20 nt, Artificial Sequence
  Description of Artificial Sequence: Synthetic oligonucleotide
ucaaggaagauggcauuucu

SEQ ID NO: 417 - RNA, 20 nt, Artificial Sequence
  Description of Artificial Sequence: Synthetic oligonucleotide
ucaaggaagauggcauuucu

SEQ ID NO: 418 - RNA, 20 nt, Artificial Sequence
  Description of Artificial Sequence: Synthetic oligonucleotide
ucaaggaagauggcauuucu

SEQ ID NO: 419 - RNA, 20 nt, Artificial Sequence
  Description of Artificial Sequence: Synthetic oligonucleotide
ucaaggaagauggcauuucu

SEQ ID NO: 420 - RNA, 20 nt, Artificial Sequence
  Description of Artificial Sequence: Synthetic oligonucleotide
ucaaggaagauggcauuucu

SEQ ID NO: 421 - RNA, 20 nt, Artificial Sequence
  Description of Artificial Sequence: Synthetic oligonucleotide
ucaaggaagauggcauuucu

SEQ ID NO: 422 - RNA, 20 nt, Artificial Sequence
  Description of Artificial Sequence: Synthetic oligonucleotide
ucaaggaagauggcauuucu

SEQ ID NO: 423 - RNA, 20 nt, Artificial Sequence
  Description of Artificial Sequence: Synthetic oligonucleotide
ucaaggaagauggcauuucu

SEQ ID NO: 424 - RNA, 20 nt, Artificial Sequence
  Description of Artificial Sequence: Synthetic oligonucleotide
ucaaggaagauggcauuucu

SEQ ID NO: 425 - RNA, 20 nt, Artificial Sequence
  Description of Artificial Sequence: Synthetic oligonucleotide
ucaaggaagauggcauuucu

SEQ ID NO: 426 - RNA, 20 nt, Artificial Sequence
  Description of Artificial Sequence: Synthetic oligonucleotide
ucaaggaagauggcauuucu

SEQ ID NO: 427 - RNA, 20 nt, Artificial Sequence
  Description of Artificial Sequence: Synthetic oligonucleotide
ucaaggaagauggcauuucu

SEQ ID NO: 428 - DNA, 20 bp, Artificial Sequence
  Description of Artificial Sequence: Synthetic oligonucleotide
tcaaggaagatggcatttct

SEQ ID NO: 429 - RNA, 20 nt, Artificial Sequence
  Description of Artificial Sequence: Synthetic oligonucleotide
ucaaggaagauggcauuucu

SEQ ID NO: 430 - RNA, 20 nt, Artificial Sequence
  Description of Artificial Sequence: Synthetic oligonucleotide
ucaaggaagauggcauuucu

SEQ ID NO: 431 - RNA, 20 nt, Artificial Sequence
  Description of Artificial Sequence: Synthetic oligonucleotide
ucaaggaagauggcauuucu

SEQ ID NO: 432 - RNA, 20 nt, Artificial Sequence
  Description of Artificial Sequence: Synthetic oligonucleotide
ucaaggaagauggcauuucu

SEQ ID NO: 433 - RNA, 20 nt, Artificial Sequence
  Description of Artificial Sequence: Synthetic oligonucleotide
ucaaggaagauggcauuucu

SEQ ID NO: 434 - RNA, 20 nt, Artificial Sequence
  Description of Artificial Sequence: Synthetic oligonucleotide
ucaaggaagauggcauuucu

SEQ ID NO: 435 - RNA, 20 nt, Artificial Sequence
  Description of Artificial Sequence: Synthetic oligonucleotide
ucaaggaagauggcauuucu

SEQ ID NO: 436 - RNA, 20 nt, Artificial Sequence
  Description of Artificial Sequence: Synthetic oligonucleotide
ucaaggaagauggcauuucu

SEQ ID NO: 437 - RNA, 20 nt, Artificial Sequence
  Description of Artificial Sequence: Synthetic oligonucleotide
ucaaggaagauggcauuucu

SEQ ID NO: 438 - RNA, 20 nt, Artificial Sequence
  Description of Artificial Sequence: Synthetic oligonucleotide
ucaaggaagauggcauuucu

SEQ ID NO: 439 - RNA, 20 nt, Artificial Sequence
  Description of Artificial Sequence: Synthetic oligonucleotide
ucaaggaagauggcauuucu

SEQ ID NO: 440 - RNA, 20 nt, Artificial Sequence
  Description of Artificial Sequence: Synthetic oligonucleotide
ucaaggaagauggcauuucu

SEQ ID NO: 441 - RNA, 20 nt, Artificial Sequence
  Description of Artificial Sequence: Synthetic oligonucleotide
ucaaggaagauggcauuucu

SEQ ID NO: 442 - RNA, 20 nt, Artificial Sequence
  Description of Artificial Sequence: Synthetic oligonucleotide
ucaaggaagauggcauuucu

SEQ ID NO: 443 - RNA, 20 nt, Artificial Sequence
  Description of Artificial Sequence: Synthetic oligonucleotide
ucaaggaagauggcauuucu

SEQ ID NO: 444 - RNA, 20 nt, Artificial Sequence
  Description of Artificial Sequence: Synthetic oligonucleotide
ucaaggaagauggcauuucu

SEQ ID NO: 445 - RNA, 20 nt, Artificial Sequence
  Description of Artificial Sequence: Synthetic oligonucleotide
ucaaggaagauggcauuucu

SEQ ID NO: 446 - RNA, 20 nt, Artificial Sequence
  Description of Artificial Sequence: Synthetic oligonucleotide
ucaaggaagauggcauuucu

SEQ ID NO: 447 - RNA, 20 nt, Artificial Sequence
  Description of Artificial Sequence: Synthetic oligonucleotide
ucaaggaagauggcauuucu

SEQ ID NO: 448 - RNA, 20 nt, Artificial Sequence
  Description of Artificial Sequence: Synthetic oligonucleotide
ucaaggaagauggcauuucu

SEQ ID NO: 449 - RNA, 20 nt, Artificial Sequence
  Description of Artificial Sequence: Synthetic oligonucleotide
ucaaggaagauggcauuucu

SEQ ID NO: 450 - RNA, 20 nt, Artificial Sequence
  Description of Artificial Sequence: Synthetic oligonucleotide
ucaaggaagauggcauuucu

SEQ ID NO: 451 - RNA, 20 nt, Artificial Sequence
  Description of Artificial Sequence: Synthetic oligonucleotide
ucaaggaagauggcauuucu

SEQ ID NO: 452 - RNA, 20 nt, Artificial Sequence
  Description of Artificial Sequence: Synthetic oligonucleotide
ucaaggaagauggcauuucu

SEQ ID NO: 453 - RNA, 20 nt, Artificial Sequence
  Description of Artificial Sequence: Synthetic oligonucleotide
ucaaggaagauggcauuucu

SEQ ID NO: 454 - RNA, 20 nt, Artificial Sequence
  Description of Artificial Sequence: Synthetic oligonucleotide
ucaaggaagauggcauuucu

SEQ ID NO: 455 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 456 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 457 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 458 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 459 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 460 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 461 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 462 - RNA, 20 nt, Artificial Sequence
  Description of Artificial Sequence: Synthetic oligonucleotide
ucaaggaagauggcauuucu

SEQ ID NO: 463 - RNA, 20 nt, Artificial Sequence
  Description of Artificial Sequence: Synthetic oligonucleotide
ucaaggaagauggcauuucu

SEQ ID NO: 464 - RNA, 20 nt, Artificial Sequence
  Description of Artificial Sequence: Synthetic oligonucleotide
ucaaggaagauggcauuucu

SEQ ID NO: 465 - RNA, 20 nt, Artificial Sequence
  Description of Artificial Sequence: Synthetic oligonucleotide
ucaaggaagauggcauuucu

SEQ ID NO: 466 - RNA, 20 nt, Artificial Sequence
  Description of Artificial Sequence: Synthetic oligonucleotide
ucaaggaagauggcauuucu

SEQ ID NO: 467 - RNA, 20 nt, Artificial Sequence
  Description of Artificial Sequence: Synthetic oligonucleotide
ucaaggaagauggcauuucu

SEQ ID NO: 468 - RNA, 20 nt, Artificial Sequence
  Description of Artificial Sequence: Synthetic oligonucleotide
ucaaggaagauggcauuucu

SEQ ID NO: 469 - RNA, 20 nt, Artificial Sequence
  Description of Artificial Sequence: Synthetic oligonucleotide
ucaaggaagauggcauuucu

SEQ ID NO: 470 - RNA, 20 nt, Artificial Sequence
  Description of Artificial Sequence: Synthetic oligonucleotide
ucaaggaagauggcauuucu

SEQ ID NO: 471 - RNA, 20 nt, Artificial Sequence
  Description of Artificial Sequence: Synthetic oligonucleotide
ucaaggaagauggcauuucu

SEQ ID NO: 472 - RNA, 20 nt, Artificial Sequence
  Description of Artificial Sequence: Synthetic oligonucleotide
ucaaggaagauggcauuucu

SEQ ID NO: 473 - RNA, 20 nt, Artificial Sequence
  Description of Artificial Sequence: Synthetic oligonucleotide
ucaaggaagauggcauuucu

SEQ ID NO: 474 - RNA, 20 nt, Artificial Sequence
  Description of Artificial Sequence: Synthetic oligonucleotide
ucaaggaagauggcauuucu

SEQ ID NO: 475 - RNA, 20 nt, Artificial Sequence
  Description of Artificial Sequence: Synthetic oligonucleotide
ucaaggaagauggcauuucu

SEQ ID NO: 476 - RNA, 20 nt, Artificial Sequence
  Description of Artificial Sequence: Synthetic oligonucleotide
ucaaggaagauggcauuucu

SEQ ID NO: 477 - RNA, 20 nt, Artificial Sequence
  Description of Artificial Sequence: Synthetic oligonucleotide
ucaaggaagauggcauuucu

SEQ ID NO: 478 - RNA, 20 nt, Artificial Sequence
  Description of Artificial Sequence: Synthetic oligonucleotide
ucaaggaagauggcauuucu

SEQ ID NO: 479 - RNA, 20 nt, Artificial Sequence
  Description of Artificial Sequence: Synthetic oligonucleotide
ucaaggaagauggcauuucu

SEQ ID NO: 480 - RNA, 20 nt, Artificial Sequence
  Description of Artificial Sequence: Synthetic oligonucleotide
ucaaggaagauggcauuucu

SEQ ID NO: 481 - RNA, 20 nt, Artificial Sequence
  Description of Artificial Sequence: Synthetic oligonucleotide
ucaaggaagauggcauuucu

SEQ ID NO: 482 - RNA, 20 nt, Artificial Sequence
  Description of Artificial Sequence: Synthetic oligonucleotide
ucaaggaagauggcauuucu

SEQ ID NO: 483 - RNA, 20 nt, Artificial Sequence
  Description of Artificial Sequence: Synthetic oligonucleotide
ucaaggaagauggcauuucu

SEQ ID NO: 484 - RNA, 20 nt, Artificial Sequence
  Description of Artificial Sequence: Synthetic oligonucleotide
ucaaggaagauggcauuucu

SEQ ID NO: 485 - RNA, 20 nt, Artificial Sequence
  Description of Artificial Sequence: Synthetic oligonucleotide
ucaaggaagauggcauuucu

SEQ ID NO: 486 - RNA, 20 nt, Artificial Sequence
  Description of Artificial Sequence: Synthetic oligonucleotide
ucaaggaagauggcauuucu

SEQ ID NO: 487 - RNA, 20 nt, Artificial Sequence
  Description of Artificial Sequence: Synthetic oligonucleotide
ucaaggaagauggcauuucu

SEQ ID NO: 488 - RNA, 20 nt, Artificial Sequence
  Description of Artificial Sequence: Synthetic oligonucleotide
ucaaggaagauggcauuucu

SEQ ID NO: 489 - RNA, 20 nt, Artificial Sequence
  Description of Artificial Sequence: Synthetic oligonucleotide
ucaaggaagauggcauuucu

SEQ ID NO: 490 - RNA, 20 nt, Artificial Sequence
  Description of Artificial Sequence: Synthetic oligonucleotide
ucaaggaagauggcauuucu

SEQ ID NO: 491 - RNA, 20 nt, Artificial Sequence
  Description of Artificial Sequence: Synthetic oligonucleotide
ucaaggaagauggcauuucu

SEQ ID NO: 492 - RNA, 20 nt, Artificial Sequence
  Description of Artificial Sequence: Synthetic oligonucleotide
ucaaggaagauggcauuucu

SEQ ID NO: 493 - RNA, 20 nt, Artificial Sequence
  Description of Artificial Sequence: Synthetic oligonucleotide
ucaaggaagauggcauuucu

SEQ ID NO: 494 - RNA, 20 nt, Artificial Sequence
  Description of Artificial Sequence: Synthetic oligonucleotide
ucaaggaagauggcauuucu

SEQ ID NO: 495 - RNA, 20 nt, Artificial Sequence
  Description of Artificial Sequence: Synthetic oligonucleotide
ucaaggaagauggcauuucu

SEQ ID NO: 496 - RNA, 20 nt, Artificial Sequence
  Description of Artificial Sequence: Synthetic oligonucleotide
ucaaggaagauggcauuucu

SEQ ID NO: 497 - RNA, 20 nt, Artificial Sequence
  Description of Artificial Sequence: Synthetic oligonucleotide
ucaaggaagauggcauuucu

SEQ ID NO: 498 - RNA, 20 nt, Artificial Sequence
  Description of Artificial Sequence: Synthetic oligonucleotide
ucaaggaagauggcauuucu

SEQ ID NO: 499 - RNA, 20 nt, Artificial Sequence
  Description of Artificial Sequence: Synthetic oligonucleotide
ucaaggaagauggcauuucu

SEQ ID NO: 500 - RNA, 20 nt, Artificial Sequence
  Description of Artificial Sequence: Synthetic oligonucleotide
ucaaggaagauggcauuucu

SEQ ID NO: 501 - RNA, 20 nt, Artificial Sequence
  Description of Artificial Sequence: Synthetic oligonucleotide
ucaaggaagauggcauuucu

SEQ ID NO: 502 - RNA, 20 nt, Artificial Sequence
  Description of Artificial Sequence: Synthetic oligonucleotide
ucaaggaagauggcauuucu

SEQ ID NO: 503 - RNA, 20 nt, Artificial Sequence
  Description of Artificial Sequence: Synthetic oligonucleotide
ucaaggaagauggcauuucu

SEQ ID NO: 504 - RNA, 20 nt, Artificial Sequence
  Description of Artificial Sequence: Synthetic oligonucleotide
ucaaggaagauggcauuucu

SEQ ID NO: 505 - RNA, 20 nt, Artificial Sequence
  Description of Artificial Sequence: Synthetic oligonucleotide
ucaaggaagauggcauuucu

SEQ ID NO: 506 - RNA, 20 nt, Artificial Sequence
  Description of Artificial Sequence: Synthetic oligonucleotide
ucaaggaagauggcauuucu

SEQ ID NO: 507 - RNA, 20 nt, Artificial Sequence
  Description of Artificial Sequence: Synthetic oligonucleotide
ucaaggaagauggcauuucu

SEQ ID NO: 508 - RNA, 20 nt, Artificial Sequence
  Description of Artificial Sequence: Synthetic oligonucleotide
ucaaggaagauggcauuucu

SEQ ID NO: 509 - RNA, 20 nt, Artificial Sequence
  Description of Artificial Sequence: Synthetic oligonucleotide
ucaaggaagauggcauuucu

SEQ ID NO: 510 - RNA, 20 nt, Artificial Sequence
  Description of Artificial Sequence: Synthetic oligonucleotide
ucaaggaagauggcauuucu

SEQ ID NO: 511 - RNA, 20 nt, Artificial Sequence
  Description of Artificial Sequence: Synthetic oligonucleotide
ucaaggaagauggcauuucu

SEQ ID NO: 512 - RNA, 20 nt, Artificial Sequence
  Description of Artificial Sequence: Synthetic oligonucleotide
ucaaggaagauggcauuucu

SEQ ID NO: 513 - RNA, 20 nt, Artificial Sequence
  Description of Artificial Sequence: Synthetic oligonucleotide
ucaaggaagauggcauuucu

SEQ ID NO: 514 - RNA, 20 nt, Artificial Sequence
  Description of Artificial Sequence: Synthetic oligonucleotide
ucaaggaagauggcauuucu

SEQ ID NO: 515 - RNA, 20 nt, Artificial Sequence
  Description of Artificial Sequence: Synthetic oligonucleotide
ucaaggaagauggcauuucu

SEQ ID NO: 516 - RNA, 20 nt, Artificial Sequence
  Description of Artificial Sequence: Synthetic oligonucleotide
ucaaggaagauggcauuucu

SEQ ID NO: 517 - RNA, 20 nt, Artificial Sequence
  Description of Artificial Sequence: Synthetic oligonucleotide
ucaaggaagauggcauuucu

SEQ ID NO: 518 - RNA, 20 nt, Artificial Sequence
  Description of Artificial Sequence: Synthetic oligonucleotide
ucaaggaagauggcauuucu

SEQ ID NO: 519 - RNA, 20 nt, Artificial Sequence
  Description of Artificial Sequence: Synthetic oligonucleotide
ucaaggaagauggcauuucu

SEQ ID NO: 520 - RNA, 20 nt, Artificial Sequence
  Description of Artificial Sequence: Synthetic oligonucleotide
ucaaggaagauggcauuucu

SEQ ID NO: 521 - RNA, 20 nt, Artificial Sequence
  Description of Artificial Sequence: Synthetic oligonucleotide
ucaaggaagauggcauuucu

SEQ ID NO: 522 - RNA, 20 nt, Artificial Sequence
  Description of Artificial Sequence: Synthetic oligonucleotide
ucaaggaagauggcauuucu

SEQ ID NO: 523 - RNA, 20 nt, Artificial Sequence
  Description of Artificial Sequence: Synthetic oligonucleotide
ucaaggaagauggcauuucu

SEQ ID NO: 524 - RNA, 20 nt, Artificial Sequence
  Description of Artificial Sequence: Synthetic oligonucleotide
ucaaggaagauggcauuucu

SEQ ID NO: 525 - RNA, 20 nt, Artificial Sequence
  Description of Artificial Sequence: Synthetic oligonucleotide
ucaaggaagauggcauuucu

SEQ ID NO: 526 - RNA, 20 nt, Artificial Sequence
  Description of Artificial Sequence: Synthetic oligonucleotide
ucaaggaagauggcauuucu

SEQ ID NO: 527 - RNA, 20 nt, Artificial Sequence
  Description of Artificial Sequence: Synthetic oligonucleotide
ucaaggaagauggcauuucu

SEQ ID NO: 528 - RNA, 20 nt, Artificial Sequence
  Description of Artificial Sequence: Synthetic oligonucleotide
ucaaggaagauggcauuucu

SEQ ID NO: 529 - RNA, 20 nt, Artificial Sequence
  Description of Artificial Sequence: Synthetic oligonucleotide
ucaaggaagauggcauuucu

SEQ ID NO: 530 - RNA, 20 nt, Artificial Sequence
  Description of Artificial Sequence: Synthetic oligonucleotide
ucaaggaagauggcauuucu

SEQ ID NO: 531 - RNA, 20 nt, Artificial Sequence
  Description of Artificial Sequence: Synthetic oligonucleotide
ucaaggaagauggcauuucu

SEQ ID NO: 532 - RNA, 20 nt, Artificial Sequence
  Description of Artificial Sequence: Synthetic oligonucleotide
ucaaggaagauggcauuucu

SEQ ID NO: 533 - RNA, 20 nt, Artificial Sequence
  Description of Artificial Sequence: Synthetic oligonucleotide
ucaaggaagauggcauuucu

SEQ ID NO: 534 - RNA, 20 nt, Artificial Sequence
  Description of Artificial Sequence: Synthetic oligonucleotide
ucaaggaagauggcauuucu

SEQ ID NO: 535 - RNA, 20 nt, Artificial Sequence
  Description of Artificial Sequence: Synthetic oligonucleotide
ucaaggaagauggcauuucu

SEQ ID NO: 536 - RNA, 20 nt, Artificial Sequence
  Description of Artificial Sequence: Synthetic oligonucleotide
ucaaggaagauggcauuucu

SEQ ID NO: 537 - RNA, 20 nt, Artificial Sequence
  Description of Artificial Sequence: Synthetic oligonucleotide
ucaaggaagauggcauuucu

SEQ ID NO: 538 - RNA, 20 nt, Artificial Sequence
  Description of Artificial Sequence: Synthetic oligonucleotide
ucaaggaagauggcauuucu

SEQ ID NO: 539 - RNA, 20 nt, Artificial Sequence
  Description of Artificial Sequence: Synthetic oligonucleotide
ucaaggaagauggcauuucu

SEQ ID NO: 540 - RNA, 20 nt, Artificial Sequence
  Description of Artificial Sequence: Synthetic oligonucleotide
ucaaggaagauggcauuucu

SEQ ID NO: 541 - RNA, 20 nt, Artificial Sequence
  Description of Artificial Sequence: Synthetic oligonucleotide
ucaaggaagauggcauuucu

SEQ ID NO: 542 - RNA, 20 nt, Artificial Sequence
  Description of Artificial Sequence: Synthetic oligonucleotide
ucaaggaagauggcauuucu

SEQ ID NO: 543 - RNA, 20 nt, Artificial Sequence
  Description of Artificial Sequence: Synthetic oligonucleotide
ucaaggaagauggcauuucu

SEQ ID NO: 544 - RNA, 20 nt, Artificial Sequence
  Description of Artificial Sequence: Synthetic oligonucleotide
ucaaggaagauggcauuucu

SEQ ID NO: 545 - RNA, 20 nt, Artificial Sequence
  Description of Artificial Sequence: Synthetic oligonucleotide
ucaaggaagauggcauuucu

SEQ ID NO: 546 - RNA, 20 nt, Artificial Sequence
  Description of Artificial Sequence: Synthetic oligonucleotide
ucaaggaagauggcauuucu

SEQ ID NO: 547 - RNA, 20 nt, Artificial Sequence
  Description of Artificial Sequence: Synthetic oligonucleotide
ucaaggaagauggcauuucu

SEQ ID NO: 548 - RNA, 20 nt, Artificial Sequence
  Description of Artificial Sequence: Synthetic oligonucleotide
ucaaggaagauggcauuucu

SEQ ID NO: 549 - RNA, 20 nt, Artificial Sequence
  Description of Artificial Sequence: Synthetic oligonucleotide
ucaaggaagauggcauuucu

SEQ ID NO: 550 - RNA, 20 nt, Artificial Sequence
  Description of Artificial Sequence: Synthetic oligonucleotide
ucaaggaagauggcauuucu

SEQ ID NO: 551 - RNA, 20 nt, Artificial Sequence
  Description of Artificial Sequence: Synthetic oligonucleotide
ucaaggaagauggcauuucu

SEQ ID NO: 552 - RNA, 20 nt, Artificial Sequence
  Description of Artificial Sequence: Synthetic oligonucleotide
ucaaggaagauggcauuucu

SEQ ID NO: 553 - RNA, 20 nt, Artificial Sequence
  Description of Artificial Sequence: Synthetic oligonucleotide
ucaaggaagauggcauuucu

SEQ ID NO: 554 - RNA, 20 nt, Artificial Sequence
  Description of Artificial Sequence: Synthetic oligonucleotide
ucaaggaagauggcauuucu

SEQ ID NO: 555 - RNA, 20 nt, Artificial Sequence
  Description of Artificial Sequence: Synthetic oligonucleotide
ucaaggaagauggcauuucu

SEQ ID NO: 556 - RNA, 20 nt, Artificial Sequence
  Description of Artificial Sequence: Synthetic oligonucleotide
ucaaggaagauggcauuucu

SEQ ID NO: 557 - RNA, 20 nt, Artificial Sequence
  Description of Artificial Sequence: Synthetic oligonucleotide
ucaaggaagauggcauuucu

SEQ ID NO: 558 - RNA, 20 nt, Artificial Sequence
  Description of Artificial Sequence: Synthetic oligonucleotide
ucaaggaagauggcauuucu

SEQ ID NO: 559 - RNA, 20 nt, Artificial Sequence
  Description of Artificial Sequence: Synthetic oligonucleotide
ucaaggaagauggcauuucu

SEQ ID NO: 560 - RNA, 20 nt, Artificial Sequence
  Description of Artificial Sequence: Synthetic oligonucleotide
ucaaggaagauggcauuucu

SEQ ID NO: 561 - RNA, 20 nt, Artificial Sequence
  Description of Artificial Sequence: Synthetic oligonucleotide
ucaaggaagauggcauuucu

SEQ ID NO: 562 - RNA, 20 nt, Artificial Sequence
  Description of Artificial Sequence: Synthetic oligonucleotide
ucaaggaagauggcauuucu

SEQ ID NO: 563 - RNA, 20 nt, Artificial Sequence
  Description of Artificial Sequence: Synthetic oligonucleotide
ucaaggaagauggcauuucu

SEQ ID NO: 564 - RNA, 20 nt, Artificial Sequence
  Description of Artificial Sequence: Synthetic oligonucleotide
ucaaggaagauggcauuucu

SEQ ID NO: 565 - RNA, 20 nt, Artificial Sequence
  Description of Artificial Sequence: Synthetic oligonucleotide
ucaaggaagauggcauuucu

SEQ ID NO: 566 - RNA, 20 nt, Artificial Sequence
  Description of Artificial Sequence: Synthetic oligonucleotide
ucaaggaagauggcauuucu

SEQ ID NO: 567 - RNA, 20 nt, Artificial Sequence
  Description of Artificial Sequence: Synthetic oligonucleotide
ucaaggaagauggcauuucu

SEQ ID NO: 568 - RNA, 20 nt, Artificial Sequence
  Description of Artificial Sequence: Synthetic oligonucleotide
ucaaggaagauggcauuucu

SEQ ID NO: 569 - RNA, 20 nt, Artificial Sequence
  Description of Artificial Sequence: Synthetic oligonucleotide
ucaaggaagauggcauuucu

SEQ ID NO: 570 - RNA, 20 nt, Artificial Sequence
  Description of Artificial Sequence: Synthetic oligonucleotide
ucaaggaagauggcauuucu

SEQ ID NO: 571 - RNA, 20 nt, Artificial Sequence
  Description of Artificial Sequence: Synthetic oligonucleotide
ucaaggaagauggcauuucu

SEQ ID NO: 572 - RNA, 20 nt, Artificial Sequence
  Description of Artificial Sequence: Synthetic oligonucleotide
ucaaggaagauggcauuucu

SEQ ID NO: 573 - RNA, 20 nt, Artificial Sequence
  Description of Artificial Sequence: Synthetic oligonucleotide
ucaaggaagauggcauuucu

SEQ ID NO: 574 - RNA, 20 nt, Artificial Sequence
  Description of Artificial Sequence: Synthetic oligonucleotide
ucaaggaagauggcauuucu

SEQ ID NO: 575 - RNA, 20 nt, Artificial Sequence
  Description of Artificial Sequence: Synthetic oligonucleotide
ucaaggaagauggcauuucu

SEQ ID NO: 576 - RNA, 20 nt, Artificial Sequence
  Description of Artificial Sequence: Synthetic oligonucleotide
ucaaggaagauggcauuucu

SEQ ID NO: 577 - RNA, 20 nt, Artificial Sequence
  Description of Artificial Sequence: Synthetic oligonucleotide
ucaaggaagauggcauuucu

SEQ ID NO: 578 - RNA, 20 nt, Artificial Sequence
  Description of Artificial Sequence: Synthetic oligonucleotide
ucaaggaagauggcauuucu

SEQ ID NO: 579 - RNA, 20 nt, Artificial Sequence
  Description of Artificial Sequence: Synthetic oligonucleotide
ucaaggaagauggcauuucu

SEQ ID NO: 580 - RNA, 20 nt, Artificial Sequence
  Description of Artificial Sequence: Synthetic oligonucleotide
ucaaggaagauggcauuucu

SEQ ID NO: 581 - RNA, 20 nt, Artificial Sequence
  Description of Artificial Sequence: Synthetic oligonucleotide
ucaaggaagauggcauuucu

SEQ ID NO: 582 - RNA, 20 nt, Artificial Sequence
  Description of Artificial Sequence: Synthetic oligonucleotide
ucaaggaagauggcauuucu

SEQ ID NO: 583 - RNA, 20 nt, Artificial Sequence
  Description of Artificial Sequence: Synthetic oligonucleotide
ucaaggaagauggcauuucu

SEQ ID NO: 584 - RNA, 20 nt, Artificial Sequence
  Description of Artificial Sequence: Synthetic oligonucleotide
ucaaggaagauggcauuucu

SEQ ID NO: 585 - RNA, 20 nt, Artificial Sequence
  Description of Artificial Sequence: Synthetic oligonucleotide
ucaaggaagauggcauuucu

SEQ ID NO: 586 - RNA, 20 nt, Artificial Sequence
  Description of Artificial Sequence: Synthetic oligonucleotide
ucaaggaagauggcauuucu

SEQ ID NO: 587 - RNA, 20 nt, Artificial Sequence
  Description of Artificial Sequence: Synthetic oligonucleotide
ucaaggaagauggcauuucu

SEQ ID NO: 588 - RNA, 20 nt, Artificial Sequence
  Description of Artificial Sequence: Synthetic oligonucleotide
ucaaggaagauggcauuucu

SEQ ID NO: 589 - RNA, 20 nt, Artificial Sequence
  Description of Artificial Sequence: Synthetic oligonucleotide
ucaaggaagauggcauuucu

SEQ ID NO: 590 - RNA, 20 nt, Artificial Sequence
  Description of Artificial Sequence: Synthetic oligonucleotide
ucaaggaagauggcauuucu

SEQ ID NO: 591 - RNA, 20 nt, Artificial Sequence
  Description of Artificial Sequence: Synthetic oligonucleotide
ucaaggaagauggcauuucu

SEQ ID NO: 592 - RNA, 20 nt, Artificial Sequence
  Description of Artificial Sequence: Synthetic oligonucleotide
ucaaggaagauggcauuucu

SEQ ID NO: 593 - RNA, 20 nt, Artificial Sequence
  Description of Artificial Sequence: Synthetic oligonucleotide
ucaaggaagauggcauuucu

SEQ ID NO: 594 - RNA, 20 nt, Artificial Sequence
  Description of Artificial Sequence: Synthetic oligonucleotide
ucaaggaagauggcauuucu

SEQ ID NO: 595 - RNA, 20 nt, Artificial Sequence
  Description of Artificial Sequence: Synthetic oligonucleotide
ucaaggaagauggcauuucu

SEQ ID NO: 596 - RNA, 19 nt, Artificial Sequence
  Description of Artificial Sequence: Synthetic oligonucleotide
ucaaggaagauggcauuuc

SEQ ID NO: 597 - RNA, 18 nt, Artificial Sequence
  Description of Artificial Sequence: Synthetic oligonucleotide
ucaaggaagauggcauuu

SEQ ID NO: 598 - RNA, 19 nt, Artificial Sequence
  Description of Artificial Sequence: Synthetic oligonucleotide
caaggaagauggcauuucu

SEQ ID NO: 599 - RNA, 20 nt, Artificial Sequence
  Description of Artificial Sequence: Synthetic oligonucleotide
ggccaaaccucggcuuaccu

SEQ ID NO: 600 - RNA, 20 nt, Artificial Sequence
  Description of Artificial Sequence: Synthetic oligonucleotide
ggccaaaccucggcuuaccu

SEQ ID NO: 601 - RNA, 20 nt, Artificial Sequence
  Description of Artificial Sequence: Synthetic oligonucleotide
uucuguaagguuuuuaugug

SEQ ID NO: 602 - RNA, 20 nt, Artificial Sequence
  Description of Artificial Sequence: Synthetic oligonucleotide
auuucuguaagguuuuuaug

SEQ ID NO: 603 - RNA, 20 nt, Artificial Sequence
  Description of Artificial Sequence: Synthetic oligonucleotide
ccauuucuguaagguuuuua

SEQ ID NO: 604 - RNA, 20 nt, Artificial Sequence
  Description of Artificial Sequence: Synthetic oligonucleotide
auccauuucuguaagguuuu

SEQ ID NO: 605 - RNA, 20 nt, Artificial Sequence
  Description of Artificial Sequence: Synthetic oligonucleotide
cauccauuucuguaagguuu

SEQ ID NO: 606 - RNA, 20 nt, Artificial Sequence
  Description of Artificial Sequence: Synthetic oligonucleotide
ccauccauuucuguaagguu

SEQ ID NO: 607 - RNA, 20 nt, Artificial Sequence
  Description of Artificial Sequence: Synthetic oligonucleotide
gccauccauuucuguaaggu

SEQ ID NO: 608 - RNA, 20 nt, Artificial Sequence
  Description of Artificial Sequence: Synthetic oligonucleotide
agccauccauuucuguaagg

SEQ ID NO: 609 - RNA, 20 nt, Artificial Sequence
  Description of Artificial Sequence: Synthetic oligonucleotide
cagccauccauuucuguaag

SEQ ID NO: 610 - RNA, 20 nt, Artificial Sequence
  Description of Artificial Sequence: Synthetic oligonucleotide
ucagccauccauuucuguaa

SEQ ID NO: 611 - RNA, 20 nt, Artificial Sequence
  Description of Artificial Sequence: Synthetic oligonucleotide
uucagccauccauuucugua

SEQ ID NO: 612 - RNA, 20 nt, Artificial Sequence
  Description of Artificial Sequence: Synthetic oligonucleotide
cuucagccauccauuucugu

SEQ ID NO: 613 - RNA, 20 nt, Artificial Sequence
  Description of Artificial Sequence: Synthetic oligonucleotide
acuucagccauccauuucug

SEQ ID NO: 614 - RNA, 20 nt, Artificial Sequence
  Description of Artificial Sequence: Synthetic oligonucleotide
aacuucagccauccauuucu

SEQ ID NO: 615 - RNA, 20 nt, Artificial Sequence
  Description of Artificial Sequence: Synthetic oligonucleotide
caacuucagccauccauuuc

SEQ ID NO: 616 - RNA, 20 nt, Artificial Sequence
  Description of Artificial Sequence: Synthetic oligonucleotide
ucaacuucagccauccauuu

SEQ ID NO: 617 - RNA, 20 nt, Artificial Sequence
  Description of Artificial Sequence: Synthetic oligonucleotide
aucaacuucagccauccauu

SEQ ID NO: 618 - RNA, 20 nt, Artificial Sequence
  Description of Artificial Sequence: Synthetic oligonucleotide
caucaacuucagccauccau

SEQ ID NO: 619 - RNA, 20 nt, Artificial Sequence
  Description of Artificial Sequence: Synthetic oligonucleotide
acaucaacuucagccaucca

SEQ ID NO: 620 - RNA, 20 nt, Artificial Sequence
  Description of Artificial Sequence: Synthetic oligonucleotide
aacaucaacuucagccaucc

SEQ ID NO: 621 - RNA, 20 nt, Artificial Sequence
  Description of Artificial Sequence: Synthetic oligonucleotide
gaaaacaucaacuucagcca

SEQ ID NO: 622 - RNA, 20 nt, Artificial Sequence
  Description of Artificial Sequence: Synthetic oligonucleotide
caggaaaacaucaacuucag

SEQ ID NO: 623 - RNA, 20 nt, Artificial Sequence
  Description of Artificial Sequence: Synthetic oligonucleotide
uuucaggaaaacaucaacuu

SEQ ID NO: 624 - RNA, 20 nt, Artificial Sequence
  Description of Artificial Sequence: Synthetic oligonucleotide
cucuuucaggaaaacaucaa

SEQ ID NO: 625 - RNA, 20 nt, Artificial Sequence
  Description of Artificial Sequence: Synthetic oligonucleotide
uuccucuuucaggaaaacau

SEQ ID NO: 626 - RNA, 20 nt, Artificial Sequence
  Description of Artificial Sequence: Synthetic oligonucleotide
gccauuccucuuucaggaaa

SEQ ID NO: 627 - RNA, 20 nt, Artificial Sequence
  Description of Artificial Sequence: Synthetic oligonucleotide
ggccauuccucuuucaggaa

SEQ ID NO: 628 - RNA, 20 nt, Artificial Sequence
  Description of Artificial Sequence: Synthetic oligonucleotide
aggccauuccucuuucagga

SEQ ID NO: 629 - RNA, 20 nt, Artificial Sequence
  Description of Artificial Sequence: Synthetic oligonucleotide
caggccauuccucuuucagg

SEQ ID NO: 630 - RNA, 20 nt, Artificial Sequence
  Description of Artificial Sequence: Synthetic oligonucleotide
gcaggccauuccucuuucag

SEQ ID NO: 631 - RNA, 20 nt, Artificial Sequence
  Description of Artificial Sequence: Synthetic oligonucleotide
ggcaggccauuccucuuuca

SEQ ID NO: 632 - RNA, 20 nt, Artificial Sequence
  Description of Artificial Sequence: Synthetic oligonucleotide
gggcaggccauuccucuuuc

SEQ ID NO: 633 - RNA, 20 nt, Artificial Sequence
  Description of Artificial Sequence: Synthetic oligonucleotide
agggcaggccauuccucuuu

SEQ ID NO: 634 - RNA, 20 nt, Artificial Sequence
  Description of Artificial Sequence: Synthetic oligonucleotide
cagggcaggccauuccucuu

SEQ ID NO: 635 - RNA, 20 nt, Artificial Sequence
  Description of Artificial Sequence: Synthetic oligonucleotide
ccagggcaggccauuccucu

SEQ ID NO: 636 - RNA, 20 nt, Artificial Sequence
  Description of Artificial Sequence: Synthetic oligonucleotide
cccagggcaggccauuccuc

SEQ ID NO: 637 - RNA, 20 nt, Artificial Sequence
  Description of Artificial Sequence: Synthetic oligonucleotide
ccccagggcaggccauuccu

SEQ ID NO: 638 - RNA, 20 nt, Artificial Sequence
  Description of Artificial Sequence: Synthetic oligonucleotide
cccccagggcaggccauucc

SEQ ID NO: 639 - RNA, 20 nt, Artificial Sequence
  Description of Artificial Sequence: Synthetic oligonucleotide
ucccccagggcaggccauuc

SEQ ID NO: 640 - RNA, 20 nt, Artificial Sequence
  Description of Artificial Sequence: Synthetic oligonucleotide
aucccccagggcaggccauu

SEQ ID NO: 641 - RNA, 20 nt, Artificial Sequence
  Description of Artificial Sequence: Synthetic oligonucleotide
caucccccagggcaggccau

SEQ ID NO: 642 - RNA, 20 nt, Artificial Sequence
  Description of Artificial Sequence: Synthetic oligonucleotide
gcaucccccagggcaggcca

SEQ ID NO: 643 - RNA, 20 nt, Artificial Sequence
  Description of Artificial Sequence: Synthetic oligonucleotide
agcaucccccagggcaggcc

SEQ ID NO: 644 - RNA, 20 nt, Artificial Sequence
  Description of Artificial Sequence: Synthetic oligonucleotide
cagcaucccccagggcaggc

SEQ ID NO: 645 - RNA, 20 nt, Artificial Sequence
  Description of Artificial Sequence: Synthetic oligonucleotide
ucagcaucccccagggcagg

SEQ ID NO: 646 - RNA, 20 nt, Artificial Sequence
  Description of Artificial Sequence: Synthetic oligonucleotide
uucagcaucccccagggcag

SEQ ID NO: 647 - RNA, 20 nt, Artificial Sequence
  Description of Artificial Sequence: Synthetic oligonucleotide
uuucagcaucccccagggca

SEQ ID NO: 648 - RNA, 20 nt, Artificial Sequence
  Description of Artificial Sequence: Synthetic oligonucleotide
auuucagcaucccccagggc

SEQ ID NO: 649 - RNA, 20 nt, Artificial Sequence
  Description of Artificial Sequence: Synthetic oligonucleotide
gauuucagcaucccccaggg

SEQ ID NO: 650 - RNA, 20 nt, Artificial Sequence
  Description of Artificial Sequence: Synthetic oligonucleotide
ggauuucagcaucccccagg

SEQ ID NO: 651 - RNA, 20 nt, Artificial Sequence
  Description of Artificial Sequence: Synthetic oligonucleotide
aggauuucagcaucccccag

SEQ ID NO: 652 - RNA, 20 nt, Artificial Sequence
  Description of Artificial Sequence: Synthetic oligonucleotide
caggauuucagcauccccca

SEQ ID NO: 653 - RNA, 20 nt, Artificial Sequence
  Description of Artificial Sequence: Synthetic oligonucleotide
ucaggauuucagcauccccc

SEQ ID NO: 654 - RNA, 20 nt, Artificial Sequence
  Description of Artificial Sequence: Synthetic oligonucleotide
uucaggauuucagcaucccc

SEQ ID NO: 655 - RNA, 20 nt, Artificial Sequence
  Description of Artificial Sequence: Synthetic oligonucleotide
uuucaggauuucagcauccc

SEQ ID NO: 656 - RNA, 20 nt, Artificial Sequence
  Description of Artificial Sequence: Synthetic oligonucleotide
uuuucaggauuucagcaucc

SEQ ID NO: 657 - RNA, 20 nt, Artificial Sequence
  Description of Artificial Sequence: Synthetic oligonucleotide
uuuuucaggauuucagcauc

SEQ ID NO: 658 - RNA, 20 nt, Artificial Sequence
  Description of Artificial Sequence: Synthetic oligonucleotide
uuuuuucaggauuucagcau

SEQ ID NO: 659 - RNA, 20 nt, Artificial Sequence
  Description of Artificial Sequence: Synthetic oligonucleotide
guuuuuucaggauuucagca

SEQ ID NO: 660 - RNA, 20 nt, Artificial Sequence
  Description of Artificial Sequence: Synthetic oligonucleotide
uguuuuuucaggauuucagc

SEQ ID NO: 661 - RNA, 20 nt, Artificial Sequence
  Description of Artificial Sequence: Synthetic oligonucleotide
cuguuuuuucaggauuucag

SEQ ID NO: 662 - RNA, 20 nt, Artificial Sequence
  Description of Artificial Sequence: Synthetic oligonucleotide
gcuguuuuuucaggauuuca

SEQ ID NO: 663 - RNA, 20 nt, Artificial Sequence
  Description of Artificial Sequence: Synthetic oligonucleotide
agcuguuuuuucaggauuuc

SEQ ID NO: 664 - RNA, 20 nt, Artificial Sequence
  Description of Artificial Sequence: Synthetic oligonucleotide
gagcuguuuuuucaggauuu

SEQ ID NO: 665 - RNA, 20 nt, Artificial Sequence
  Description of Artificial Sequence: Synthetic oligonucleotide
ugagcuguuuuuucaggauu

SEQ ID NO: 666 - RNA, 20 nt, Artificial Sequence
  Description of Artificial Sequence: Synthetic oligonucleotide
uugagcuguuuuuucaggau

SEQ ID NO: 667 - RNA, 20 nt, Artificial Sequence
  Description of Artificial Sequence: Synthetic oligonucleotide
uuugagcuguuuuuucagga

SEQ ID NO: 668 - RNA, 20 nt, Artificial Sequence
  Description of Artificial Sequence: Synthetic oligonucleotide
guuugagcuguuuuuucagg

SEQ ID NO: 669 - RNA, 20 nt, Artificial Sequence
  Description of Artificial Sequence: Synthetic oligonucleotide
uuguuugagcuguuuuuuca

SEQ ID NO: 670 - RNA, 20 nt, Artificial Sequence
  Description of Artificial Sequence: Synthetic oligonucleotide
cauuguuugagcuguuuuuu

SEQ ID NO: 671 - RNA, 20 nt, Artificial Sequence
  Description of Artificial Sequence: Synthetic oligonucleotide
gcauuguuugagcuguuuuu

SEQ ID NO: 672 - RNA, 20 nt, Artificial Sequence
  Description of Artificial Sequence: Synthetic oligonucleotide
ugcauuguuugagcuguuuu

SEQ ID NO: 673 - RNA, 20 nt, Artificial Sequence
  Description of Artificial Sequence: Synthetic oligonucleotide
cugcauuguuugagcuguuu

SEQ ID NO: 674 - RNA, 20 nt, Artificial Sequence
  Description of Artificial Sequence: Synthetic oligonucleotide
ucugcauuguuugagcuguu

SEQ ID NO: 675 - RNA, 20 nt, Artificial Sequence
  Description of Artificial Sequence: Synthetic oligonucleotide
cucugcauuguuugagcugu

SEQ ID NO: 676 - RNA, 20 nt, Artificial Sequence
  Description of Artificial Sequence: Synthetic oligonucleotide
acucugcauuguuugagcug

SEQ ID NO: 677 - RNA, 20 nt, Artificial Sequence
  Description of Artificial Sequence: Synthetic oligonucleotide
uacucugcauuguuugagcu

SEQ ID NO: 678 - RNA, 20 nt, Artificial Sequence
  Description of Artificial Sequence: Synthetic oligonucleotide
uuacucugcauuguuugagc

SEQ ID NO: 679 - RNA, 20 nt, Artificial Sequence
  Description of Artificial Sequence: Synthetic oligonucleotide
cuuacucugcauuguuugag

SEQ ID NO: 680 - RNA, 20 nt, Artificial Sequence
  Description of Artificial Sequence: Synthetic oligonucleotide
ucuuacucugcauuguuuga

SEQ ID NO: 681 - RNA, 20 nt, Artificial Sequence
  Description of Artificial Sequence: Synthetic oligonucleotide
aucuuacucugcauuguuug

SEQ ID NO: 682 - RNA, 20 nt, Artificial Sequence
  Description of Artificial Sequence: Synthetic oligonucleotide
aaucuuacucugcauuguuu

SEQ ID NO: 683 - RNA, 20 nt, Artificial Sequence
  Description of Artificial Sequence: Synthetic oligonucleotide
caaaucuuacucugcauugu

SEQ ID NO: 684 - RNA, 20 nt, Artificial Sequence
  Description of Artificial Sequence: Synthetic oligonucleotide
gauacaaaucuuacucugca

SEQ ID NO: 685 - RNA, 20 nt, Artificial Sequence
  Description of Artificial Sequence: Synthetic oligonucleotide
aauucuuucaacuagaauaa

SEQ ID NO: 686 - RNA, 20 nt, Artificial Sequence
  Description of Artificial Sequence: Synthetic oligonucleotide
ugaauucuuucaacuagaau

SEQ ID NO: 687 - RNA, 20 nt, Artificial Sequence
  Description of Artificial Sequence: Synthetic oligonucleotide
ucugaauucuuucaacuaga

SEQ ID NO: 688 - RNA, 20 nt, Artificial Sequence
  Description of Artificial Sequence: Synthetic oligonucleotide
auucugaauucuuucaacua

SEQ ID NO: 689 - RNA, 20 nt, Artificial Sequence
  Description of Artificial Sequence: Synthetic oligonucleotide
ugauucugaauucuuucaac

SEQ ID NO: 690 - RNA, 20 nt, Artificial Sequence
  Description of Artificial Sequence: Synthetic oligonucleotide
acugauucugaauucuuuca

SEQ ID NO: 691 - RNA, 20 nt, Artificial Sequence
  Description of Artificial Sequence: Synthetic oligonucleotide
ccacugauucugaauucuuu

SEQ ID NO: 692 - RNA, 20 nt, Artificial Sequence
  Description of Artificial Sequence: Synthetic oligonucleotide
ucccacugauucugaauucu

SEQ ID NO: 693 - RNA, 20 nt, Artificial Sequence
  Description of Artificial Sequence: Synthetic oligonucleotide
caucccacugauucugaauu

SEQ ID NO: 694 - RNA, 20 nt, Artificial Sequence
  Description of Artificial Sequence: Synthetic oligonucleotide
uucaucccacugauucugaa

SEQ ID NO: 695 - RNA, 20 nt, Artificial Sequence
  Description of Artificial Sequence: Synthetic oligonucleotide
acuucaucccacugauucug

SEQ ID NO: 696 - RNA, 20 nt, Artificial Sequence
  Description of Artificial Sequence: Synthetic oligonucleotide
guacuucaucccacugauuc

SEQ ID NO: 697 - RNA, 20 nt, Artificial Sequence
  Description of Artificial Sequence: Synthetic oligonucleotide
uuguacuucaucccacugau

SEQ ID NO: 698 - RNA, 20 nt, Artificial Sequence
  Description of Artificial Sequence: Synthetic oligonucleotide
ucuuguacuucaucccacug

SEQ ID NO: 699 - RNA, 20 nt, Artificial Sequence
  Description of Artificial Sequence: Synthetic oligonucleotide
guucuuguacuucaucccac

SEQ ID NO: 700 - RNA, 20 nt, Artificial Sequence
  Description of Artificial Sequence: Synthetic oligonucleotide
guguucuuguacuucauccc

SEQ ID NO: 701 - RNA, 20 nt, Artificial Sequence
  Description of Artificial Sequence: Synthetic oligonucleotide
agguguucuuguacuucauc

SEQ ID NO: 702 - RNA, 20 nt, Artificial Sequence
  Description of Artificial Sequence: Synthetic oligonucleotide
gaagguguucuuguacuuca

SEQ ID NO: 703 - RNA, 20 nt, Artificial Sequence
  Description of Artificial Sequence: Synthetic oligonucleotide
cugaagguguucuuguacuu

SEQ ID NO: 704 - RNA, 20 nt, Artificial Sequence
  Description of Artificial Sequence: Synthetic oligonucleotide
uucugaagguguucuuguac

SEQ ID NO: 705 - RNA, 20 nt, Artificial Sequence
  Description of Artificial Sequence: Synthetic oligonucleotide
gguucugaagguguucuugu

SEQ ID NO: 706 - RNA, 20 nt, Artificial Sequence
  Description of Artificial Sequence: Synthetic oligonucleotide
ccgguucugaagguguucuu

SEQ ID NO: 707 - RNA, 20 nt, Artificial Sequence
  Description of Artificial Sequence: Synthetic oligonucleotide
cuccgguucugaagguguuc

SEQ ID NO: 708 - RNA, 20 nt, Artificial Sequence
  Description of Artificial Sequence: Synthetic oligonucleotide
gccuccgguucugaaggugu

SEQ ID NO: 709 - RNA, 20 nt, Artificial Sequence
  Description of Artificial Sequence: Synthetic oligonucleotide
uugccuccgguucugaaggu

SEQ ID NO: 710 - RNA, 20 nt, Artificial Sequence
  Description of Artificial Sequence: Synthetic oligonucleotide
uguugccuccgguucugaag

SEQ ID NO: 711 - RNA, 20 nt, Artificial Sequence
  Description of Artificial Sequence: Synthetic oligonucleotide
acuguugccuccgguucuga

SEQ ID NO: 712 - RNA, 20 nt, Artificial Sequence
  Description of Artificial Sequence: Synthetic oligonucleotide
caacuguugccuccgguucu

SEQ ID NO: 713 - RNA, 20 nt, Artificial Sequence
  Description of Artificial Sequence: Synthetic oligonucleotide
uucaacuguugccuccgguu

SEQ ID NO: 714 - RNA, 20 nt, Artificial Sequence
  Description of Artificial Sequence: Synthetic oligonucleotide
cauucaacuguugccuccgg

SEQ ID NO: 715 - RNA, 20 nt, Artificial Sequence
  Description of Artificial Sequence: Synthetic oligonucleotide
uucauucaacuguugccucc

SEQ ID NO: 716 - RNA, 20 nt, Artificial Sequence
  Description of Artificial Sequence: Synthetic oligonucleotide
auuucauucaacuguugccu

SEQ ID NO: 717 - RNA, 20 nt, Artificial Sequence
  Description of Artificial Sequence: Synthetic oligonucleotide
auccuuuaacauuucauuca

SEQ ID NO: 718 - RNA, 20 nt, Artificial Sequence
  Description of Artificial Sequence: Synthetic oligonucleotide
gaauccuuuaacauuucauu

SEQ ID NO: 719 - RNA, 20 nt, Artificial Sequence
  Description of Artificial Sequence: Synthetic oligonucleotide
uugaauccuuuaacauuuca

SEQ ID NO: 720 - RNA, 20 nt, Artificial Sequence
  Description of Artificial Sequence: Synthetic oligonucleotide
uguugaauccuuuaacauuu

SEQ ID NO: 721 - RNA, 20 nt, Artificial Sequence
  Description of Artificial Sequence: Synthetic oligonucleotide
uguguugaauccuuuaacau

SEQ ID NO: 722 - RNA, 20 nt, Artificial Sequence
  Description of Artificial Sequence: Synthetic oligonucleotide
auuguguugaauccuuuaac

SEQ ID NO: 723 - RNA, 20 nt, Artificial Sequence
  Description of Artificial Sequence: Synthetic oligonucleotide
ccauuguguugaauccuuua

SEQ ID NO: 724 - RNA, 20 nt, Artificial Sequence
  Description of Artificial Sequence: Synthetic oligonucleotide
agccauuguguugaauccuu

SEQ ID NO: 725 - RNA, 20 nt, Artificial Sequence
  Description of Artificial Sequence: Synthetic oligonucleotide
ccagccauuguguugaaucc

SEQ ID NO: 726 - RNA, 20 nt, Artificial Sequence
  Description of Artificial Sequence: Synthetic oligonucleotide
uuccagccauuguguugaau

SEQ ID NO: 727 - RNA, 20 nt, Artificial Sequence
  Description of Artificial Sequence: Synthetic oligonucleotide
gcuuccagccauuguguuga

SEQ ID NO: 728 - RNA, 20 nt, Artificial Sequence
  Description of Artificial Sequence: Synthetic oligonucleotide
uagcuuccagccauuguguu

SEQ ID NO: 729 - RNA, 20 nt, Artificial Sequence
  Description of Artificial Sequence: Synthetic oligonucleotide
cuuagcuuccagccauugug

SEQ ID NO: 730 - RNA, 20 nt, Artificial Sequence
  Description of Artificial Sequence: Synthetic oligonucleotide
uccuuagcuuccagccauug

SEQ ID NO: 731 - RNA, 20 nt, Artificial Sequence
  Description of Artificial Sequence: Synthetic oligonucleotide
cuuccuuagcuuccagccau

SEQ ID NO: 732 - RNA, 20 nt, Artificial Sequence
  Description of Artificial Sequence: Synthetic oligonucleotide
uucuuccuuagcuuccagcc

SEQ ID NO: 733 - RNA, 20 nt, Artificial Sequence
  Description of Artificial Sequence: Synthetic oligonucleotide
gcuucuuccuuagcuuccag

SEQ ID NO: 734 - RNA, 20 nt, Artificial Sequence
  Description of Artificial Sequence: Synthetic oligonucleotide
cagcuucuuccuuagcuucc

SEQ ID NO: 735 - RNA, 20 nt, Artificial Sequence
  Description of Artificial Sequence: Synthetic oligonucleotide
cucagcuucuuccuuagcuu

SEQ ID NO: 736 - RNA, 20 nt, Artificial Sequence
  Description of Artificial Sequence: Synthetic oligonucleotide
cugcucagcuucuuccuuag

SEQ ID NO: 737 - RNA, 20 nt, Artificial Sequence
  Description of Artificial Sequence: Synthetic oligonucleotide
accugcucagcuucuuccuu

SEQ ID NO: 738 - RNA, 20 nt, Artificial Sequence
  Description of Artificial Sequence: Synthetic oligonucleotide
agaccugcucagcuucuucc

SEQ ID NO: 739 - RNA, 20 nt, Artificial Sequence
  Description of Artificial Sequence: Synthetic oligonucleotide
uaagaccugcucagcuucuu

SEQ ID NO: 740 - RNA, 20 nt, Artificial Sequence
  Description of Artificial Sequence: Synthetic oligonucleotide
ccuaagaccugcucagcuuc

SEQ ID NO: 741 - RNA, 20 nt, Artificial Sequence
  Description of Artificial Sequence: Synthetic oligonucleotide
guccuaagaccugcucagcu

SEQ ID NO: 742 - RNA, 20 nt, Artificial Sequence
  Description of Artificial Sequence: Synthetic oligonucleotide
cuguccuaagaccugcucag

SEQ ID NO: 743 - RNA, 20 nt, Artificial Sequence
  Description of Artificial Sequence: Synthetic oligonucleotide
ggccuguccuaagaccugcu

SEQ ID NO: 744 - RNA, 20 nt, Artificial Sequence
  Description of Artificial Sequence: Synthetic oligonucleotide
cuggccuguccuaagaccug

SEQ ID NO: 745 - RNA, 20 nt, Artificial Sequence
  Description of Artificial Sequence: Synthetic oligonucleotide
cucuggccuguccuaagacc

SEQ ID NO: 746 - RNA, 20 nt, Artificial Sequence
  Description of Artificial Sequence: Synthetic oligonucleotide
ggcucuggccuguccuaaga

SEQ ID NO: 747 - RNA, 20 nt, Artificial Sequence
  Description of Artificial Sequence: Synthetic oligonucleotide
uuggcucuggccuguccuaa

SEQ ID NO: 748 - RNA, 20 nt, Artificial Sequence
  Description of Artificial Sequence: Synthetic oligonucleotide
gcuuggcucuggccuguccu

SEQ ID NO: 749 - RNA, 20 nt, Artificial Sequence
  Description of Artificial Sequence: Synthetic oligonucleotide
aagcuuggcucuggccuguc

SEQ ID NO: 750 - RNA, 20 nt, Artificial Sequence
  Description of Artificial Sequence: Synthetic oligonucleotide
ucaagcuuggcucuggccug

SEQ ID NO: 751 - RNA, 20 nt, Artificial Sequence
  Description of Artificial Sequence: Synthetic oligonucleotide
uccuuccaugacucaagcuu

SEQ ID NO: 752 - RNA, 20 nt, Artificial Sequence
  Description of Artificial Sequence: Synthetic oligonucleotide
ccuccuuccaugacucaagc

SEQ ID NO: 753 - RNA, 20 nt, Artificial Sequence
  Description of Artificial Sequence: Synthetic oligonucleotide
acccuccuuccaugacucaa

SEQ ID NO: 754 - RNA, 20 nt, Artificial Sequence
  Description of Artificial Sequence: Synthetic oligonucleotide
ggacccuccuuccaugacuc

SEQ ID NO: 755 - RNA, 20 nt, Artificial Sequence
  Description of Artificial Sequence: Synthetic oligonucleotide
agggacccuccuuccaugac

SEQ ID NO: 756 - RNA, 20 nt, Artificial Sequence
  Description of Artificial Sequence: Synthetic oligonucleotide
auagggacccuccuuccaug

SEQ ID NO: 757 - RNA, 20 nt, Artificial Sequence
  Description of Artificial Sequence: Synthetic oligonucleotide
guauagggacccuccuucca

SEQ ID NO: 758 - RNA, 20 nt, Artificial Sequence
  Description of Artificial Sequence: Synthetic oligonucleotide
cuguauagggacccuccuuc

SEQ ID NO: 759 - RNA, 20 nt, Artificial Sequence
  Description of Artificial Sequence: Synthetic oligonucleotide
uacuguauagggacccuccu

SEQ ID NO: 760 - RNA, 20 nt, Artificial Sequence
  Description of Artificial Sequence: Synthetic oligonucleotide
ucuacuguauagggacccuc

SEQ ID NO: 761 - RNA, 20 nt, Artificial Sequence
  Description of Artificial Sequence: Synthetic oligonucleotide
caucuacuguauagggaccc

SEQ ID NO: 762 - RNA, 20 nt, Artificial Sequence
  Description of Artificial Sequence: Synthetic oligonucleotide
ugcaucuacuguauagggac

SEQ ID NO: 763 - RNA, 20 nt, Artificial Sequence
  Description of Artificial Sequence: Synthetic oligonucleotide
auugcaucuacuguauaggg

SEQ ID NO: 764 - RNA, 20 nt, Artificial Sequence
  Description of Artificial Sequence: Synthetic oligonucleotide
ggauugcaucuacuguauag

SEQ ID NO: 765 - RNA, 20 nt, Artificial Sequence
  Description of Artificial Sequence: Synthetic oligonucleotide
uuggauugcaucuacuguau

SEQ ID NO: 766 - RNA, 20 nt, Artificial Sequence
  Description of Artificial Sequence: Synthetic oligonucleotide
uuuuggauugcaucuacugu

SEQ ID NO: 767 - RNA, 20 nt, Artificial Sequence
  Description of Artificial Sequence: Synthetic oligonucleotide
ucuuuuggauugcaucuacu

SEQ ID NO: 768 - RNA, 20 nt, Artificial Sequence
  Description of Artificial Sequence: Synthetic oligonucleotide
uuucuuuuggauugcaucua

SEQ ID NO: 769 - RNA, 20 nt, Artificial Sequence
  Description of Artificial Sequence: Synthetic oligonucleotide
auuuucuuuuggauugcauc

SEQ ID NO: 770 - RNA, 20 nt, Artificial Sequence
  Description of Artificial Sequence: Synthetic oligonucleotide
ugauuuucuuuuggauugca

SEQ ID NO: 771 - RNA, 20 nt, Artificial Sequence
  Description of Artificial Sequence: Synthetic oligonucleotide
ugugauuuucuuuuggauug

SEQ ID NO: 772 - RNA, 20 nt, Artificial Sequence
  Description of Artificial Sequence: Synthetic oligonucleotide
ucugugauuuucuuuuggau

SEQ ID NO: 773 - RNA, 20 nt, Artificial Sequence
  Description of Artificial Sequence: Synthetic oligonucleotide
uuucugugauuuucuuuugg

SEQ ID NO: 774 - RNA, 20 nt, Artificial Sequence
  Description of Artificial Sequence: Synthetic oligonucleotide
gguuucugugauuuucuuuu

SEQ ID NO: 775 - RNA, 20 nt, Artificial Sequence
  Description of Artificial Sequence: Synthetic oligonucleotide
uugguuucugugauuuucuu

SEQ ID NO: 776 - RNA, 20 nt, Artificial Sequence
  Description of Artificial Sequence: Synthetic oligonucleotide
ccuugguuucugugauuuuc

SEQ ID NO: 777 - RNA, 20 nt, Artificial Sequence
  Description of Artificial Sequence: Synthetic oligonucleotide
aaccuugguuucugugauuu

SEQ ID NO: 778 - RNA, 20 nt, Artificial Sequence
  Description of Artificial Sequence: Synthetic oligonucleotide
cuaaccuugguuucugugau

SEQ ID NO: 779 - RNA, 20 nt, Artificial Sequence
  Description of Artificial Sequence: Synthetic oligonucleotide
uacuaaccuugguuucugug

SEQ ID NO: 780 - RNA, 20 nt, Artificial Sequence
  Description of Artificial Sequence: Synthetic oligonucleotide
gauacuaaccuugguuucug

SEQ ID NO: 781 - RNA, 20 nt, Artificial Sequence
  Description of Artificial Sequence: Synthetic oligonucleotide
ucaaggaagauggcauuucu

SEQ ID NO: 782 - RNA, 20 nt, Artificial Sequence
  Description of Artificial Sequence: Synthetic oligonucleotide
ggccaaaccucggcuuaccu

SEQ ID NO: 783 - RNA, 20 nt, Artificial Sequence
  Description of Artificial Sequence: Synthetic oligonucleotide
ucaaggaagauggcauuucu

SEQ ID NO: 784 - RNA, 20 nt, Artificial Sequence
  Description of Artificial Sequence: Synthetic oligonucleotide
ucaaggaagauggcauuucu

SEQ ID NO: 785 - RNA, 20 nt, Artificial Sequence
  Description of Artificial Sequence: Synthetic oligonucleotide
ucaaggaagauggcauuucu

SEQ ID NO: 786 - RNA, 20 nt, Artificial Sequence
  Description of Artificial Sequence: Synthetic oligonucleotide
ucaaggaagauggcauuucu

SEQ ID NO: 787 - RNA, 20 nt, Artificial Sequence
  Description of Artificial Sequence: Synthetic oligonucleotide
ucaaggaagauggcauuucu

SEQ ID NO: 788 - RNA, 20 nt, Artificial Sequence
  Description of Artificial Sequence: Synthetic oligonucleotide
ucaaggaagauggcauuucu

SEQ ID NO: 789 - RNA, 20 nt, Artificial Sequence
  Description of Artificial Sequence: Synthetic oligonucleotide
ucaaggaagauggcauuucu

SEQ ID NO: 790 - RNA, 20 nt, Artificial Sequence
  Description of Artificial Sequence: Synthetic oligonucleotide
ccuucccugaagguuccucc

SEQ ID NO: 791 - RNA, 20 nt, Artificial Sequence
  Description of Artificial Sequence: Synthetic oligonucleotide
ccuucccugaagguuccucc

SEQ ID NO: 792 - RNA, 20 nt, Artificial Sequence
  Description of Artificial Sequence: Synthetic oligonucleotide
ucaaggaagauggcauuucu

SEQ ID NO: 793 - RNA, 20 nt, Artificial Sequence
  Description of Artificial Sequence: Synthetic oligonucleotide
ucaaggaagauggcauuucu

SEQ ID NO: 794 - RNA, 20 nt, Artificial Sequence
  Description of Artificial Sequence: Synthetic oligonucleotide
ccuucccugaagguuccucc

SEQ ID NO: 795 - RNA, 20 nt, Artificial Sequence
  Description of Artificial Sequence: Synthetic oligonucleotide
ccuucccugaagguuccucc

SEQ ID NO: 796 - RNA, 20 nt, Artificial Sequence
  Description of Artificial Sequence: Synthetic oligonucleotide
ucaaggaagauggcauuucu

SEQ ID NO: 797 - RNA, 20 nt, Artificial Sequence
  Description of Artificial Sequence: Synthetic oligonucleotide
ucaaggaagauggcauuucu

SEQ ID NO: 798 - RNA, 20 nt, Artificial Sequence
  Description of Artificial Sequence: Synthetic oligonucleotide
ucaaggaagauggcauuucu

SEQ ID NO: 799 - RNA, 20 nt, Artificial Sequence
  Description of Artificial Sequence: Synthetic oligonucleotide
ucaaggaagauggcauuucu

SEQ ID NO: 800 - RNA, 20 nt, Artificial Sequence
  Description of Artificial Sequence: Synthetic oligonucleotide
ucaaggaagauggcauuucu

SEQ ID NO: 801 - RNA, 20 nt, Artificial Sequence
  Description of Artificial Sequence: Synthetic oligonucleotide
ucaaggaagauggcauuucu

SEQ ID NO: 802 - RNA, 20 nt, Artificial Sequence
  Description of Artificial Sequence: Synthetic oligonucleotide
ucaaggaagauggcauuucu

SEQ ID NO: 803 - RNA, 20 nt, Artificial Sequence
  Description of Artificial Sequence: Synthetic oligonucleotide
ucaaggaagauggcauuucu

SEQ ID NO: 804 - RNA, 20 nt, Artificial Sequence
  Description of Artificial Sequence: Synthetic oligonucleotide
ucaaggaagauggcauuucu

SEQ ID NO: 805 - RNA, 20 nt, Artificial Sequence
  Description of Artificial Sequence: Synthetic oligonucleotide
ucaaggaagauggcauuucu

SEQ ID NO: 806 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 807 - RNA, 20 nt, Artificial Sequence
  Description of Artificial Sequence: Synthetic oligonucleotide
ucaaggaagauggcauuucu

SEQ ID NO: 808 - RNA, 20 nt, Artificial Sequence
  Description of Artificial Sequence: Synthetic oligonucleotide
ucaaggaagauggcauuucu

SEQ ID NO: 809 - RNA, 20 nt, Artificial Sequence
  Description of Artificial Sequence: Synthetic oligonucleotide
ucaaggaagauggcauuucu

SEQ ID NO: 810 - RNA, 20 nt, Artificial Sequence
  Description of Artificial Sequence: Synthetic oligonucleotide
ucaaggaagauggcauuucu

SEQ ID NO: 811 - RNA, 20 nt, Artificial Sequence
  Description of Artificial Sequence: Synthetic oligonucleotide
ucaaggaagauggcauuucu

SEQ ID NO: 812 - RNA, 20 nt, Artificial Sequence
  Description of Artificial Sequence: Synthetic oligonucleotide
ucaaggaagauggcauuucu

SEQ ID NO: 813 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 814 - RNA, 20 nt, Artificial Sequence
  Description of Artificial Sequence: Synthetic oligonucleotide
ucaaggaagauggcauuucu

SEQ ID NO: 815 - RNA, 20 nt, Artificial Sequence
  Description of Artificial Sequence: Synthetic oligonucleotide
ucaaggaagauggcauuucu

SEQ ID NO: 816 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuucu

SEQ ID NO: 817 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautucu

SEQ ID NO: 818 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 819 - RNA, 20 nt, Artificial Sequence
  Description of Artificial Sequence: Synthetic oligonucleotide
ucaaggaagauggcauuucu

SEQ ID NO: 820 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauuuct

SEQ ID NO: 821 - RNA, 20 nt, Artificial Sequence
  Description of Artificial Sequence: Synthetic oligonucleotide
ucaaggaagauggcauuucu

SEQ ID NO: 822 - RNA, 20 nt, Artificial Sequence
  Description of Artificial Sequence: Synthetic oligonucleotide
ucaaggaagauggcauuucu

SEQ ID NO: 823 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 824 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuutu

SEQ ID NO: 825 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 826 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautuct

SEQ ID NO: 827 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuutu

SEQ ID NO: 828 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 829 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautuct

SEQ ID NO: 830 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuutu

SEQ ID NO: 831 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 832 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautuct

SEQ ID NO: 833 - DNA, 20 bp, Artificial Sequence
  Description of Artificial Sequence: Synthetic oligonucleotide
  Description of Combined DNA/RNA Molecule: Synthetic oligonucleotide
tcaaggaagauggcatuutu

SEQ ID NO: 834 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauutcu

SEQ ID NO: 835 - DNA, 20 bp, Artificial Sequence
  Description of Artificial Sequence: Synthetic oligonucleotide
  Description of Combined DNA/RNA Molecule: Synthetic oligonucleotide
tcaaggaagauggcautuct

SEQ ID NO: 836 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 837 - RNA, 20 nt, Artificial Sequence
  Description of Artificial Sequence: Synthetic oligonucleotide
ucaaggaagauggcauuucu

SEQ ID NO: 838 - RNA, 20 nt, Artificial Sequence
  Description of Artificial Sequence: Synthetic oligonucleotide
ucaaggaagauggcauuucu

SEQ ID NO: 839 - RNA, 20 nt, Artificial Sequence
  Description of Artificial Sequence: Synthetic oligonucleotide
ucaaggaagauggcauuucu

SEQ ID NO: 840 - RNA, 20 nt, Artificial Sequence
  Description of Artificial Sequence: Synthetic oligonucleotide
ucaaggaagauggcauuucu

SEQ ID NO: 841 - RNA, 20 nt, Artificial Sequence
  Description of Artificial Sequence: Synthetic oligonucleotide
ucaaggaagauggcauuucu

SEQ ID NO: 842 - RNA, 20 nt, Artificial Sequence
  Description of Artificial Sequence: Synthetic oligonucleotide
ucaaggaagauggcauuucu

SEQ ID NO: 843 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 844 - RNA, 20 nt, Artificial Sequence
  Description of Artificial Sequence: Synthetic oligonucleotide
ucaaggaagauggcauuucu

SEQ ID NO: 845 - RNA, 20 nt, Artificial Sequence
  Description of Artificial Sequence: Synthetic oligonucleotide
ucaaggaagauggcauuucu

SEQ ID NO: 846 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuucu

SEQ ID NO: 847 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautucu

SEQ ID NO: 848 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 849 - RNA, 20 nt, Artificial Sequence
  Description of Artificial Sequence: Synthetic oligonucleotide
ucaaggaagauggcauuucu

SEQ ID NO: 850 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauuuct

SEQ ID NO: 851 - RNA, 20 nt, Artificial Sequence
  Description of Artificial Sequence: Synthetic oligonucleotide
ucaaggaagauggcauuucu

SEQ ID NO: 852 - RNA, 20 nt, Artificial Sequence
  Description of Artificial Sequence: Synthetic oligonucleotide
ucaaggaagauggcauuucu

SEQ ID NO: 853 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 854 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuutu

SEQ ID NO: 855 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 856 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautuct

SEQ ID NO: 857 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuutu

SEQ ID NO: 858 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 859 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautuct

SEQ ID NO: 860 - DNA, 20 bp, Artificial Sequence
  Description of Artificial Sequence: Synthetic oligonucleotide
  Description of Combined DNA/RNA Molecule: Synthetic oligonucleotide
ucaaggaagauggcatuutu

SEQ ID NO: 861 - DNA, 20 bp, Artificial Sequence
  Description of Artificial Sequence: Synthetic oligonucleotide
  Description of Combined DNA/RNA Molecule: Synthetic oligonucleotide
ucaaggaagauggcauutcu

SEQ ID NO: 862 - DNA, 20 bp, Artificial Sequence
  Description of Artificial Sequence: Synthetic oligonucleotide
  Description of Combined DNA/RNA Molecule: Synthetic oligonucleotide
ucaaggaagauggcautuct

SEQ ID NO: 863 - DNA, 20 bp, Artificial Sequence
  Description of Artificial Sequence: Synthetic oligonucleotide
  Description of Combined DNA/RNA Molecule: Synthetic oligonucleotide
tcaaggaagauggcatuutu

SEQ ID NO: 864 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauutcu

SEQ ID NO: 865 - DNA, 20 bp, Artificial Sequence
  Description of Artificial Sequence: Synthetic oligonucleotide
  Description of Combined DNA/RNA Molecule: Synthetic oligonucleotide
tcaaggaagauggcautuct

SEQ ID NO: 866 - RNA, 20 nt, Artificial Sequence
  Description of Artificial Sequence: Synthetic oligonucleotide
ucaaggaagauggcauuucu

SEQ ID NO: 867 - RNA, 20 nt, Artificial Sequence
  Description of Artificial Sequence: Synthetic oligonucleotide
ucaaggaagauggcauuucu

SEQ ID NO: 868 - RNA, 20 nt, Artificial Sequence
  Description of Artificial Sequence: Synthetic oligonucleotide
ucaaggaagauggcauuucu

SEQ ID NO: 869 - RNA, 20 nt, Artificial Sequence
  Description of Artificial Sequence: Synthetic oligonucleotide
ucaaggaagauggcauuucu

SEQ ID NO: 870 - RNA, 20 nt, Artificial Sequence
  Description of Artificial Sequence: Synthetic oligonucleotide
ucaaggaagauggcauuucu

SEQ ID NO: 871 - RNA, 20 nt, Artificial Sequence
  Description of Artificial Sequence: Synthetic oligonucleotide
ucaaggaagauggcauuucu

SEQ ID NO: 872 - RNA, 20 nt, Artificial Sequence
  Description of Artificial Sequence: Synthetic oligonucleotide
cuuuaacauuucauucaacu

SEQ ID NO: 873 - RNA, 20 nt, Artificial Sequence
  Description of Artificial Sequence: Synthetic oligonucleotide
uuaacauuucauucaacugu

SEQ ID NO: 874 - RNA, 20 nt, Artificial Sequence
  Description of Artificial Sequence: Synthetic oligonucleotide
aacauuucauucaacuguug

SEQ ID NO: 875 - RNA, 20 nt, Artificial Sequence
  Description of Artificial Sequence: Synthetic oligonucleotide
cauuucauucaacuguuguc

SEQ ID NO: 876 - RNA, 20 nt, Artificial Sequence
  Description of Artificial Sequence: Synthetic oligonucleotide
uuucauucaacuguugucuc

SEQ ID NO: 877 - RNA, 20 nt, Artificial Sequence
  Description of Artificial Sequence: Synthetic oligonucleotide
ucauucaacuguugucuccu

SEQ ID NO: 878 - RNA, 20 nt, Artificial Sequence
  Description of Artificial Sequence: Synthetic oligonucleotide
auucaacuguugucuccugu

SEQ ID NO: 879 - RNA, 20 nt, Artificial Sequence
  Description of Artificial Sequence: Synthetic oligonucleotide
ucaacuguugucuccuguuc

SEQ ID NO: 880 - RNA, 20 nt, Artificial Sequence
  Description of Artificial Sequence: Synthetic oligonucleotide
aacuguugucuccuguucug

SEQ ID NO: 881 - RNA, 20 nt, Artificial Sequence
  Description of Artificial Sequence: Synthetic oligonucleotide
cuguugucuccuguucugca

SEQ ID NO: 882 - RNA, 20 nt, Artificial Sequence
  Description of Artificial Sequence: Synthetic oligonucleotide
guugucuccuguucugcagc

SEQ ID NO: 883 - RNA, 20 nt, Artificial Sequence
  Description of Artificial Sequence: Synthetic oligonucleotide
ugucuccuguucugcagcug

SEQ ID NO: 884 - RNA, 20 nt, Artificial Sequence
  Description of Artificial Sequence: Synthetic oligonucleotide
ucuccuguucugcagcuguu

SEQ ID NO: 885 - RNA, 20 nt, Artificial Sequence
  Description of Artificial Sequence: Synthetic oligonucleotide
uccuguucugcagcuguucu

SEQ ID NO: 886 - RNA, 20 nt, Artificial Sequence
  Description of Artificial Sequence: Synthetic oligonucleotide
cuguucugcagcuguucuug

SEQ ID NO: 887 - RNA, 20 nt, Artificial Sequence
  Description of Artificial Sequence: Synthetic oligonucleotide
guucugcagcuguucuugaa

SEQ ID NO: 888 - RNA, 20 nt, Artificial Sequence
  Description of Artificial Sequence: Synthetic oligonucleotide
ucugcagcuguucuugaacc

SEQ ID NO: 889 - RNA, 20 nt, Artificial Sequence
  Description of Artificial Sequence: Synthetic oligonucleotide
ugcagcuguucuugaaccuc

SEQ ID NO: 890 - RNA, 20 nt, Artificial Sequence
  Description of Artificial Sequence: Synthetic oligonucleotide
uguucuugaaccucauccca

SEQ ID NO: 891 - RNA, 20 nt, Artificial Sequence
  Description of Artificial Sequence: Synthetic oligonucleotide
cagcuguucuugaaccucau

SEQ ID NO: 892 - RNA, 20 nt, Artificial Sequence
  Description of Artificial Sequence: Synthetic oligonucleotide
gcuguucuugaaccucaucc

SEQ ID NO: 893 - RNA, 20 nt, Artificial Sequence
  Description of Artificial Sequence: Synthetic oligonucleotide
ucaaggaagauggcauuucu

SEQ ID NO: 894 - RNA, 20 nt, Artificial Sequence
  Description of Artificial Sequence: Synthetic oligonucleotide
ucaaggaagauggcauuucu

SEQ ID NO: 895 - RNA, 20 nt, Artificial Sequence
  Description of Artificial Sequence: Synthetic oligonucleotide
ucaaggaagauggcauuucu

SEQ ID NO: 896 - RNA, 20 nt, Artificial Sequence
  Description of Artificial Sequence: Synthetic oligonucleotide
ucaaggaagauggcauuucu

SEQ ID NO: 897 - RNA, 20 nt, Artificial Sequence
  Description of Artificial Sequence: Synthetic oligonucleotide
ucaaggaagauggcauuucu

SEQ ID NO: 898 - RNA, 20 nt, Artificial Sequence
  Description of Artificial Sequence: Synthetic oligonucleotide
ucaaggaagauggcauuucu

SEQ ID NO: 899 - RNA, 20 nt, Artificial Sequence
  Description of Artificial Sequence: Synthetic oligonucleotide
ccuucccugaagguuccucc

SEQ ID NO: 900 - RNA, 20 nt, Artificial Sequence
  Description of Artificial Sequence: Synthetic oligonucleotide
ccuucccugaagguuccucc

SEQ ID NO: 901 - RNA, 20 nt, Artificial Sequence
  Description of Artificial Sequence: Synthetic oligonucleotide
ucaaggaagauggcauuucu

SEQ ID NO: 902 - RNA, 20 nt, Artificial Sequence
  Description of Artificial Sequence: Synthetic oligonucleotide
gccauuuuguugcucuuuca

SEQ ID NO: 903 - RNA, 20 nt, Artificial Sequence
  Description of Artificial Sequence: Synthetic oligonucleotide
agccauuuuguugcucuuuc

SEQ ID NO: 904 - RNA, 20 nt, Artificial Sequence
  Description of Artificial Sequence: Synthetic oligonucleotide
aagccauuuuguugcucuuu

SEQ ID NO: 905 - RNA, 20 nt, Artificial Sequence
  Description of Artificial Sequence: Synthetic oligonucleotide
uugaagccauuuuguugcuc

SEQ ID NO: 906 - RNA, 20 nt, Artificial Sequence
  Description of Artificial Sequence: Synthetic oligonucleotide
uaguugaagccauuuuguug

SEQ ID NO: 907 - RNA, 20 nt, Artificial Sequence
  Description of Artificial Sequence: Synthetic oligonucleotide
agauaguugaagccauuuug

SEQ ID NO: 908 - RNA, 20 nt, Artificial Sequence
  Description of Artificial Sequence: Synthetic oligonucleotide
cucagauaguugaagccauu

SEQ ID NO: 909 - RNA, 20 nt, Artificial Sequence
  Description of Artificial Sequence: Synthetic oligonucleotide
ucacucagauaguugaagcc

SEQ ID NO: 910 - RNA, 20 nt, Artificial Sequence
  Description of Artificial Sequence: Synthetic oligonucleotide
gugucacucagauaguugaa

SEQ ID NO: 911 - RNA, 20 nt, Artificial Sequence
  Description of Artificial Sequence: Synthetic oligonucleotide
acagugucacucagauaguu

SEQ ID NO: 912 - RNA, 20 nt, Artificial Sequence
  Description of Artificial Sequence: Synthetic oligonucleotide
cacagugucacucagauagu

SEQ ID NO: 913 - RNA, 20 nt, Artificial Sequence
  Description of Artificial Sequence: Synthetic oligonucleotide
cuucacagugucacucagau

SEQ ID NO: 914 - RNA, 20 nt, Artificial Sequence
  Description of Artificial Sequence: Synthetic oligonucleotide
ccuucacagugucacucaga

SEQ ID NO: 915 - RNA, 20 nt, Artificial Sequence
  Description of Artificial Sequence: Synthetic oligonucleotide
cuccuucacagugucacuca

SEQ ID NO: 916 - RNA, 20 nt, Artificial Sequence
  Description of Artificial Sequence: Synthetic oligonucleotide
aucuccuucacagugucacu

SEQ ID NO: 917 - RNA, 20 nt, Artificial Sequence
  Description of Artificial Sequence: Synthetic oligonucleotide
ccaucuccuucacaguguca

SEQ ID NO: 918 - RNA, 20 nt, Artificial Sequence
  Description of Artificial Sequence: Synthetic oligonucleotide
ggccaucuccuucacagugu

SEQ ID NO: 919 - RNA, 20 nt, Artificial Sequence
  Description of Artificial Sequence: Synthetic oligonucleotide
uuggccaucuccuucacagu

SEQ ID NO: 920 - RNA, 20 nt, Artificial Sequence
  Description of Artificial Sequence: Synthetic oligonucleotide
ucuuggccaucuccuucaca

SEQ ID NO: 921 - RNA, 20 nt, Artificial Sequence
  Description of Artificial Sequence: Synthetic oligonucleotide
uuucuuggccaucuccuuca

SEQ ID NO: 922 - RNA, 20 nt, Artificial Sequence
  Description of Artificial Sequence: Synthetic oligonucleotide
gcuuucuuggccaucuccuu

SEQ ID NO: 923 - RNA, 20 nt, Artificial Sequence
  Description of Artificial Sequence: Synthetic oligonucleotide
gugcuuucuuggccaucucc

SEQ ID NO: 924 - RNA, 20 nt, Artificial Sequence
  Description of Artificial Sequence: Synthetic oligonucleotide
aggugcuuucuuggccaucu

SEQ ID NO: 925 - RNA, 20 nt, Artificial Sequence
  Description of Artificial Sequence: Synthetic oligonucleotide
gaaggugcuuucuuggccau

SEQ ID NO: 926 - RNA, 20 nt, Artificial Sequence
  Description of Artificial Sequence: Synthetic oligonucleotide
cugaaggugcuuucuuggcc

SEQ ID NO: 927 - RNA, 20 nt, Artificial Sequence
  Description of Artificial Sequence: Synthetic oligonucleotide
uucugaaggugcuuucuugg

SEQ ID NO: 928 - RNA, 20 nt, Artificial Sequence
  Description of Artificial Sequence: Synthetic oligonucleotide
uauuucugaaggugcuuucu

SEQ ID NO: 929 - RNA, 20 nt, Artificial Sequence
  Description of Artificial Sequence: Synthetic oligonucleotide
auauuucugaaggugcuuuc

SEQ ID NO: 930 - RNA, 20 nt, Artificial Sequence
  Description of Artificial Sequence: Synthetic oligonucleotide
ggcauauuucugaaggugcu

SEQ ID NO: 931 - RNA, 20 nt, Artificial Sequence
  Description of Artificial Sequence: Synthetic oligonucleotide
uggcauauuucugaaggugc

SEQ ID NO: 932 - RNA, 20 nt, Artificial Sequence
  Description of Artificial Sequence: Synthetic oligonucleotide
ucuggcauauuucugaaggu

SEQ ID NO: 933 - RNA, 20 nt, Artificial Sequence
  Description of Artificial Sequence: Synthetic oligonucleotide
ucugacagauauuucuggca

SEQ ID NO: 934 - RNA, 20 nt, Artificial Sequence
  Description of Artificial Sequence: Synthetic oligonucleotide
auucugacagauauuucugg

SEQ ID NO: 935 - RNA, 20 nt, Artificial Sequence
  Description of Artificial Sequence: Synthetic oligonucleotide
caaauucugacagauauuuc

SEQ ID NO: 936 - RNA, 20 nt, Artificial Sequence
  Description of Artificial Sequence: Synthetic oligonucleotide
ucucuucaaauucugacaga

SEQ ID NO: 937 - RNA, 20 nt, Artificial Sequence
  Description of Artificial Sequence: Synthetic oligonucleotide
ccucaaucucuucaaauucu

SEQ ID NO: 938 - RNA, 20 nt, Artificial Sequence
  Description of Artificial Sequence: Synthetic oligonucleotide
gccccucaaucucuucaaau

SEQ ID NO: 939 - RNA, 20 nt, Artificial Sequence
  Description of Artificial Sequence: Synthetic oligonucleotide
ugccccucaaucucuucaaa

SEQ ID NO: 940 - RNA, 20 nt, Artificial Sequence
  Description of Artificial Sequence: Synthetic oligonucleotide
gugccccucaaucucuucaa

SEQ ID NO: 941 - RNA, 20 nt, Artificial Sequence
  Description of Artificial Sequence: Synthetic oligonucleotide
agugccccucaaucucuuca

SEQ ID NO: 942 - RNA, 20 nt, Artificial Sequence
  Description of Artificial Sequence: Synthetic oligonucleotide
ccagugccccucaaucucuu

SEQ ID NO: 943 - RNA, 20 nt, Artificial Sequence
  Description of Artificial Sequence: Synthetic oligonucleotide
uuccagugccccucaaucuc

SEQ ID NO: 944 - RNA, 20 nt, Artificial Sequence
  Description of Artificial Sequence: Synthetic oligonucleotide
ucuuccagugccccucaauc

SEQ ID NO: 945 - RNA, 20 nt, Artificial Sequence
  Description of Artificial Sequence: Synthetic oligonucleotide
uuucuuccagugccccucaa

SEQ ID NO: 946 - RNA, 20 nt, Artificial Sequence
  Description of Artificial Sequence: Synthetic oligonucleotide
aguuucuuccagugccccuc

SEQ ID NO: 947 - RNA, 20 nt, Artificial Sequence
  Description of Artificial Sequence: Synthetic oligonucleotide
aaaguuucuuccagugcccc

SEQ ID NO: 948 - RNA, 20 nt, Artificial Sequence
  Description of Artificial Sequence: Synthetic oligonucleotide
aggaaaguuucuuccagugc

SEQ ID NO: 949 - RNA, 20 nt, Artificial Sequence
  Description of Artificial Sequence: Synthetic oligonucleotide
ggaggaaaguuucuuccagu

SEQ ID NO: 950 - RNA, 20 nt, Artificial Sequence
  Description of Artificial Sequence: Synthetic oligonucleotide
cugggaggaaaguuucuucc

SEQ ID NO: 951 - RNA, 20 nt, Artificial Sequence
  Description of Artificial Sequence: Synthetic oligonucleotide
acugggaggaaaguuucuuc

SEQ ID NO: 952 - RNA, 20 nt, Artificial Sequence
  Description of Artificial Sequence: Synthetic oligonucleotide
ccaacugggaggaaaguuuc

SEQ ID NO: 953 - RNA, 20 nt, Artificial Sequence
  Description of Artificial Sequence: Synthetic oligonucleotide
ccaccaacugggaggaaagu

SEQ ID NO: 954 - RNA, 20 nt, Artificial Sequence
  Description of Artificial Sequence: Synthetic oligonucleotide
uuuccaccaacugggaggaa

SEQ ID NO: 955 - RNA, 20 nt, Artificial Sequence
  Description of Artificial Sequence: Synthetic oligonucleotide
cuuuccaccaacugggagga

SEQ ID NO: 956 - RNA, 20 nt, Artificial Sequence
  Description of Artificial Sequence: Synthetic oligonucleotide
gcuuuccaccaacugggagg

SEQ ID NO: 957 - RNA, 20 nt, Artificial Sequence
  Description of Artificial Sequence: Synthetic oligonucleotide
cagcuuuccaccaacuggga

SEQ ID NO: 958 - RNA, 20 nt, Artificial Sequence
  Description of Artificial Sequence: Synthetic oligonucleotide
ggcagcuuuccaccaacugg

SEQ ID NO: 959 - RNA, 20 nt, Artificial Sequence
  Description of Artificial Sequence: Synthetic oligonucleotide
uuggcagcuuuccaccaacu

SEQ ID NO: 960 - RNA, 20 nt, Artificial Sequence
  Description of Artificial Sequence: Synthetic oligonucleotide
uuuuggcagcuuuccaccaa

SEQ ID NO: 961 - RNA, 20 nt, Artificial Sequence
  Description of Artificial Sequence: Synthetic oligonucleotide
gcuuuuggcagcuuuccacc

SEQ ID NO: 962 - RNA, 20 nt, Artificial Sequence
  Description of Artificial Sequence: Synthetic oligonucleotide
uagcuuuuggcagcuuucca

SEQ ID NO: 963 - RNA, 20 nt, Artificial Sequence
  Description of Artificial Sequence: Synthetic oligonucleotide
ucuagcuuuuggcagcuuuc

SEQ ID NO: 964 - RNA, 20 nt, Artificial Sequence
  Description of Artificial Sequence: Synthetic oligonucleotide
cuucuagcuuuuggcagcuu

SEQ ID NO: 965 - RNA, 20 nt, Artificial Sequence
  Description of Artificial Sequence: Synthetic oligonucleotide
uucuucuagcuuuuggcagc

SEQ ID NO: 966 - RNA, 20 nt, Artificial Sequence
  Description of Artificial Sequence: Synthetic oligonucleotide
uguucuucuagcuuuuggca

SEQ ID NO: 967 - RNA, 20 nt, Artificial Sequence
  Description of Artificial Sequence: Synthetic oligonucleotide
uauguucuucuagcuuuugg

SEQ ID NO: 968 - RNA, 20 nt, Artificial Sequence
  Description of Artificial Sequence: Synthetic oligonucleotide
cauauguucuucuagcuuuu

SEQ ID NO: 969 - RNA, 20 nt, Artificial Sequence
  Description of Artificial Sequence: Synthetic oligonucleotide
uucauauguucuucuagcuu

SEQ ID NO: 970 - RNA, 20 nt, Artificial Sequence
  Description of Artificial Sequence: Synthetic oligonucleotide
auucauauguucuucuagcu

SEQ ID NO: 971 - RNA, 20 nt, Artificial Sequence
  Description of Artificial Sequence: Synthetic oligonucleotide
uauucauauguucuucuagc

SEQ ID NO: 972 - RNA, 20 nt, Artificial Sequence
  Description of Artificial Sequence: Synthetic oligonucleotide
guuuauucauauguucuucu

SEQ ID NO: 973 - RNA, 20 nt, Artificial Sequence
  Description of Artificial Sequence: Synthetic oligonucleotide
aguuuauucauauguucuuc

SEQ ID NO: 974 - RNA, 20 nt, Artificial Sequence
  Description of Artificial Sequence: Synthetic oligonucleotide
gaaguuuauucauauguucu

SEQ ID NO: 975 - RNA, 20 nt, Artificial Sequence
  Description of Artificial Sequence: Synthetic oligonucleotide
ucgaaguuuauucauauguu

SEQ ID NO: 976 - RNA, 20 nt, Artificial Sequence
  Description of Artificial Sequence: Synthetic oligonucleotide
uucgaaguuuauucauaugu

SEQ ID NO: 977 - RNA, 20 nt, Artificial Sequence
  Description of Artificial Sequence: Synthetic oligonucleotide
uuucgaaguuuauucauaug

SEQ ID NO: 978 - RNA, 20 nt, Artificial Sequence
  Description of Artificial Sequence: Synthetic oligonucleotide
aauuuucgaaguuuauucau

SEQ ID NO: 979 - RNA, 20 nt, Artificial Sequence
  Description of Artificial Sequence: Synthetic oligonucleotide
ugaaauuuucgaaguuuauu

SEQ ID NO: 980 - RNA, 20 nt, Artificial Sequence
  Description of Artificial Sequence: Synthetic oligonucleotide
accugaaauuuucgaaguuu

SEQ ID NO: 981 - RNA, 20 nt, Artificial Sequence
  Description of Artificial Sequence: Synthetic oligonucleotide
uuaccugaaauuuucgaagu

SEQ ID NO: 982 - RNA, 20 nt, Artificial Sequence
  Description of Artificial Sequence: Synthetic oligonucleotide
gcuuaccugaaauuuucgaa

SEQ ID NO: 983 - RNA, 20 nt, Artificial Sequence
  Description of Artificial Sequence: Synthetic oligonucleotide
cggcuuaccugaaauuuucg

SEQ ID NO: 984 - RNA, 20 nt, Artificial Sequence
  Description of Artificial Sequence: Synthetic oligonucleotide
cucggcuuaccugaaauuuu

SEQ ID NO: 985 - RNA, 20 nt, Artificial Sequence
  Description of Artificial Sequence: Synthetic oligonucleotide
accucggcuuaccugaaauu

SEQ ID NO: 986 - RNA, 20 nt, Artificial Sequence
  Description of Artificial Sequence: Synthetic oligonucleotide
aaaccucggcuuaccugaaa

SEQ ID NO: 987 - RNA, 20 nt, Artificial Sequence
  Description of Artificial Sequence: Synthetic oligonucleotide
ccaaaccucggcuuaccuga

SEQ ID NO: 988 - RNA, 20 nt, Artificial Sequence
  Description of Artificial Sequence: Synthetic oligonucleotide
gccaaaccucggcuuaccug

SEQ ID NO: 989 - RNA, 20 nt, Artificial Sequence
  Description of Artificial Sequence: Synthetic oligonucleotide
aggccaaaccucggcuuacc

SEQ ID NO: 990 - RNA, 20 nt, Artificial Sequence
  Description of Artificial Sequence: Synthetic oligonucleotide
aaaggccaaaccucggcuua

SEQ ID NO: 991 - RNA, 20 nt, Artificial Sequence
  Description of Artificial Sequence: Synthetic oligonucleotide
uuaaaggccaaaccucggcu

SEQ ID NO: 992 - RNA, 20 nt, Artificial Sequence
  Description of Artificial Sequence: Synthetic oligonucleotide
guuuaaaggccaaaccucgg

SEQ ID NO: 993 - RNA, 20 nt, Artificial Sequence
  Description of Artificial Sequence: Synthetic oligonucleotide
uaguuuaaaggccaaaccuc

SEQ ID NO: 994 - RNA, 20 nt, Artificial Sequence
  Description of Artificial Sequence: Synthetic oligonucleotide
uauaguuuaaaggccaaacc

SEQ ID NO: 995 - RNA, 20 nt, Artificial Sequence
  Description of Artificial Sequence: Synthetic oligonucleotide
aauauaguuuaaaggccaaa

SEQ ID NO: 996 - RNA, 20 nt, Artificial Sequence
  Description of Artificial Sequence: Synthetic oligonucleotide
aaaauauaguuuaaaggcca

SEQ ID NO: 997 - RNA, 20 nt, Artificial Sequence
  Description of Artificial Sequence: Synthetic oligonucleotide
ucaaggaagauggcauuucu

SEQ ID NO: 998 - RNA, 20 nt, Artificial Sequence
  Description of Artificial Sequence: Synthetic oligonucleotide
ucaaggaagauggcauuucu

SEQ ID NO: 999 - RNA, 20 nt, Artificial Sequence
  Description of Artificial Sequence: Synthetic oligonucleotide
ucaaggaagauggcauuucu

SEQ ID NO: 1000 - RNA, 20 nt, Artificial Sequence
  Description of Artificial Sequence: Synthetic oligonucleotide
ucaaggaagauggcauuucu

SEQ ID NO: 1001 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1002 - RNA, 20 nt, Artificial Sequence
  Description of Artificial Sequence: Synthetic oligonucleotide
ucaaggaagauggcauuucu

SEQ ID NO: 1003 - DNA, 20 bp, Artificial Sequence
  Description of Artificial Sequence: Synthetic oligonucleotide
  Description of Combined DNA/RNA Molecule: Synthetic oligonucleotide
ucaaggaagatggcatttct

SEQ ID NO: 1004 - DNA, 20 bp, Artificial Sequence
  Description of Artificial Sequence: Synthetic oligonucleotide
  Description of Combined DNA/RNA Molecule: Synthetic oligonucleotide
ucaaggaagatggcatttcu

SEQ ID NO: 1005 - DNA, 20 bp, Artificial Sequence
  Description of Artificial Sequence: Synthetic oligonucleotide
  Description of Combined DNA/RNA Molecule: Synthetic oligonucleotide
ucaaggaagatggcatttcu

SEQ ID NO: 1006 - DNA, 20 bp, Artificial Sequence
  Description of Artificial Sequence: Synthetic oligonucleotide
  Description of Combined DNA/RNA Molecule: Synthetic oligonucleotide
ucaaggaagatggcattucu

SEQ ID NO: 1007 - DNA, 20 bp, Artificial Sequence
  Description of Artificial Sequence: Synthetic oligonucleotide
  Description of Combined DNA/RNA Molecule: Synthetic oligonucleotide
ucaaggaagatggcatuucu

SEQ ID NO: 1008 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1009 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1010 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1011 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1012 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1013 - RNA, 20 nt, Artificial Sequence
  Description of Artificial Sequence: Synthetic oligonucleotide
ucaaggaagauggcauuucu

SEQ ID NO: 1014 - RNA, 20 nt, Artificial Sequence
  Description of Artificial Sequence: Synthetic oligonucleotide
ucaaggaagauggcauuucu

SEQ ID NO: 1015 - RNA, 20 nt, Artificial Sequence
  Description of Artificial Sequence: Synthetic oligonucleotide
ucaaggaagauggcauuucu

SEQ ID NO: 1016 - RNA, 20 nt, Artificial Sequence
  Description of Artificial Sequence: Synthetic oligonucleotide
ucaaggaagauggcauuucu

SEQ ID NO: 1017 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauuucu

SEQ ID NO: 1018 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1019 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1020 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1021 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1022 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1023 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1024 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1025 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1026 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1027 - DNA, 20 bp, Artificial Sequence
  Description of Artificial Sequence: Synthetic oligonucleotide
  Description of Combined DNA/RNA Molecule: Synthetic oligonucleotide
ucaaggaagatggcauuucu

SEQ ID NO: 1028 - RNA, 20 nt, Artificial Sequence
  Description of Artificial Sequence: Synthetic oligonucleotide
ucaaggaagauggcauuucu

SEQ ID NO: 1029 - RNA, 20 nt, Artificial Sequence
  Description of Artificial Sequence: Synthetic oligonucleotide
ucaaggaagauggcauuucu

SEQ ID NO: 1030 - RNA, 20 nt, Artificial Sequence
  Description of Artificial Sequence: Synthetic oligonucleotide
ucaaggaagauggcauuucu

SEQ ID NO: 1031 - DNA, 20 bp, Artificial Sequence
  Description of Artificial Sequence: Synthetic oligonucleotide
tcaaggaagatggcatttct

SEQ ID NO: 1032 - DNA, 30 bp, Artificial Sequence
  Description of Artificial Sequence: Synthetic oligonucleotide
ctccaacatcaaggaagatggcatttctag

SEQ ID NO: 1033 - RNA, 20 nt, Artificial Sequence
  Description of Artificial Sequence: Synthetic oligonucleotide
ucaaggaagauggcauuucu

SEQ ID NO: 1034 - RNA, 20 nt, Artificial Sequence
  Description of Artificial Sequence: Synthetic oligonucleotide
ucaaggaagauggcauuucu

SEQ ID NO: 1035 - RNA, 20 nt, Artificial Sequence
  Description of Artificial Sequence: Synthetic oligonucleotide
ucaaggaagauggcauuucu

SEQ ID NO: 1036 - RNA, 20 nt, Artificial Sequence
  Description of Artificial Sequence: Synthetic oligonucleotide
ucaaggaagauggcauuucu

SEQ ID NO: 1037 - RNA, 20 nt, Artificial Sequence
  Description of Artificial Sequence: Synthetic oligonucleotide
ucaaggaagauggcauuucu

SEQ ID NO: 1038 - RNA, 20 nt, Artificial Sequence
  Description of Artificial Sequence: Synthetic oligonucleotide
ucaaggaagauggcauuucu

SEQ ID NO: 1039 - RNA, 20 nt, Artificial Sequence
  Description of Artificial Sequence: Synthetic oligonucleotide
ucaaggaagauggcauuucu

SEQ ID NO: 1040 - RNA, 20 nt, Artificial Sequence
  Description of Artificial Sequence: Synthetic oligonucleotide
ucaaggaagauggcauuucu

SEQ ID NO: 1041 - RNA, 20 nt, Artificial Sequence
  Description of Artificial Sequence: Synthetic oligonucleotide
ucaaggaagauggcauuucu

SEQ ID NO: 1042 - RNA, 20 nt, Artificial Sequence
  Description of Artificial Sequence: Synthetic oligonucleotide
ucaaggaagauggcauuucu

SEQ ID NO: 1043 - RNA, 18 nt, Artificial Sequence
  Description of Artificial Sequence: Synthetic oligonucleotide
aaggaagauggcauuucu

SEQ ID NO: 1044 - RNA, 20 nt, Artificial Sequence
  Description of Artificial Sequence: Synthetic oligonucleotide
ucaaggaagauggcauuucu

SEQ ID NO: 1045 - RNA, 20 nt, Artificial Sequence
  Description of Artificial Sequence: Synthetic oligonucleotide
ucaaggaagauggcauuucu

SEQ ID NO: 1046 - RNA, 20 nt, Artificial Sequence
  Description of Artificial Sequence: Synthetic oligonucleotide
ucaaggaagauggcauuucu

SEQ ID NO: 1047 - RNA, 20 nt, Artificial Sequence
  Description of Artificial Sequence: Synthetic oligonucleotide
ucaaggaagauggcauuucu

SEQ ID NO: 1048 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1049 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1050 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1051 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1052 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1053 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1054 - RNA, 20 nt, Artificial Sequence
  Description of Artificial Sequence: Synthetic oligonucleotide
guacuucaucccacugauuc

SEQ ID NO: 1055 - RNA, 20 nt, Artificial Sequence
  Description of Artificial Sequence: Synthetic oligonucleotide
guacuucaucccacugauuc

SEQ ID NO: 1056 - RNA, 20 nt, Artificial Sequence
  Description of Artificial Sequence: Synthetic oligonucleotide
guacuucaucccacugauuc

SEQ ID NO: 1057 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1058 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1059 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1060 - RNA, 20 nt, Artificial Sequence
  Description of Artificial Sequence: Synthetic oligonucleotide
guacuucaucccacugauuc

SEQ ID NO: 1061 - RNA, 20 nt, Artificial Sequence
  Description of Artificial Sequence: Synthetic oligonucleotide
guacuucaucccacugauuc

SEQ ID NO: 1062 - RNA, 20 nt, Artificial Sequence
  Description of Artificial Sequence: Synthetic oligonucleotide
guacuucaucccacugauuc

SEQ ID NO: 1063 - RNA, 20 nt, Artificial Sequence
  Description of Artificial Sequence: Synthetic oligonucleotide
guacuucaucccacugauuc

SEQ ID NO: 1064 - RNA, 20 nt, Artificial Sequence
  Description of Artificial Sequence: Synthetic oligonucleotide
guacuucaucccacugauuc

SEQ ID NO: 1065 - RNA, 20 nt, Artificial Sequence
  Description of Artificial Sequence: Synthetic oligonucleotide
guacuucaucccacugauuc

SEQ ID NO: 1066 - RNA, 20 nt, Artificial Sequence
  Description of Artificial Sequence: Synthetic oligonucleotide
guacuucaucccacugauuc

SEQ ID NO: 1067 - RNA, 20 nt, Artificial Sequence
  Description of Artificial Sequence: Synthetic oligonucleotide
guacuucaucccacugauuc

SEQ ID NO: 1068 - RNA, 20 nt, Artificial Sequence
  Description of Artificial Sequence: Synthetic oligonucleotide
guacuucaucccacugauuc

SEQ ID NO: 1069 - DNA, 20 bp, Artificial Sequence
  Description of Artificial Sequence: Synthetic oligonucleotide
  Description of Combined DNA/RNA Molecule: Synthetic oligonucleotide
gtacttcatcccacugauuc

SEQ ID NO: 1070 - DNA, 20 bp, Artificial Sequence
  Description of Artificial Sequence: Synthetic oligonucleotide
  Description of Combined DNA/RNA Molecule: Synthetic oligonucleotide
guacutcatcccacugauuc

SEQ ID NO: 1071 - DNA, 20 bp, Artificial Sequence
  Description of Artificial Sequence: Synthetic oligonucleotide
  Description of Combined DNA/RNA Molecule: Synthetic oligonucleotide
guacuucatcccacugauuc

SEQ ID NO: 1072 - DNA, 20 bp, Artificial Sequence
  Description of Artificial Sequence: Synthetic oligonucleotide
  Description of Combined DNA/RNA Molecule: Synthetic oligonucleotide
guguucttgtacttcauccc

SEQ ID NO: 1073 - DNA, 20 bp, Artificial Sequence
  Description of Artificial Sequence: Synthetic oligonucleotide
  Description of Combined DNA/RNA Molecule: Synthetic oligonucleotide
guguucttgtacttcauccc

SEQ ID NO: 1074 - DNA, 20 bp, Artificial Sequence
  Description of Artificial Sequence: Synthetic oligonucleotide
  Description of Combined DNA/RNA Molecule: Synthetic oligonucleotide
guguucttgtacttcauccc

SEQ ID NO: 1075 - DNA, 20 bp, Artificial Sequence
  Description of Artificial Sequence: Synthetic oligonucleotide
  Description of Combined DNA/RNA Molecule: Synthetic oligonucleotide
guguuctuguactucauccc

SEQ ID NO: 1076 - DNA, 20 bp, Artificial Sequence
  Description of Artificial Sequence: Synthetic oligonucleotide
  Description of Combined DNA/RNA Molecule: Synthetic oligonucleotide
guguuctuguactucauccc

SEQ ID NO: 1077 - DNA, 20 bp, Artificial Sequence
  Description of Artificial Sequence: Synthetic oligonucleotide
  Description of Combined DNA/RNA Molecule: Synthetic oligonucleotide
guguuctuguactucauccc

SEQ ID NO: 1078 - DNA, 20 bp, Artificial Sequence
  Description of Artificial Sequence: Synthetic oligonucleotide
  Description of Combined DNA/RNA Molecule: Synthetic oligonucleotide
guguucutgtacutcauccc

SEQ ID NO: 1079 - DNA, 20 bp, Artificial Sequence
  Description of Artificial Sequence: Synthetic oligonucleotide
  Description of Combined DNA/RNA Molecule: Synthetic oligonucleotide
guguucutgtacutcauccc

SEQ ID NO: 1080 - DNA, 20 bp, Artificial Sequence
  Description of Artificial Sequence: Synthetic oligonucleotide
  Description of Combined DNA/RNA Molecule: Synthetic oligonucleotide
guguucutgtacutcauccc

SEQ ID NO: 1081 - DNA, 20 bp, Artificial Sequence
  Description of Artificial Sequence: Synthetic oligonucleotide
  Description of Combined DNA/RNA Molecule: Synthetic oligonucleotide
guguuctuguactucauccc

SEQ ID NO: 1082 - DNA, 20 bp, Artificial Sequence
  Description of Artificial Sequence: Synthetic oligonucleotide
  Description of Combined DNA/RNA Molecule: Synthetic oligonucleotide
guguuctuguactucauccc

SEQ ID NO: 1083 - DNA, 20 bp, Artificial Sequence
  Description of Artificial Sequence: Synthetic oligonucleotide
  Description of Combined DNA/RNA Molecule: Synthetic oligonucleotide
guguuctuguactucauccc

SEQ ID NO: 1084 - DNA, 20 bp, Artificial Sequence
  Description of Artificial Sequence: Synthetic oligonucleotide
  Description of Combined DNA/RNA Molecule: Synthetic oligonucleotide
guguucutgtacutcauccc

SEQ ID NO: 1085 - DNA, 20 bp, Artificial Sequence
  Description of Artificial Sequence: Synthetic oligonucleotide
  Description of Combined DNA/RNA Molecule: Synthetic oligonucleotide
guguucutgtacutcauccc

SEQ ID NO: 1086 - DNA, 20 bp, Artificial Sequence
  Description of Artificial Sequence: Synthetic oligonucleotide
  Description of Combined DNA/RNA Molecule: Synthetic oligonucleotide
guguucutgtacutcauccc

SEQ ID NO: 1087 - RNA, 20 nt, Artificial Sequence
  Description of Artificial Sequence: Synthetic oligonucleotide
guguucuuguacuucauccc

SEQ ID NO: 1088 - RNA, 20 nt, Artificial Sequence
  Description of Artificial Sequence: Synthetic oligonucleotide
guguucuuguacuucauccc

SEQ ID NO: 1089 - RNA, 20 nt, Artificial Sequence
  Description of Artificial Sequence: Synthetic oligonucleotide
guguucuuguacuucauccc

SEQ ID NO: 1090 - RNA, 20 nt, Artificial Sequence
  Description of Artificial Sequence: Synthetic oligonucleotide
guguucuuguacuucauccc

SEQ ID NO: 1091 - RNA, 20 nt, Artificial Sequence
  Description of Artificial Sequence: Synthetic oligonucleotide
guguucuuguacuucauccc

SEQ ID NO: 1092 - RNA, 20 nt, Artificial Sequence
  Description of Artificial Sequence: Synthetic oligonucleotide
guguucuuguacuucauccc

SEQ ID NO: 1093 - DNA, 20 bp, Artificial Sequence
  Description of Artificial Sequence: Synthetic oligonucleotide
  Description of Combined DNA/RNA Molecule: Synthetic oligonucleotide
gtgttcttgtacttcauccc

SEQ ID NO: 1094 - DNA, 20 bp, Artificial Sequence
  Description of Artificial Sequence: Synthetic oligonucleotide
  Description of Combined DNA/RNA Molecule: Synthetic oligonucleotide
guguucttgtacttcauccc

SEQ ID NO: 1095 - DNA, 20 bp, Artificial Sequence
  Description of Artificial Sequence: Synthetic oligonucleotide
  Description of Combined DNA/RNA Molecule: Synthetic oligonucleotide
guguucttgtacttcauccc

SEQ ID NO: 1096 - DNA, 20 bp, Artificial Sequence
  Description of Artificial Sequence: Synthetic oligonucleotide
  Description of Combined DNA/RNA Molecule: Synthetic oligonucleotide
uucugaaggtgttcuuguac

SEQ ID NO: 1097 - DNA, 20 bp, Artificial Sequence
  Description of Artificial Sequence: Synthetic oligonucleotide
  Description of Combined DNA/RNA Molecule: Synthetic oligonucleotide
uucugaaggtgttcuuguac

SEQ ID NO: 1098 - DNA, 20 bp, Artificial Sequence
  Description of Artificial Sequence: Synthetic oligonucleotide
  Description of Combined DNA/RNA Molecule: Synthetic oligonucleotide
uucugaaggtgttcuuguac

SEQ ID NO: 1099 - DNA, 20 bp, Artificial Sequence
  Description of Artificial Sequence: Synthetic oligonucleotide
  Description of Combined DNA/RNA Molecule: Synthetic oligonucleotide
uucugaaggugutcuuguac

SEQ ID NO: 1100 - DNA, 20 bp, Artificial Sequence
  Description of Artificial Sequence: Synthetic oligonucleotide
  Description of Combined DNA/RNA Molecule: Synthetic oligonucleotide
uucugaaggugutcuuguac

SEQ ID NO: 1101 - DNA, 20 bp, Artificial Sequence
  Description of Artificial Sequence: Synthetic oligonucleotide
  Description of Combined DNA/RNA Molecule: Synthetic oligonucleotide
uucugaaggugutcuuguac

SEQ ID NO: 1102 - DNA, 20 bp, Artificial Sequence
  Description of Artificial Sequence: Synthetic oligonucleotide
  Description of Combined DNA/RNA Molecule: Synthetic oligonucleotide
uucugaaggtgtucuuguac

SEQ ID NO: 1103 - DNA, 20 bp, Artificial Sequence
  Description of Artificial Sequence: Synthetic oligonucleotide
  Description of Combined DNA/RNA Molecule: Synthetic oligonucleotide
uucugaaggtgtucuuguac

SEQ ID NO: 1104 - DNA, 20 bp, Artificial Sequence
  Description of Artificial Sequence: Synthetic oligonucleotide
  Description of Combined DNA/RNA Molecule: Synthetic oligonucleotide
uucugaaggtgtucuuguac

SEQ ID NO: 1105 - DNA, 20 bp, Artificial Sequence
  Description of Artificial Sequence: Synthetic oligonucleotide
  Description of Combined DNA/RNA Molecule: Synthetic oligonucleotide
uucugaaggugutcuuguac

SEQ ID NO: 1106 - DNA, 20 bp, Artificial Sequence
  Description of Artificial Sequence: Synthetic oligonucleotide
  Description of Combined DNA/RNA Molecule: Synthetic oligonucleotide
uucugaaggugutcuuguac

SEQ ID NO: 1107 - DNA, 20 bp, Artificial Sequence
  Description of Artificial Sequence: Synthetic oligonucleotide
  Description of Combined DNA/RNA Molecule: Synthetic oligonucleotide
uucugaaggugutcuuguac

SEQ ID NO: 1108 - DNA, 20 bp, Artificial Sequence
  Description of Artificial Sequence: Synthetic oligonucleotide
  Description of Combined DNA/RNA Molecule: Synthetic oligonucleotide
uucugaaggtgtucuuguac

SEQ ID NO: 1109 - DNA, 20 bp, Artificial Sequence
  Description of Artificial Sequence: Synthetic oligonucleotide
  Description of Combined DNA/RNA Molecule: Synthetic oligonucleotide
uucugaaggtgtucuuguac

SEQ ID NO: 1110 - DNA, 20 bp, Artificial Sequence
  Description of Artificial Sequence: Synthetic oligonucleotide
  Description of Combined DNA/RNA Molecule: Synthetic oligonucleotide
uucugaaggtgtucuuguac

SEQ ID NO: 1111 - RNA, 20 nt, Artificial Sequence
  Description of Artificial Sequence: Synthetic oligonucleotide
uucugaagguguucuuguac

SEQ ID NO: 1112 - RNA, 20 nt, Artificial Sequence
  Description of Artificial Sequence: Synthetic oligonucleotide
uucugaagguguucuuguac

SEQ ID NO: 1113 - RNA, 20 nt, Artificial Sequence
  Description of Artificial Sequence: Synthetic oligonucleotide
uucugaagguguucuuguac

SEQ ID NO: 1114 - RNA, 20 nt, Artificial Sequence
  Description of Artificial Sequence: Synthetic oligonucleotide
uucugaagguguucuuguac

SEQ ID NO: 1115 - RNA, 20 nt, Artificial Sequence
  Description of Artificial Sequence: Synthetic oligonucleotide
uucugaagguguucuuguac

SEQ ID NO: 1116 - RNA, 20 nt, Artificial Sequence
  Description of Artificial Sequence: Synthetic oligonucleotide
uucugaagguguucuuguac

SEQ ID NO: 1117 - DNA, 20 bp, Artificial Sequence
  Description of Artificial Sequence: Synthetic oligonucleotide
  Description of Combined DNA/RNA Molecule: Synthetic oligonucleotide
ttctgaaggtgttcuuguac

SEQ ID NO: 1118 - DNA, 20 bp, Artificial Sequence
  Description of Artificial Sequence: Synthetic oligonucleotide
  Description of Combined DNA/RNA Molecule: Synthetic oligonucleotide
uucugaaggtgttcuuguac

SEQ ID NO: 1119 - DNA, 20 bp, Artificial Sequence
  Description of Artificial Sequence: Synthetic oligonucleotide
  Description of Combined DNA/RNA Molecule: Synthetic oligonucleotide
uucugaaggtgttcuuguac

SEQ ID NO: 1120 - DNA, 20 bp, Artificial Sequence
  Description of Artificial Sequence: Synthetic oligonucleotide
  Description of Combined DNA/RNA Molecule: Synthetic oligonucleotide
cuccggttctgaagguguuc

SEQ ID NO: 1121 - DNA, 20 bp, Artificial Sequence
  Description of Artificial Sequence: Synthetic oligonucleotide
  Description of Combined DNA/RNA Molecule: Synthetic oligonucleotide
cuccggttctgaagguguuc

SEQ ID NO: 1122 - DNA, 20 bp, Artificial Sequence
  Description of Artificial Sequence: Synthetic oligonucleotide
  Description of Combined DNA/RNA Molecule: Synthetic oligonucleotide
cuccggttctgaagguguuc

SEQ ID NO: 1123 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1124 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1125 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1126 - DNA, 20 bp, Artificial Sequence
  Description of Artificial Sequence: Synthetic oligonucleotide
  Description of Combined DNA/RNA Molecule: Synthetic oligonucleotide
cuccggutctgaagguguuc

SEQ ID NO: 1127 - DNA, 20 bp, Artificial Sequence
  Description of Artificial Sequence: Synthetic oligonucleotide
  Description of Combined DNA/RNA Molecule: Synthetic oligonucleotide
cuccggutctgaagguguuc

SEQ ID NO: 1128 - DNA, 20 bp, Artificial Sequence
  Description of Artificial Sequence: Synthetic oligonucleotide
  Description of Combined DNA/RNA Molecule: Synthetic oligonucleotide
cuccggutctgaagguguuc

SEQ ID NO: 1129 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1130 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1131 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1132 - DNA, 20 bp, Artificial Sequence
  Description of Artificial Sequence: Synthetic oligonucleotide
  Description of Combined DNA/RNA Molecule: Synthetic oligonucleotide
cuccggutctgaagguguuc

SEQ ID NO: 1133 - DNA, 20 bp, Artificial Sequence
  Description of Artificial Sequence: Synthetic oligonucleotide
  Description of Combined DNA/RNA Molecule: Synthetic oligonucleotide
cuccggutctgaagguguuc

SEQ ID NO: 1134 - DNA, 20 bp, Artificial Sequence
  Description of Artificial Sequence: Synthetic oligonucleotide
  Description of Combined DNA/RNA Molecule: Synthetic oligonucleotide
cuccggutctgaagguguuc

SEQ ID NO: 1135 - RNA, 20 nt, Artificial Sequence
  Description of Artificial Sequence: Synthetic oligonucleotide
cuccgguucugaagguguuc

SEQ ID NO: 1136 - RNA, 20 nt, Artificial Sequence
  Description of Artificial Sequence: Synthetic oligonucleotide
cuccgguucugaagguguuc

SEQ ID NO: 1137 - RNA, 20 nt, Artificial Sequence
  Description of Artificial Sequence: Synthetic oligonucleotide
cuccgguucugaagguguuc

SEQ ID NO: 1138 - RNA, 20 nt, Artificial Sequence
  Description of Artificial Sequence: Synthetic oligonucleotide
cuccgguucugaagguguuc

SEQ ID NO: 1139 - RNA, 20 nt, Artificial Sequence
  Description of Artificial Sequence: Synthetic oligonucleotide
cuccgguucugaagguguuc

SEQ ID NO: 1140 - RNA, 20 nt, Artificial Sequence
  Description of Artificial Sequence: Synthetic oligonucleotide
cuccgguucugaagguguuc

SEQ ID NO: 1141 - DNA, 20 bp, Artificial Sequence
  Description of Artificial Sequence: Synthetic oligonucleotide
  Description of Combined DNA/RNA Molecule: Synthetic oligonucleotide
ctccggttctgaagguguuc

SEQ ID NO: 1142 - DNA, 20 bp, Artificial Sequence
  Description of Artificial Sequence: Synthetic oligonucleotide
  Description of Combined DNA/RNA Molecule: Synthetic oligonucleotide
cuccggttctgaagguguuc

SEQ ID NO: 1143 - DNA, 20 bp, Artificial Sequence
  Description of Artificial Sequence: Synthetic oligonucleotide
  Description of Combined DNA/RNA Molecule: Synthetic oligonucleotide
cuccggttctgaagguguuc

SEQ ID NO: 1144 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1145 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1146 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1147 - RNA, 20 nt, Artificial Sequence
  Description of Artificial Sequence: Synthetic oligonucleotide
ucuuggccaucuccuucaca

SEQ ID NO: 1148 - RNA, 20 nt, Artificial Sequence
  Description of Artificial Sequence: Synthetic oligonucleotide
ucuuggccaucuccuucaca

SEQ ID NO: 1149 - RNA, 20 nt, Artificial Sequence
  Description of Artificial Sequence: Synthetic oligonucleotide
ucuuggccaucuccuucaca

SEQ ID NO: 1150 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1151 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1152 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1153 - RNA, 20 nt, Artificial Sequence
  Description of Artificial Sequence: Synthetic oligonucleotide
ucuuggccaucuccuucaca

SEQ ID NO: 1154 - RNA, 20 nt, Artificial Sequence
  Description of Artificial Sequence: Synthetic oligonucleotide
ucuuggccaucuccuucaca

SEQ ID NO: 1155 - RNA, 20 nt, Artificial Sequence
  Description of Artificial Sequence: Synthetic oligonucleotide
ucuuggccaucuccuucaca

SEQ ID NO: 1156 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1157 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1158 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1159 - RNA, 20 nt, Artificial Sequence
  Description of Artificial Sequence: Synthetic oligonucleotide
ucuuggccaucuccuucaca

SEQ ID NO: 1160 - RNA, 20 nt, Artificial Sequence
  Description of Artificial Sequence: Synthetic oligonucleotide
ucuuggccaucuccuucaca

SEQ ID NO: 1161 - RNA, 20 nt, Artificial Sequence
  Description of Artificial Sequence: Synthetic oligonucleotide
ucuuggccaucuccuucaca

SEQ ID NO: 1162 - RNA, 20 nt, Artificial Sequence
  Description of Artificial Sequence: Synthetic oligonucleotide
ucuuggccaucuccuucaca

SEQ ID NO: 1163 - RNA, 20 nt, Artificial Sequence
  Description of Artificial Sequence: Synthetic oligonucleotide
ucuuggccaucuccuucaca

SEQ ID NO: 1164 - RNA, 20 nt, Artificial Sequence
  Description of Artificial Sequence: Synthetic oligonucleotide
ucuuggccaucuccuucaca

SEQ ID NO: 1165 - DNA, 20 bp, Artificial Sequence
  Description of Artificial Sequence: Synthetic oligonucleotide
  Description of Combined DNA/RNA Molecule: Synthetic oligonucleotide
tcttggccatctccuucaca

SEQ ID NO: 1166 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1167 - DNA, 20 bp, Artificial Sequence
  Description of Artificial Sequence: Synthetic oligonucleotide
  Description of Combined DNA/RNA Molecule: Synthetic oligonucleotide
ucuuggccatctccuucaca

SEQ ID NO: 1168 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1169 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1170 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1171 - RNA, 20 nt, Artificial Sequence
  Description of Artificial Sequence: Synthetic oligonucleotide
uuucuuggccaucuccuuca

SEQ ID NO: 1172 - RNA, 20 nt, Artificial Sequence
  Description of Artificial Sequence: Synthetic oligonucleotide
uuucuuggccaucuccuuca

SEQ ID NO: 1173 - RNA, 20 nt, Artificial Sequence
  Description of Artificial Sequence: Synthetic oligonucleotide
uuucuuggccaucuccuuca

SEQ ID NO: 1174 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1175 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1176 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1177 - RNA, 20 nt, Artificial Sequence
  Description of Artificial Sequence: Synthetic oligonucleotide
uuucuuggccaucuccuuca

SEQ ID NO: 1178 - RNA, 20 nt, Artificial Sequence
  Description of Artificial Sequence: Synthetic oligonucleotide
uuucuuggccaucuccuuca

SEQ ID NO: 1179 - RNA, 20 nt, Artificial Sequence
  Description of Artificial Sequence: Synthetic oligonucleotide
uuucuuggccaucuccuuca

SEQ ID NO: 1180 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1181 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1182 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1183 - RNA, 20 nt, Artificial Sequence
  Description of Artificial Sequence: Synthetic oligonucleotide
uuucuuggccaucuccuuca

SEQ ID NO: 1184 - RNA, 20 nt, Artificial Sequence
  Description of Artificial Sequence: Synthetic oligonucleotide
uuucuuggccaucuccuuca

SEQ ID NO: 1185 - RNA, 20 nt, Artificial Sequence
  Description of Artificial Sequence: Synthetic oligonucleotide
uuucuuggccaucuccuuca

SEQ ID NO: 1186 - RNA, 20 nt, Artificial Sequence
  Description of Artificial Sequence: Synthetic oligonucleotide
uuucuuggccaucuccuuca

SEQ ID NO: 1187 - RNA, 20 nt, Artificial Sequence
  Description of Artificial Sequence: Synthetic oligonucleotide
uuucuuggccaucuccuuca

SEQ ID NO: 1188 - RNA, 20 nt, Artificial Sequence
  Description of Artificial Sequence: Synthetic oligonucleotide
uuucuuggccaucuccuuca

SEQ ID NO: 1189 - DNA, 20 bp, Artificial Sequence
  Description of Artificial Sequence: Synthetic oligonucleotide
  Description of Combined DNA/RNA Molecule: Synthetic oligonucleotide
tttcttggccatctccuuca

SEQ ID NO: 1190 - DNA, 20 bp, Artificial Sequence
  Description of Artificial Sequence: Synthetic oligonucleotide
  Description of Combined DNA/RNA Molecule: Synthetic oligonucleotide
uuucutggccatctccuuca

SEQ ID NO: 1191 - DNA, 20 bp, Artificial Sequence
  Description of Artificial Sequence: Synthetic oligonucleotide
  Description of Combined DNA/RNA Molecule: Synthetic oligonucleotide
uuucuuggccatctccuuca

SEQ ID NO: 1192 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 1193 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauuucu

SEQ ID NO: 1194 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauuucu

SEQ ID NO: 1195 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 1196 - DNA, 20 bp, Artificial Sequence
  Description of Artificial Sequence: Synthetic oligonucleotide
  Description of Combined DNA/RNA Molecule: Synthetic oligonucleotide
tcaaggaagatggcauuucu

SEQ ID NO: 1197 - RNA, 20 nt, Artificial Sequence
  Description of Artificial Sequence: Synthetic oligonucleotide
ucaaggaagauggcauuucu

SEQ ID NO: 1198 - RNA, 20 nt, Artificial Sequence
  Description of Artificial Sequence: Synthetic oligonucleotide
uuuuggcagcuuuccaccaa

SEQ ID NO: 1199 - RNA, 20 nt, Artificial Sequence
  Description of Artificial Sequence: Synthetic oligonucleotide
uuuuggcagcuuuccaccaa

SEQ ID NO: 1200 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1201 - RNA, 20 nt, Artificial Sequence
  Description of Artificial Sequence: Synthetic oligonucleotide
uuuuggcagcuuuccaccaa

SEQ ID NO: 1202 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1203 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1204 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1205 - RNA, 20 nt, Artificial Sequence
  Description of Artificial Sequence: Synthetic oligonucleotide
uuuuggcagcuuuccaccaa

SEQ ID NO: 1206 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1207 - RNA, 20 nt, Artificial Sequence
  Description of Artificial Sequence: Synthetic oligonucleotide
uuuuggcagcuuuccaccaa

SEQ ID NO: 1208 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1209 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1210 - RNA, 20 nt, Artificial Sequence
  Description of Artificial Sequence: Synthetic oligonucleotide
ucaaggaagauggcauuucu

SEQ ID NO: 1211 - DNA, 20 bp, Artificial Sequence
  Description of Artificial Sequence: Synthetic oligonucleotide
  Description of Combined DNA/RNA Molecule: Synthetic oligonucleotide
uuuuggcagcuttccaccaa

SEQ ID NO: 1212 - RNA, 20 nt, Artificial Sequence
  Description of Artificial Sequence: Synthetic oligonucleotide
cuccgguucugaagguguuc

SEQ ID NO: 1213 - DNA, 20 bp, Artificial Sequence
  Description of Artificial Sequence: Synthetic oligonucleotide
  Description of Combined DNA/RNA Molecule: Synthetic oligonucleotide
cuccggtuctgaagguguuc

SEQ ID NO: 1214 - DNA, 20 bp, Artificial Sequence
  Description of Artificial Sequence: Synthetic oligonucleotide
  Description of Combined DNA/RNA Molecule: Synthetic oligonucleotide
cuccggtuctgaagguguuc

SEQ ID NO: 1215 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1216 - RNA, 20 nt, Artificial Sequence
  Description of Artificial Sequence: Synthetic oligonucleotide
cuccgguucugaagguguuc

SEQ ID NO: 1217 - DNA, 20 bp, Artificial Sequence
  Description of Artificial Sequence: Synthetic oligonucleotide
  Description of Combined DNA/RNA Molecule: Synthetic oligonucleotide
cuccggtuctgaagguguuc

SEQ ID NO: 1218 - DNA, 20 bp, Artificial Sequence
  Description of Artificial Sequence: Synthetic oligonucleotide
  Description of Combined DNA/RNA Molecule: Synthetic oligonucleotide
cuccggtuctgaagguguuc

SEQ ID NO: 1219 - DNA, 20 bp, Artificial Sequence
  Description of Artificial Sequence: Synthetic oligonucleotide
  Description of Combined DNA/RNA Molecule: Synthetic oligonucleotide
cuccggtucugaagguguuc

SEQ ID NO: 1220 - RNA, 20 nt, Artificial Sequence
  Description of Artificial Sequence: Synthetic oligonucleotide
ggccaaaccucggcuuaccu

SEQ ID NO: 1221 - RNA, 20 nt, Artificial Sequence
  Description of Artificial Sequence: Synthetic oligonucleotide
cuccgguucugaagguguuc

SEQ ID NO: 1222 - RNA, 20 nt, Artificial Sequence
  Description of Artificial Sequence: Synthetic oligonucleotide
cuccgguucugaagguguuc

SEQ ID NO: 1223 - RNA, 20 nt, Artificial Sequence
  Description of Artificial Sequence: Synthetic oligonucleotide
cuccgguucugaagguguuc

SEQ ID NO: 1224 - RNA, 20 nt, Artificial Sequence
  Description of Artificial Sequence: Synthetic oligonucleotide
cuccgguucugaagguguuc

SEQ ID NO: 1225 - RNA, 20 nt, Artificial Sequence
  Description of Artificial Sequence: Synthetic oligonucleotide
cuccgguucugaagguguuc

SEQ ID NO: 1226 - RNA, 20 nt, Artificial Sequence
  Description of Artificial Sequence: Synthetic oligonucleotide
cuccgguucugaagguguuc

SEQ ID NO: 1227 - RNA, 20 nt, Artificial Sequence
  Description of Artificial Sequence: Synthetic oligonucleotide
cuccgguucugaagguguuc

SEQ ID NO: 1228 - RNA, 20 nt, Artificial Sequence
  Description of Artificial Sequence: Synthetic oligonucleotide
cuccgguucugaagguguuc

SEQ ID NO: 1229 - RNA, 20 nt, Artificial Sequence
  Description of Artificial Sequence: Synthetic oligonucleotide
cuccgguucugaagguguuc

SEQ ID NO: 1230 - RNA, 20 nt, Artificial Sequence
  Description of Artificial Sequence: Synthetic oligonucleotide
cuccgguucugaagguguuc

SEQ ID NO: 1231 - RNA, 20 nt, Artificial Sequence
  Description of Artificial Sequence: Synthetic oligonucleotide
cuccgguucugaagguguuc

SEQ ID NO: 1232 - RNA, 20 nt, Artificial Sequence
  Description of Artificial Sequence: Synthetic oligonucleotide
cuccgguucugaagguguuc

SEQ ID NO: 1233 - RNA, 20 nt, Artificial Sequence
  Description of Artificial Sequence: Synthetic oligonucleotide
cuccgguucugaagguguuc

SEQ ID NO: 1234 - RNA, 20 nt, Artificial Sequence
  Description of Artificial Sequence: Synthetic oligonucleotide
cuccgguucugaagguguuc

SEQ ID NO: 1235 - RNA, 20 nt, Artificial Sequence
  Description of Artificial Sequence: Synthetic oligonucleotide
cuccgguucugaagguguuc

SEQ ID NO: 1236 - RNA, 20 nt, Artificial Sequence
  Description of Artificial Sequence: Synthetic oligonucleotide
cuccgguucugaagguguuc

SEQ ID NO: 1237 - RNA, 20 nt, Artificial Sequence
  Description of Artificial Sequence: Synthetic oligonucleotide
cuccgguucugaagguguuc

SEQ ID NO: 1238 - RNA, 20 nt, Artificial Sequence
  Description of Artificial Sequence: Synthetic oligonucleotide
cuccgguucugaagguguuc

SEQ ID NO: 1239 - RNA, 20 nt, Artificial Sequence
  Description of Artificial Sequence: Synthetic oligonucleotide
cuccgguucugaagguguuc

SEQ ID NO: 1240 - RNA, 20 nt, Artificial Sequence
  Description of Artificial Sequence: Synthetic oligonucleotide
cuccgguucugaagguguuc

SEQ ID NO: 1241 - RNA, 20 nt, Artificial Sequence
  Description of Artificial Sequence: Synthetic oligonucleotide
cuccgguucugaagguguuc

SEQ ID NO: 1242 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 1243 - DNA, 20 bp, Artificial Sequence
  Description of Artificial Sequence: Synthetic oligonucleotide
  Description of Combined DNA/RNA Molecule: Synthetic oligonucleotide
tcaaggaagauggcauuucu

SEQ ID NO: 1244 - RNA, 25 nt, Artificial Sequence
  Description of Artificial Sequence: Synthetic oligonucleotide
aauauucuucuaaagaaagcuuaaa

SEQ ID NO: 1245 - RNA, 25 nt, Artificial Sequence
  Description of Artificial Sequence: Synthetic oligonucleotide
ucuucuaaagaaagcuuaaaaaguc

SEQ ID NO: 1246 - RNA, 25 nt, Artificial Sequence
  Description of Artificial Sequence: Synthetic oligonucleotide
uaaagaaagcuuaaaaagucugcua

SEQ ID NO: 1247 - RNA, 25 nt, Artificial Sequence
  Description of Artificial Sequence: Synthetic oligonucleotide
aaagcuuaaaaagucugcuaaaaug

SEQ ID NO: 1248 - RNA, 25 nt, Artificial Sequence
  Description of Artificial Sequence: Synthetic oligonucleotide
uuaaaaagucugcuaaaauguuuuc

SEQ ID NO: 1249 - RNA, 25 nt, Artificial Sequence
  Description of Artificial Sequence: Synthetic oligonucleotide
aagucugcuaaaauguuuucauucc

SEQ ID NO: 1250 - RNA, 25 nt, Artificial Sequence
  Description of Artificial Sequence: Synthetic oligonucleotide
ugcuaaaauguuuucauuccuauua

SEQ ID NO: 1251 - RNA, 25 nt, Artificial Sequence
  Description of Artificial Sequence: Synthetic oligonucleotide
aaauguuuucauuccuauuagaucu

SEQ ID NO: 1252 - RNA, 25 nt, Artificial Sequence
  Description of Artificial Sequence: Synthetic oligonucleotide
uuuucauuccuauuagaucugucgc

SEQ ID NO: 1253 - RNA, 25 nt, Artificial Sequence
  Description of Artificial Sequence: Synthetic oligonucleotide
auuccuauuagaucugucgcccuac

SEQ ID NO: 1254 - RNA, 25 nt, Artificial Sequence
  Description of Artificial Sequence: Synthetic oligonucleotide
uauuagaucugucgcccuaccucuu

SEQ ID NO: 1255 - RNA, 25 nt, Artificial Sequence
  Description of Artificial Sequence: Synthetic oligonucleotide
gaucugucgcccuaccucuuuuuuc

SEQ ID NO: 1256 - RNA, 25 nt, Artificial Sequence
  Description of Artificial Sequence: Synthetic oligonucleotide
gucgcccuaccucuuuuuucugucu

SEQ ID NO: 1257 - RNA, 25 nt, Artificial Sequence
  Description of Artificial Sequence: Synthetic oligonucleotide
ccuaccucuuuuuucugucugacag

SEQ ID NO: 1258 - RNA, 25 nt, Artificial Sequence
  Description of Artificial Sequence: Synthetic oligonucleotide
cucuuuuuucugucugacagcuguu

SEQ ID NO: 1259 - RNA, 25 nt, Artificial Sequence
  Description of Artificial Sequence: Synthetic oligonucleotide
uuuucugucugacagcuguuugcag

SEQ ID NO: 1260 - RNA, 25 nt, Artificial Sequence
  Description of Artificial Sequence: Synthetic oligonucleotide
ugucugacagcuguuugcagaccuc

SEQ ID NO: 1261 - RNA, 25 nt, Artificial Sequence
  Description of Artificial Sequence: Synthetic oligonucleotide
gacagcuguuugcagaccuccugcc

SEQ ID NO: 1262 - RNA, 25 nt, Artificial Sequence
  Description of Artificial Sequence: Synthetic oligonucleotide
cuguuugcagaccuccugccaccgc

SEQ ID NO: 1263 - RNA, 25 nt, Artificial Sequence
  Description of Artificial Sequence: Synthetic oligonucleotide
ugcagaccuccugccaccgcagauu

SEQ ID NO: 1264 - RNA, 25 nt, Artificial Sequence
  Description of Artificial Sequence: Synthetic oligonucleotide
accuccugccaccgcagauucaggc

SEQ ID NO: 1265 - RNA, 25 nt, Artificial Sequence
  Description of Artificial Sequence: Synthetic oligonucleotide
cugccaccgcagauucaggcuuccc

SEQ ID NO: 1266 - RNA, 25 nt, Artificial Sequence
  Description of Artificial Sequence: Synthetic oligonucleotide
accgcagauucaggcuucccaauuu

SEQ ID NO: 1267 - RNA, 25 nt, Artificial Sequence
  Description of Artificial Sequence: Synthetic oligonucleotide
agauucaggcuucccaauuuuuccu

SEQ ID NO: 1268 - RNA, 25 nt, Artificial Sequence
  Description of Artificial Sequence: Synthetic oligonucleotide
caggcuucccaauuuuuccuguaga

SEQ ID NO: 1269 - RNA, 25 nt, Artificial Sequence
  Description of Artificial Sequence: Synthetic oligonucleotide
uucccaauuuuuccuguagaauacu

SEQ ID NO: 1270 - RNA, 25 nt, Artificial Sequence
  Description of Artificial Sequence: Synthetic oligonucleotide
aauuuuuccuguagaauacuggcau

SEQ ID NO: 1271 - RNA, 25 nt, Artificial Sequence
  Description of Artificial Sequence: Synthetic oligonucleotide
uuccuguagaauacuggcaucuguu

SEQ ID NO: 1272 - RNA, 25 nt, Artificial Sequence
  Description of Artificial Sequence: Synthetic oligonucleotide
guagaauacuggcaucuguuuuuga

SEQ ID NO: 1273 - RNA, 25 nt, Artificial Sequence
  Description of Artificial Sequence: Synthetic oligonucleotide
auacuggcaucuguuuuugaggauu

SEQ ID NO: 1274 - RNA, 25 nt, Artificial Sequence
  Description of Artificial Sequence: Synthetic oligonucleotide
ggcaucuguuuuugaggauugcuga

SEQ ID NO: 1275 - RNA, 25 nt, Artificial Sequence
  Description of Artificial Sequence: Synthetic oligonucleotide
cuguuuuugaggauugcugaauuau

SEQ ID NO: 1276 - RNA, 25 nt, Artificial Sequence
  Description of Artificial Sequence: Synthetic oligonucleotide
uuugaggauugcugaauuauuucuu

SEQ ID NO: 1277 - RNA, 25 nt, Artificial Sequence
  Description of Artificial Sequence: Synthetic oligonucleotide
ggauugcugaauuauuucuucccca

SEQ ID NO: 1278 - RNA, 25 nt, Artificial Sequence
  Description of Artificial Sequence: Synthetic oligonucleotide
gcugaauuauuucuuccccaguugc

SEQ ID NO: 1279 - RNA, 25 nt, Artificial Sequence
  Description of Artificial Sequence: Synthetic oligonucleotide
auuauuucuuccccaguugcauuca

SEQ ID NO: 1280 - RNA, 25 nt, Artificial Sequence
  Description of Artificial Sequence: Synthetic oligonucleotide
uucuuccccaguugcauucaauguu

SEQ ID NO: 1281 - RNA, 25 nt, Artificial Sequence
  Description of Artificial Sequence: Synthetic oligonucleotide
ccccaguugcauucaauguucugac

SEQ ID NO: 1282 - RNA, 25 nt, Artificial Sequence
  Description of Artificial Sequence: Synthetic oligonucleotide
guugcauucaauguucugacaacag

SEQ ID NO: 1283 - RNA, 25 nt, Artificial Sequence
  Description of Artificial Sequence: Synthetic oligonucleotide
auucaauguucugacaacaguuugc

SEQ ID NO: 1284 - RNA, 25 nt, Artificial Sequence
  Description of Artificial Sequence: Synthetic oligonucleotide
auguucugacaacaguuugccgcug

SEQ ID NO: 1285 - RNA, 25 nt, Artificial Sequence
  Description of Artificial Sequence: Synthetic oligonucleotide
cugacaacaguuugccgcugcccaa

SEQ ID NO: 1286 - RNA, 25 nt, Artificial Sequence
  Description of Artificial Sequence: Synthetic oligonucleotide
aacaguuugccgcugcccaaugcca

SEQ ID NO: 1287 - RNA, 25 nt, Artificial Sequence
  Description of Artificial Sequence: Synthetic oligonucleotide
uuugccgcugcccaaugccauccug

SEQ ID NO: 1288 - RNA, 25 nt, Artificial Sequence
  Description of Artificial Sequence: Synthetic oligonucleotide
cgcugcccaaugccauccuggaguu

SEQ ID NO: 1289 - RNA, 25 nt, Artificial Sequence
  Description of Artificial Sequence: Synthetic oligonucleotide
cccaaugccauccuggaguuccugu

SEQ ID NO: 1290 - RNA, 25 nt, Artificial Sequence
  Description of Artificial Sequence: Synthetic oligonucleotide
ugccauccuggaguuccuguaagau

SEQ ID NO: 1291 - RNA, 25 nt, Artificial Sequence
  Description of Artificial Sequence: Synthetic oligonucleotide
uccuggaguuccuguaagauaccaa

SEQ ID NO: 1292 - RNA, 25 nt, Artificial Sequence
  Description of Artificial Sequence: Synthetic oligonucleotide
gaguuccuguaagauaccaaaaagg

SEQ ID NO: 1293 - RNA, 25 nt, Artificial Sequence
  Description of Artificial Sequence: Synthetic oligonucleotide
ccuguaagauaccaaaaaggcaaaa

SEQ ID NO: 1294 - RNA, 25 nt, Artificial Sequence
  Description of Artificial Sequence: Synthetic oligonucleotide
aagauaccaaaaaggcaaaacaaaa

SEQ ID NO: 1295 - RNA, 25 nt, Artificial Sequence
  Description of Artificial Sequence: Synthetic oligonucleotide
accaaaaaggcaaaacaaaaaugaa

SEQ ID NO: 1296 - RNA, 25 nt, Artificial Sequence
  Description of Artificial Sequence: Synthetic oligonucleotide
aaaggcaaaacaaaaaugaagcccc

SEQ ID NO: 1297 - RNA, 25 nt, Artificial Sequence
  Description of Artificial Sequence: Synthetic oligonucleotide
caaaacaaaaaugaagccccauguc

SEQ ID NO: 1298 - RNA, 25 nt, Artificial Sequence
  Description of Artificial Sequence: Synthetic oligonucleotide
caaaaaugaagccccaugucuuuuu

SEQ ID NO: 1299 - RNA, 25 nt, Artificial Sequence
  Description of Artificial Sequence: Synthetic oligonucleotide
augaagccccaugucuuuuuauuug

SEQ ID NO: 1300 - RNA, 25 nt, Artificial Sequence
  Description of Artificial Sequence: Synthetic oligonucleotide
gccccaugucuuuuuauuugagaaa

SEQ ID NO: 1301 - RNA, 25 nt, Artificial Sequence
  Description of Artificial Sequence: Synthetic oligonucleotide
augucuuuuuauuugagaaaagauu

SEQ ID NO: 1302 - RNA, 25 nt, Artificial Sequence
  Description of Artificial Sequence: Synthetic oligonucleotide
uuuuuauuugagaaaagauuaaaca

SEQ ID NO: 1303 - RNA, 25 nt, Artificial Sequence
  Description of Artificial Sequence: Synthetic oligonucleotide
auuugagaaaagauuaaacagugug

SEQ ID NO: 1304 - RNA, 25 nt, Artificial Sequence
  Description of Artificial Sequence: Synthetic oligonucleotide
agaaaagauuaaacagugugcuacc

SEQ ID NO: 1305 - RNA, 25 nt, Artificial Sequence
  Description of Artificial Sequence: Synthetic oligonucleotide
agauuaaacagugugcuaccacaug

SEQ ID NO: 1306 - RNA, 25 nt, Artificial Sequence
  Description of Artificial Sequence: Synthetic oligonucleotide
aaacagugugcuaccacaugcaguu

SEQ ID NO: 1307 - RNA, 25 nt, Artificial Sequence
  Description of Artificial Sequence: Synthetic oligonucleotide
gugugcuaccacaugcaguuguacu

SEQ ID NO: 1308 - RNA, 25 nt, Artificial Sequence
  Description of Artificial Sequence: Synthetic oligonucleotide
uugccgcugcccaaugccauccugg

SEQ ID NO: 1309 - RNA, 17 nt, Artificial Sequence
  Description of Artificial Sequence: Synthetic oligonucleotide
gcccaaugccauccugg

SEQ ID NO: 1310 - RNA, 20 nt, Artificial Sequence
  Description of Artificial Sequence: Synthetic oligonucleotide
uucugaagguguucuuguac

SEQ ID NO: 1311 - RNA, 20 nt, Artificial Sequence
  Description of Artificial Sequence: Synthetic oligonucleotide
uucugaagguguucuuguac

SEQ ID NO: 1312 - RNA, 20 nt, Artificial Sequence
  Description of Artificial Sequence: Synthetic oligonucleotide
uucugaagguguucuuguac

SEQ ID NO: 1313 - RNA, 20 nt, Artificial Sequence
  Description of Artificial Sequence: Synthetic oligonucleotide
uucugaagguguucuuguac

SEQ ID NO: 1314 - RNA, 20 nt, Artificial Sequence
  Description of Artificial Sequence: Synthetic oligonucleotide
uucugaagguguucuuguac

SEQ ID NO: 1315 - RNA, 20 nt, Artificial Sequence
  Description of Artificial Sequence: Synthetic oligonucleotide
uucugaagguguucuuguac

SEQ ID NO: 1316 - RNA, 20 nt, Artificial Sequence
  Description of Artificial Sequence: Synthetic oligonucleotide
uucugaagguguucuuguac

SEQ ID NO: 1317 - RNA, 20 nt, Artificial Sequence
  Description of Artificial Sequence: Synthetic oligonucleotide
uucugaagguguucuuguac

SEQ ID NO: 1318 - RNA, 20 nt, Artificial Sequence
  Description of Artificial Sequence: Synthetic oligonucleotide
uucugaagguguucuuguac

SEQ ID NO: 1319 - RNA, 20 nt, Artificial Sequence
  Description of Artificial Sequence: Synthetic oligonucleotide
uucugaagguguucuuguac

SEQ ID NO: 1320 - RNA, 20 nt, Artificial Sequence
  Description of Artificial Sequence: Synthetic oligonucleotide
uucugaagguguucuuguac

SEQ ID NO: 1321 - RNA, 20 nt, Artificial Sequence
  Description of Artificial Sequence: Synthetic oligonucleotide
uucugaagguguucuuguac

SEQ ID NO: 1322 - RNA, 20 nt, Artificial Sequence
  Description of Artificial Sequence: Synthetic oligonucleotide
cuccgguucugaagguguuc

SEQ ID NO: 1323 - RNA, 20 nt, Artificial Sequence
  Description of Artificial Sequence: Synthetic oligonucleotide
cuccgguucugaagguguuc

SEQ ID NO: 1324 - RNA, 20 nt, Artificial Sequence
  Description of Artificial Sequence: Synthetic oligonucleotide
cuccgguucugaagguguuc

SEQ ID NO: 1325 - RNA, 20 nt, Artificial Sequence
  Description of Artificial Sequence: Synthetic oligonucleotide
cuccgguucugaagguguuc

SEQ ID NO: 1326 - RNA, 20 nt, Artificial Sequence
  Description of Artificial Sequence: Synthetic oligonucleotide
cuccgguucugaagguguuc

SEQ ID NO: 1327 - RNA, 20 nt, Artificial Sequence
  Description of Artificial Sequence: Synthetic oligonucleotide
cuccgguucugaagguguuc

SEQ ID NO: 1328 - RNA, 20 nt, Artificial Sequence
  Description of Artificial Sequence: Synthetic oligonucleotide
cuccgguucugaagguguuc

SEQ ID NO: 1329 - RNA, 20 nt, Artificial Sequence
  Description of Artificial Sequence: Synthetic oligonucleotide
cuccgguucugaagguguuc

SEQ ID NO: 1330 - RNA, 20 nt, Artificial Sequence
  Description of Artificial Sequence: Synthetic oligonucleotide
cuccgguucugaagguguuc

SEQ ID NO: 1331 - RNA, 20 nt, Artificial Sequence
  Description of Artificial Sequence: Synthetic oligonucleotide
cuccgguucugaagguguuc

SEQ ID NO: 1332 - RNA, 20 nt, Artificial Sequence
  Description of Artificial Sequence: Synthetic oligonucleotide
cuccgguucugaagguguuc

SEQ ID NO: 1333 - RNA, 20 nt, Artificial Sequence
  Description of Artificial Sequence: Synthetic oligonucleotide
cuccgguucugaagguguuc

SEQ ID NO: 1334 - RNA, 20 nt, Artificial Sequence
  Description of Artificial Sequence: Synthetic oligonucleotide
cuccgguucugaagguguuc

SEQ ID NO: 1335 - RNA, 20 nt, Artificial Sequence
  Description of Artificial Sequence: Synthetic oligonucleotide
ucaaggaagauggcauuucu

SEQ ID NO: 1336 - RNA, 20 nt, Artificial Sequence
  Description of Artificial Sequence: Synthetic oligonucleotide
ucaaggaagauggcauuucu

SEQ ID NO: 1337 - RNA, 20 nt, Artificial Sequence
  Description of Artificial Sequence: Synthetic oligonucleotide
ucaaggaagauggcauuucu

SEQ ID NO: 1338 - RNA, 20 nt, Artificial Sequence
  Description of Artificial Sequence: Synthetic oligonucleotide
ucaaggaagauggcauuucu

SEQ ID NO: 1339 - RNA, 20 nt, Artificial Sequence
  Description of Artificial Sequence: Synthetic oligonucleotide
ucaaggaagauggcauuucu

SEQ ID NO: 1340 - RNA, 20 nt, Artificial Sequence
  Description of Artificial Sequence: Synthetic oligonucleotide
ucaaggaagauggcauuucu

SEQ ID NO: 1341 - RNA, 20 nt, Artificial Sequence
  Description of Artificial Sequence: Synthetic oligonucleotide
cuccgguucugaagguguuc

SEQ ID NO: 1342 - RNA, 20 nt, Artificial Sequence
  Description of Artificial Sequence: Synthetic oligonucleotide
cuccgguucugaagguguuc

SEQ ID NO: 1343 - RNA, 20 nt, Artificial Sequence
  Description of Artificial Sequence: Synthetic oligonucleotide
cuccgguucugaagguguuc

SEQ ID NO: 1344 - RNA, 20 nt, Artificial Sequence
  Description of Artificial Sequence: Synthetic oligonucleotide
uucugaagguguucuuguac

SEQ ID NO: 1345 - RNA, 20 nt, Artificial Sequence
  Description of Artificial Sequence: Synthetic oligonucleotide
uucugaagguguucuuguac

SEQ ID NO: 1346 - RNA, 20 nt, Artificial Sequence
  Description of Artificial Sequence: Synthetic oligonucleotide
uucugaagguguucuuguac

SEQ ID NO: 1347 - RNA, 20 nt, Artificial Sequence
  Description of Artificial Sequence: Synthetic oligonucleotide
uucugaagguguucuuguac

SEQ ID NO: 1348 - RNA, 20 nt, Artificial Sequence
  Description of Artificial Sequence: Synthetic oligonucleotide
uucugaagguguucuuguac

SEQ ID NO: 1349 - RNA, 20 nt, Artificial Sequence
  Description of Artificial Sequence: Synthetic oligonucleotide
uucugaagguguucuuguac

SEQ ID NO: 1350 - RNA, 20 nt, Artificial Sequence
  Description of Artificial Sequence: Synthetic oligonucleotide
uucugaagguguucuuguac

SEQ ID NO: 1351 - RNA, 20 nt, Artificial Sequence
  Description of Artificial Sequence: Synthetic oligonucleotide
uucugaagguguucuuguac

SEQ ID NO: 1352 - RNA, 20 nt, Artificial Sequence
  Description of Artificial Sequence: Synthetic oligonucleotide
uucugaagguguucuuguac

SEQ ID NO: 1353 - RNA, 20 nt, Artificial Sequence
  Description of Artificial Sequence: Synthetic oligonucleotide
uucugaagguguucuuguac

SEQ ID NO: 1354 - RNA, 20 nt, Artificial Sequence
  Description of Artificial Sequence: Synthetic oligonucleotide
uucugaagguguucuuguac

SEQ ID NO: 1355 - RNA, 20 nt, Artificial Sequence
  Description of Artificial Sequence: Synthetic oligonucleotide
uucugaagguguucuuguac

SEQ ID NO: 1356 - RNA, 20 nt, Artificial Sequence
  Description of Artificial Sequence: Synthetic oligonucleotide
uucugaagguguucuuguac

SEQ ID NO: 1357 - RNA, 20 nt, Artificial Sequence
  Description of Artificial Sequence: Synthetic oligonucleotide
uucugaagguguucuuguac

SEQ ID NO: 1358 - RNA, 20 nt, Artificial Sequence
  Description of Artificial Sequence: Synthetic oligonucleotide
uucugaagguguucuuguac

SEQ ID NO: 1359 - RNA, 20 nt, Artificial Sequence
  Description of Artificial Sequence: Synthetic oligonucleotide
uucugaagguguucuuguac

SEQ ID NO: 1360 - RNA, 25 nt, Artificial Sequence
  Description of Artificial Sequence: Synthetic oligonucleotide
aauauucuucuaaagaaagcuuaaa

SEQ ID NO: 1361 - RNA, 25 nt, Artificial Sequence
  Description of Artificial Sequence: Synthetic oligonucleotide
ucuucuaaagaaagcuuaaaaaguc

SEQ ID NO: 1362 - RNA, 25 nt, Artificial Sequence
  Description of Artificial Sequence: Synthetic oligonucleotide
uaaagaaagcuuaaaaagucugcua

SEQ ID NO: 1363 - RNA, 25 nt, Artificial Sequence
  Description of Artificial Sequence: Synthetic oligonucleotide
aaagcuuaaaaagucugcuaaaaug

SEQ ID NO: 1364 - RNA, 25 nt, Artificial Sequence
  Description of Artificial Sequence: Synthetic oligonucleotide
uuaaaaagucugcuaaaauguuuuc

SEQ ID NO: 1365 - RNA, 25 nt, Artificial Sequence
  Description of Artificial Sequence: Synthetic oligonucleotide
aagucugcuaaaauguuuucauucc

SEQ ID NO: 1366 - RNA, 25 nt, Artificial Sequence
  Description of Artificial Sequence: Synthetic oligonucleotide
ugcuaaaauguuuucauuccuauua

SEQ ID NO: 1367 - RNA, 25 nt, Artificial Sequence
  Description of Artificial Sequence: Synthetic oligonucleotide
aaauguuuucauuccuauuagaucu

SEQ ID NO: 1368 - RNA, 25 nt, Artificial Sequence
  Description of Artificial Sequence: Synthetic oligonucleotide
uuuucauuccuauuagaucugucgc

SEQ ID NO: 1369 - RNA, 25 nt, Artificial Sequence
  Description of Artificial Sequence: Synthetic oligonucleotide
auuccuauuagaucugucgcccuac

SEQ ID NO: 1370 - RNA, 25 nt, Artificial Sequence
  Description of Artificial Sequence: Synthetic oligonucleotide
uauuagaucugucgcccuaccucuu

SEQ ID NO: 1371 - RNA, 25 nt, Artificial Sequence
  Description of Artificial Sequence: Synthetic oligonucleotide
gaucugucgcccuaccucuuuuuuc

SEQ ID NO: 1372 - RNA, 25 nt, Artificial Sequence
  Description of Artificial Sequence: Synthetic oligonucleotide
gucgcccuaccucuuuuuucugucu

SEQ ID NO: 1373 - RNA, 25 nt, Artificial Sequence
  Description of Artificial Sequence: Synthetic oligonucleotide
ccuaccucuuuuuucugucugacag

SEQ ID NO: 1374 - RNA, 25 nt, Artificial Sequence
  Description of Artificial Sequence: Synthetic oligonucleotide
cucuuuuuucugucugacagcuguu

SEQ ID NO: 1375 - RNA, 25 nt, Artificial Sequence
  Description of Artificial Sequence: Synthetic oligonucleotide
uuuucugucugacagcuguuugcag

SEQ ID NO: 1376 - RNA, 25 nt, Artificial Sequence
  Description of Artificial Sequence: Synthetic oligonucleotide
ugucugacagcuguuugcagaccuc

SEQ ID NO: 1377 - RNA, 25 nt, Artificial Sequence
  Description of Artificial Sequence: Synthetic oligonucleotide
gacagcuguuugcagaccuccugcc

SEQ ID NO: 1378 - RNA, 25 nt, Artificial Sequence
  Description of Artificial Sequence: Synthetic oligonucleotide
cuguuugcagaccuccugccaccgc

SEQ ID NO: 1379 - RNA, 25 nt, Artificial Sequence
  Description of Artificial Sequence: Synthetic oligonucleotide
ugcagaccuccugccaccgcagauu

SEQ ID NO: 1380 - RNA, 25 nt, Artificial Sequence
  Description of Artificial Sequence: Synthetic oligonucleotide
accuccugccaccgcagauucaggc

SEQ ID NO: 1381 - RNA, 25 nt, Artificial Sequence
  Description of Artificial Sequence: Synthetic oligonucleotide
cugccaccgcagauucaggcuuccc

SEQ ID NO: 1382 - RNA, 25 nt, Artificial Sequence
  Description of Artificial Sequence: Synthetic oligonucleotide
accgcagauucaggcuucccaauuu

SEQ ID NO: 1383 - RNA, 25 nt, Artificial Sequence
  Description of Artificial Sequence: Synthetic oligonucleotide
agauucaggcuucccaauuuuuccu

SEQ ID NO: 1384 - RNA, 25 nt, Artificial Sequence
  Description of Artificial Sequence: Synthetic oligonucleotide
caggcuucccaauuuuuccuguaga

SEQ ID NO: 1385 - RNA, 25 nt, Artificial Sequence
  Description of Artificial Sequence: Synthetic oligonucleotide
uucccaauuuuuccuguagaauacu

SEQ ID NO: 1386 - RNA, 25 nt, Artificial Sequence
  Description of Artificial Sequence: Synthetic oligonucleotide
aauuuuuccuguagaauacuggcau

SEQ ID NO: 1387 - RNA, 25 nt, Artificial Sequence
  Description of Artificial Sequence: Synthetic oligonucleotide
uuccuguagaauacuggcaucuguu

SEQ ID NO: 1388 - RNA, 25 nt, Artificial Sequence
  Description of Artificial Sequence: Synthetic oligonucleotide
guagaauacuggcaucuguuuuuga

SEQ ID NO: 1389 - RNA, 25 nt, Artificial Sequence
  Description of Artificial Sequence: Synthetic oligonucleotide
auacuggcaucuguuuuugaggauu

SEQ ID NO: 1390 - RNA, 25 nt, Artificial Sequence
  Description of Artificial Sequence: Synthetic oligonucleotide
ggcaucuguuuuugaggauugcuga

SEQ ID NO: 1391 - RNA, 25 nt, Artificial Sequence
  Description of Artificial Sequence: Synthetic oligonucleotide
cuguuuuugaggauugcugaauuau

SEQ ID NO: 1392 - RNA, 25 nt, Artificial Sequence
  Description of Artificial Sequence: Synthetic oligonucleotide
uuugaggauugcugaauuauuucuu

SEQ ID NO: 1393 - RNA, 25 nt, Artificial Sequence
  Description of Artificial Sequence: Synthetic oligonucleotide
ggauugcugaauuauuucuucccca

SEQ ID NO: 1394 - RNA, 25 nt, Artificial Sequence
  Description of Artificial Sequence: Synthetic oligonucleotide
gcugaauuauuucuuccccaguugc

SEQ ID NO: 1395 - RNA, 25 nt, Artificial Sequence
  Description of Artificial Sequence: Synthetic oligonucleotide
auuauuucuuccccaguugcauuca

SEQ ID NO: 1396 - RNA, 25 nt, Artificial Sequence
  Description of Artificial Sequence: Synthetic oligonucleotide
uucuuccccaguugcauucaauguu

SEQ ID NO: 1397 - RNA, 25 nt, Artificial Sequence
  Description of Artificial Sequence: Synthetic oligonucleotide
ccccaguugcauucaauguucugac

SEQ ID NO: 1398 - RNA, 25 nt, Artificial Sequence
  Description of Artificial Sequence: Synthetic oligonucleotide
guugcauucaauguucugacaacag

SEQ ID NO: 1399 - RNA, 25 nt, Artificial Sequence
  Description of Artificial Sequence: Synthetic oligonucleotide
auucaauguucugacaacaguuugc

SEQ ID NO: 1400 - RNA, 25 nt, Artificial Sequence
  Description of Artificial Sequence: Synthetic oligonucleotide
auguucugacaacaguuugccgcug

SEQ ID NO: 1401 - RNA, 25 nt, Artificial Sequence
  Description of Artificial Sequence: Synthetic oligonucleotide
cugacaacaguuugccgcugcccaa

SEQ ID NO: 1402 - RNA, 25 nt, Artificial Sequence
  Description of Artificial Sequence: Synthetic oligonucleotide
aacaguuugccgcugcccaaugcca

SEQ ID NO: 1403 - RNA, 25 nt, Artificial Sequence
  Description of Artificial Sequence: Synthetic oligonucleotide
uuugccgcugcccaaugccauccug

SEQ ID NO: 1404 - RNA, 25 nt, Artificial Sequence
  Description of Artificial Sequence: Synthetic oligonucleotide
cgcugcccaaugccauccuggaguu

SEQ ID NO: 1405 - RNA, 25 nt, Artificial Sequence
  Description of Artificial Sequence: Synthetic oligonucleotide
cccaaugccauccuggaguuccugu

SEQ ID NO: 1406 - RNA, 25 nt, Artificial Sequence
  Description of Artificial Sequence: Synthetic oligonucleotide
ugccauccuggaguuccuguaagau

SEQ ID NO: 1407 - RNA, 25 nt, Artificial Sequence
  Description of Artificial Sequence: Synthetic oligonucleotide
uccuggaguuccuguaagauaccaa

SEQ ID NO: 1408 - RNA, 25 nt, Artificial Sequence
  Description of Artificial Sequence: Synthetic oligonucleotide
gaguuccuguaagauaccaaaaagg

SEQ ID NO: 1409 - RNA, 25 nt, Artificial Sequence
  Description of Artificial Sequence: Synthetic oligonucleotide
ccuguaagauaccaaaaaggcaaaa

SEQ ID NO: 1410 - RNA, 25 nt, Artificial Sequence
  Description of Artificial Sequence: Synthetic oligonucleotide
aagauaccaaaaaggcaaaacaaaa

SEQ ID NO: 1411 - RNA, 25 nt, Artificial Sequence
  Description of Artificial Sequence: Synthetic oligonucleotide
accaaaaaggcaaaacaaaaaugaa

SEQ ID NO: 1412 - RNA, 25 nt, Artificial Sequence
  Description of Artificial Sequence: Synthetic oligonucleotide
aaaggcaaaacaaaaaugaagcccc

SEQ ID NO: 1413 - RNA, 25 nt, Artificial Sequence
  Description of Artificial Sequence: Synthetic oligonucleotide
caaaacaaaaaugaagccccauguc

SEQ ID NO: 1414 - RNA, 25 nt, Artificial Sequence
  Description of Artificial Sequence: Synthetic oligonucleotide
caaaaaugaagccccaugucuuuuu

SEQ ID NO: 1415 - RNA, 25 nt, Artificial Sequence
  Description of Artificial Sequence: Synthetic oligonucleotide
augaagccccaugucuuuuuauuug

SEQ ID NO: 1416 - RNA, 25 nt, Artificial Sequence
  Description of Artificial Sequence: Synthetic oligonucleotide
gccccaugucuuuuuauuugagaaa

SEQ ID NO: 1417 - RNA, 25 nt, Artificial Sequence
  Description of Artificial Sequence: Synthetic oligonucleotide
augucuuuuuauuugagaaaagauu

SEQ ID NO: 1418 - RNA, 25 nt, Artificial Sequence
  Description of Artificial Sequence: Synthetic oligonucleotide
uuuuuauuugagaaaagauuaaaca

SEQ ID NO: 1419 - RNA, 25 nt, Artificial Sequence
  Description of Artificial Sequence: Synthetic oligonucleotide
auuugagaaaagauuaaacagugug

SEQ ID NO: 1420 - RNA, 25 nt, Artificial Sequence
  Description of Artificial Sequence: Synthetic oligonucleotide
agaaaagauuaaacagugugcuacc

SEQ ID NO: 1421 - RNA, 25 nt, Artificial Sequence
  Description of Artificial Sequence: Synthetic oligonucleotide
agauuaaacagugugcuaccacaug

SEQ ID NO: 1422 - RNA, 25 nt, Artificial Sequence
  Description of Artificial Sequence: Synthetic oligonucleotide
aaacagugugcuaccacaugcaguu

SEQ ID NO: 1423 - RNA, 25 nt, Artificial Sequence
  Description of Artificial Sequence: Synthetic oligonucleotide
gugugcuaccacaugcaguuguacu

SEQ ID NO: 1424 - RNA, 17 nt, Artificial Sequence
  Description of Artificial Sequence: Synthetic oligonucleotide
gcccaaugccauccugg

SEQ ID NO: 1425 - RNA, 30 nt, Artificial Sequence
  Description of Artificial Sequence: Synthetic oligonucleotide
ccacagguugugucaccagaguaacagucu

SEQ ID NO: 1426 - RNA, 30 nt, Artificial Sequence
  Description of Artificial Sequence: Synthetic oligonucleotide
gugucaccagaguaacagucugaguaggag

SEQ ID NO: 1427 - RNA, 30 nt, Artificial Sequence
  Description of Artificial Sequence: Synthetic oligonucleotide
agguugugucaccagaguaacagucugagu

SEQ ID NO: 1428 - RNA, 30 nt, Artificial Sequence
  Description of Artificial Sequence: Synthetic oligonucleotide
ggcaguuuccuuaguaaccacagguugugu

SEQ ID NO: 1429 - RNA, 30 nt, Artificial Sequence
  Description of Artificial Sequence: Synthetic oligonucleotide
agauggcaguuuccuuaguaaccacagguu

SEQ ID NO: 1430 - RNA, 30 nt, Artificial Sequence
  Description of Artificial Sequence: Synthetic oligonucleotide
auggcauuucuaguuuggagauggcaguuu

SEQ ID NO: 1431 - RNA, 30 nt, Artificial Sequence
  Description of Artificial Sequence: Synthetic oligonucleotide
uuauaacuugaucaagcagagaaagccagu

SEQ ID NO: 1432 - RNA, 30 nt, Artificial Sequence
  Description of Artificial Sequence: Synthetic oligonucleotide
auaccuucugcuugaugaucaucucguuga

SEQ ID NO: 1433 - RNA, 29 nt, Artificial Sequence
  Description of Artificial Sequence: Synthetic oligonucleotide
ugucaccagaguaacagucugaguaggag

SEQ ID NO: 1434 - RNA, 28 nt, Artificial Sequence
  Description of Artificial Sequence: Synthetic oligonucleotide
gucaccagaguaacagucugaguaggag

SEQ ID NO: 1435 - RNA, 27 nt, Artificial Sequence
  Description of Artificial Sequence: Synthetic oligonucleotide
ucaccagaguaacagucugaguaggag

SEQ ID NO: 1436 - RNA, 26 nt, Artificial Sequence
  Description of Artificial Sequence: Synthetic oligonucleotide
caccagaguaacagucugaguaggag

SEQ ID NO: 1437 - RNA, 25 nt, Artificial Sequence
  Description of Artificial Sequence: Synthetic oligonucleotide
accagaguaacagucugaguaggag

SEQ ID NO: 1438 - RNA, 30 nt, Artificial Sequence; identical to SEQ ID NO: 1425
  Description of Artificial Sequence: Synthetic oligonucleotide

SEQ ID NO: 1439 - RNA, 30 nt, Artificial Sequence; identical to SEQ ID NO: 1426
  Description of Artificial Sequence: Synthetic oligonucleotide

SEQ ID NO: 1440 - RNA, 30 nt, Artificial Sequence; identical to SEQ ID NO: 1427
  Description of Artificial Sequence: Synthetic oligonucleotide

SEQ ID NO: 1441 - RNA, 30 nt, Artificial Sequence; identical to SEQ ID NO: 1428
  Description of Artificial Sequence: Synthetic oligonucleotide

SEQ ID NO: 1442 - RNA, 30 nt, Artificial Sequence; identical to SEQ ID NO: 1429
  Description of Artificial Sequence: Synthetic oligonucleotide

SEQ ID NO: 1443 - RNA, 30 nt, Artificial Sequence; identical to SEQ ID NO: 1430
  Description of Artificial Sequence: Synthetic oligonucleotide

SEQ ID NO: 1444 - RNA, 30 nt, Artificial Sequence; identical to SEQ ID NO: 1431
  Description of Artificial Sequence: Synthetic oligonucleotide

SEQ ID NO: 1445 - RNA, 30 nt, Artificial Sequence; identical to SEQ ID NO: 1432
  Description of Artificial Sequence: Synthetic oligonucleotide

SEQ ID NO: 1446 - RNA, 29 nt, Artificial Sequence
  Description of Artificial Sequence: Synthetic oligonucleotide
ugucaccagaguaacagucugaguaggag

SEQ ID NO: 1447 - RNA, 28 nt, Artificial Sequence
  Description of Artificial Sequence: Synthetic oligonucleotide
gucaccagaguaacagucugaguaggag

SEQ ID NO: 1448 - RNA, 27 nt, Artificial Sequence
  Description of Artificial Sequence: Synthetic oligonucleotide
ucaccagaguaacagucugaguaggag

SEQ ID NO: 1449 - RNA, 26 nt, Artificial Sequence
  Description of Artificial Sequence: Synthetic oligonucleotide
caccagaguaacagucugaguaggag

SEQ ID NO: 1450 - RNA, 25 nt, Artificial Sequence
  Description of Artificial Sequence: Synthetic oligonucleotide
accagaguaacagucugaguaggag

SEQ ID NO: 1451 - RNA, 20 nt, Artificial Sequence
  Description of Artificial Sequence: Synthetic oligonucleotide
ucaaggaagauggcauuucu

SEQ ID NO: 1452 - RNA, 20 nt, Artificial Sequence
  Description of Artificial Sequence: Synthetic oligonucleotide
uuuuggcagcuuuccaccaa

SEQ ID NO: 1453 - RNA, 20 nt, Artificial Sequence
  Description of Artificial Sequence: Synthetic oligonucleotide
uuuuggcagcuuuccaccaa

SEQ ID NO: 1454 - RNA, 20 nt, Artificial Sequence
  Description of Artificial Sequence: Synthetic oligonucleotide
uuuuggcagcuuuccaccaa

SEQ ID NO: 1455 - RNA, 20 nt, Artificial Sequence
  Description of Artificial Sequence: Synthetic oligonucleotide
uuuuggcagcuuuccaccaa

SEQ ID NO: 1456 - RNA, 20 nt, Artificial Sequence
  Description of Artificial Sequence: Synthetic oligonucleotide
uuuuggcagcuuuccaccaa

SEQ ID NO: 1457 - RNA, 20 nt, Artificial Sequence
  Description of Artificial Sequence: Synthetic oligonucleotide
cuccgguucugaagguguuc

SEQ ID NO: 1458 - RNA, 20 nt, Artificial Sequence
  Description of Artificial Sequence: Synthetic oligonucleotide
cuccgguucugaagguguuc

SEQ ID NO: 1459 - RNA, 20 nt, Artificial Sequence
  Description of Artificial Sequence: Synthetic oligonucleotide
cuccgguucugaagguguuc

SEQ ID NO: 1460 - RNA, 20 nt, Artificial Sequence
  Description of Artificial Sequence: Synthetic oligonucleotide
cuccgguucugaagguguuc

SEQ ID NO: 1461 - RNA, 20 nt, Artificial Sequence
  Description of Artificial Sequence: Synthetic oligonucleotide
cuccgguucugaagguguuc

SEQ ID NO: 1462 - RNA, 20 nt, Artificial Sequence
  Description of Artificial Sequence: Synthetic oligonucleotide
cuccgguucugaagguguuc

SEQ ID NO: 1463 - RNA, 20 nt, Artificial Sequence
  Description of Artificial Sequence: Synthetic oligonucleotide
cuccgguucugaagguguuc

SEQ ID NO: 1464 - RNA, 20 nt, Artificial Sequence
  Description of Artificial Sequence: Synthetic oligonucleotide
cuccgguucugaagguguuc

SEQ ID NO: 1465 - RNA, 20 nt, Artificial Sequence
  Description of Artificial Sequence: Synthetic oligonucleotide
cuccgguucugaagguguuc

SEQ ID NO: 1466 - RNA, 20 nt, Artificial Sequence
  Description of Artificial Sequence: Synthetic oligonucleotide
cuccgguucugaagguguuc

SEQ ID NO: 1467 - RNA, 20 nt, Artificial Sequence
  Description of Artificial Sequence: Synthetic oligonucleotide
cuccgguucugaagguguuc

SEQ ID NO: 1468 - RNA, 20 nt, Artificial Sequence
  Description of Artificial Sequence: Synthetic oligonucleotide
cuccgguucugaagguguuc

SEQ ID NO: 1469 - RNA, 20 nt, Artificial Sequence
  Description of Artificial Sequence: Synthetic oligonucleotide
cuccgguucugaagguguuc

SEQ ID NO: 1470 - RNA, 20 nt, Artificial Sequence
  Description of Artificial Sequence: Synthetic oligonucleotide
cuccgguucugaagguguuc

SEQ ID NO: 1471 - RNA, 20 nt, Artificial Sequence
  Description of Artificial Sequence: Synthetic oligonucleotide
cuccgguucugaagguguuc

SEQ ID NO: 1472 - RNA, 20 nt, Artificial Sequence
  Description of Artificial Sequence: Synthetic oligonucleotide
cuccgguucugaagguguuc

SEQ ID NO: 1473 - RNA, 20 nt, Artificial Sequence
  Description of Artificial Sequence: Synthetic oligonucleotide
cuccgguucugaagguguuc

SEQ ID NO: 1474 - RNA, 20 nt, Artificial Sequence
  Description of Artificial Sequence: Synthetic oligonucleotide
cuccgguucugaagguguuc

SEQ ID NO: 1475 - RNA, 20 nt, Artificial Sequence
  Description of Artificial Sequence: Synthetic oligonucleotide
ucaaggaagauggcauuucu

SEQ ID NO: 1476 - RNA, 20 nt, Artificial Sequence
  Description of Artificial Sequence: Synthetic oligonucleotide
ucacucagauaguugaagcc

SEQ ID NO: 1477 - RNA, 20 nt, Artificial Sequence
  Description of Artificial Sequence: Synthetic oligonucleotide
ucacucagauaguugaagcc

SEQ ID NO: 1478 - RNA, 20 nt, Artificial Sequence
  Description of Artificial Sequence: Synthetic oligonucleotide
ucacucagauaguugaagcc

SEQ ID NO: 1479 - RNA, 20 nt, Artificial Sequence
  Description of Artificial Sequence: Synthetic oligonucleotide
ucacucagauaguugaagcc

SEQ ID NO: 1480 - RNA, 20 nt, Artificial Sequence
  Description of Artificial Sequence: Synthetic oligonucleotide
ucacucagauaguugaagcc

SEQ ID NO: 1481 - RNA, 20 nt, Artificial Sequence
  Description of Artificial Sequence: Synthetic oligonucleotide
gcaaagaagauggcauuucu

SEQ ID NO: 1482 - RNA, 20 nt, Artificial Sequence
  Description of Artificial Sequence: Synthetic oligonucleotide
gcaaagaagauggcauuucu

SEQ ID NO: 1483 - RNA, 30 nt, Artificial Sequence
  Description of Artificial Sequence: Synthetic oligonucleotide
uucuuguacuucaucccacugauucugaau

SEQ ID NO: 1484 - RNA, 30 nt, Artificial Sequence
  Description of Artificial Sequence: Synthetic oligonucleotide
guguucuuguacuucaucccacugauucug

SEQ ID NO: 1485 - RNA, 30 nt, Artificial Sequence
  Description of Artificial Sequence: Synthetic oligonucleotide
aagguguucuuguacuucaucccacugauu

SEQ ID NO: 1486 - RNA, 30 nt, Artificial Sequence
  Description of Artificial Sequence: Synthetic oligonucleotide
cugaagguguucuuguacuucaucccacug

SEQ ID NO: 1487 - RNA, 30 nt, Artificial Sequence
  Description of Artificial Sequence: Synthetic oligonucleotide
guucugaagguguucuuguacuucauccca

SEQ ID NO: 1488 - RNA, 30 nt, Artificial Sequence
  Description of Artificial Sequence: Synthetic oligonucleotide
ccgguucugaagguguucuuguacuucauc

SEQ ID NO: 1489 - RNA, 30 nt, Artificial Sequence
  Description of Artificial Sequence: Synthetic oligonucleotide
ccuccgguucugaagguguucuuguacuuc

SEQ ID NO: 1490 - RNA, 30 nt, Artificial Sequence
  Description of Artificial Sequence: Synthetic oligonucleotide
uugccuccgguucugaagguguucuuguac

SEQ ID NO: 1491 - RNA, 30 nt, Artificial Sequence
  Description of Artificial Sequence: Synthetic oligonucleotide
cuguugccuccgguucugaagguguucuug

SEQ ID NO: 1492 - RNA, 30 nt, Artificial Sequence
  Description of Artificial Sequence: Synthetic oligonucleotide
caacuguugccuccgguucugaagguguuc

SEQ ID NO: 1493 - RNA, 30 nt, Artificial Sequence
  Description of Artificial Sequence: Synthetic oligonucleotide
auucaacuguugccuccgguucugaaggug

SEQ ID NO: 1494 - RNA, 30 nt, Artificial Sequence
  Description of Artificial Sequence: Synthetic oligonucleotide
uucauucaacuguugccuccgguucugaag

SEQ ID NO: 1495 - RNA, 30 nt, Artificial Sequence
  Description of Artificial Sequence: Synthetic oligonucleotide
cauuucauucaacuguugccuccgguucug

SEQ ID NO: 1496 - RNA, 30 nt, Artificial Sequence
  Description of Artificial Sequence: Synthetic oligonucleotide
uaacauuucauucaacuguugccuccgguu

SEQ ID NO: 1497 - RNA, 30 nt, Artificial Sequence
  Description of Artificial Sequence: Synthetic oligonucleotide
cuuuaacauuucauucaacuguugccuccg

SEQ ID NO: 1498 - RNA, 25 nt, Artificial Sequence
  Description of Artificial Sequence: Synthetic oligonucleotide
uacuucaucccacugauucugaauu

SEQ ID NO: 1499 - RNA, 25 nt, Artificial Sequence
  Description of Artificial Sequence: Synthetic oligonucleotide
uuguacuucaucccacugauucuga

SEQ ID NO: 1500 - RNA, 25 nt, Artificial Sequence
  Description of Artificial Sequence: Synthetic oligonucleotide
uucuuguacuucaucccacugauuc

SEQ ID NO: 1501 - RNA, 25 nt, Artificial Sequence
  Description of Artificial Sequence: Synthetic oligonucleotide
guguucuuguacuucaucccacuga

SEQ ID NO: 1502 - RNA, 25 nt, Artificial Sequence
  Description of Artificial Sequence: Synthetic oligonucleotide
aagguguucuuguacuucaucccac

SEQ ID NO: 1503 - RNA, 25 nt, Artificial Sequence
  Description of Artificial Sequence: Synthetic oligonucleotide
cugaagguguucuuguacuucaucc

SEQ ID NO: 1504 - RNA, 25 nt, Artificial Sequence
  Description of Artificial Sequence: Synthetic oligonucleotide
guucugaagguguucuuguacuuca

SEQ ID NO: 1505 - RNA, 25 nt, Artificial Sequence
  Description of Artificial Sequence: Synthetic oligonucleotide
ccgguucugaagguguucuuguacu

SEQ ID NO: 1506 - RNA, 25 nt, Artificial Sequence
  Description of Artificial Sequence: Synthetic oligonucleotide
ccuccgguucugaagguguucuugu

SEQ ID NO: 1507 - RNA, 25 nt, Artificial Sequence
  Description of Artificial Sequence: Synthetic oligonucleotide
uugccuccgguucugaagguguucu

SEQ ID NO: 1508 - RNA, 25 nt, Artificial Sequence
  Description of Artificial Sequence: Synthetic oligonucleotide
cuguugccuccgguucugaaggugu

SEQ ID NO: 1509 - RNA, 25 nt, Artificial Sequence
  Description of Artificial Sequence: Synthetic oligonucleotide
caacuguugccuccgguucugaagg

SEQ ID NO: 1510 - RNA, 25 nt, Artificial Sequence
  Description of Artificial Sequence: Synthetic oligonucleotide
auucaacuguugccuccgguucuga

SEQ ID NO: 1511 - RNA, 25 nt, Artificial Sequence
  Description of Artificial Sequence: Synthetic oligonucleotide
uucauucaacuguugccuccgguuc

SEQ ID NO: 1512 - RNA, 25 nt, Artificial Sequence
  Description of Artificial Sequence: Synthetic oligonucleotide
cauuucauucaacuguugccuccgg

SEQ ID NO: 1513 - RNA, 25 nt, Artificial Sequence
  Description of Artificial Sequence: Synthetic oligonucleotide
uaacauuucauucaacuguugccuc

SEQ ID NO: 1514 - RNA, 25 nt, Artificial Sequence
  Description of Artificial Sequence: Synthetic oligonucleotide
cuuuaacauuucauucaacuguugc

SEQ ID NO: 1515 - RNA, 30 nt, Artificial Sequence
  Description of Artificial Sequence: Synthetic oligonucleotide
auccaccugccucggccucccaaagugcug

SEQ ID NO: 1516 - RNA, 30 nt, Artificial Sequence
  Description of Artificial Sequence: Synthetic oligonucleotide
ccucaggugauccaccugccucggccuccc

SEQ ID NO: 1517 - RNA, 30 nt, Artificial Sequence
  Description of Artificial Sequence: Synthetic oligonucleotide
aaacuccugaccucaggugauccaccugcc

SEQ ID NO: 1518 - RNA, 30 nt, Artificial Sequence
  Description of Artificial Sequence: Synthetic oligonucleotide
auuuuuaauagagacaggguuucaccaugu

SEQ ID NO: 1519 - RNA, 30 nt, Artificial Sequence
  Description of Artificial Sequence: Synthetic oligonucleotide
cuacaggcacgugccaucaugcccagcuaa

SEQ ID NO: 1520 - RNA, 30 nt, Artificial Sequence
  Description of Artificial Sequence: Synthetic oligonucleotide
ccuccugucucagccucccgaguagcagga

SEQ ID NO: 1521 - RNA, 30 nt, Artificial Sequence
  Description of Artificial Sequence: Synthetic oligonucleotide
uccgcucacugcaaccuccgccucccgggu

SEQ ID NO: 1522 - RNA, 30 nt, Artificial Sequence
  Description of Artificial Sequence: Synthetic oligonucleotide
ucuuguaacccaggcuggagugcaauggug

SEQ ID NO: 1523 - RNA, 30 nt, Artificial Sequence
  Description of Artificial Sequence: Synthetic oligonucleotide
agugaacccaagggaagauaaguguauuag

SEQ ID NO: 1524 - RNA, 30 nt, Artificial Sequence
  Description of Artificial Sequence: Synthetic oligonucleotide
ugauuaauuuaccccccaaauaaaucacuu

SEQ ID NO: 1525 - RNA, 30 nt, Artificial Sequence
  Description of Artificial Sequence: Synthetic oligonucleotide
acuggcugccuugccucaccugucucauuu

SEQ ID NO: 1526 - RNA, 30 nt, Artificial Sequence
  Description of Artificial Sequence: Synthetic oligonucleotide
gggauaaagcuccagugacccacaacagca

SEQ ID NO: 1527 - RNA, 30 nt, Artificial Sequence
  Description of Artificial Sequence: Synthetic oligonucleotide
uuccagaguuucccaagggauaaagcucca

SEQ ID NO: 1528 - RNA, 30 nt, Artificial Sequence
  Description of Artificial Sequence: Synthetic oligonucleotide
ggggaaauaacucugaggcauguauuuuac

SEQ ID NO: 1529 - RNA, 30 nt, Artificial Sequence
  Description of Artificial Sequence: Synthetic oligonucleotide
cuugaugcuaggggaaauaacucugaggca

SEQ ID NO: 1530 - RNA, 30 nt, Artificial Sequence
  Description of Artificial Sequence: Synthetic oligonucleotide
acuagcucccuugaugcuaggggaaauaac

SEQ ID NO: 1531 - RNA, 30 nt, Artificial Sequence
  Description of Artificial Sequence: Synthetic oligonucleotide
cagaggcagccuguauauaaugacuaauug

SEQ ID NO: 1532 - RNA, 30 nt, Artificial Sequence
  Description of Artificial Sequence: Synthetic oligonucleotide
cuccagcucccagaggcagccuguauauaa

SEQ ID NO: 1533 - RNA, 30 nt, Artificial Sequence
  Description of Artificial Sequence: Synthetic oligonucleotide
augccuccccuccagcucccagaggcagcc

SEQ ID NO: 1534 - RNA, 30 nt, Artificial Sequence
  Description of Artificial Sequence: Synthetic oligonucleotide
caggcaacugaugccuccccuccagcuccc

SEQ ID NO: 1535 - RNA, 30 nt, Artificial Sequence
  Description of Artificial Sequence: Synthetic oligonucleotide
augugacaggcuagacauaccaggcaacug

SEQ ID NO: 1536 - RNA, 30 nt, Artificial Sequence
  Description of Artificial Sequence: Synthetic oligonucleotide
agugccagcauuucauugccugaaggcuuu

SEQ ID NO: 1537 - RNA, 30 nt, Artificial Sequence
  Description of Artificial Sequence: Synthetic oligonucleotide
acccaucagccugauuucccagugccagca

SEQ ID NO: 1538 - RNA, 30 nt, Artificial Sequence
  Description of Artificial Sequence: Synthetic oligonucleotide
ccacuucagcacccaucagccugauuuccc

SEQ ID NO: 1539 - RNA, 30 nt, Artificial Sequence
  Description of Artificial Sequence: Synthetic oligonucleotide
uccauauccccucauccuugccacuucagc

SEQ ID NO: 1540 - RNA, 30 nt, Artificial Sequence
  Description of Artificial Sequence: Synthetic oligonucleotide
aauucuugaucccuagaaccaaauaugaau

SEQ ID NO: 1541 - RNA, 30 nt, Artificial Sequence
  Description of Artificial Sequence: Synthetic oligonucleotide
aacaucaacauauauauaaaauuuuaacuc

SEQ ID NO: 1542 - RNA, 30 nt, Artificial Sequence
  Description of Artificial Sequence: Synthetic oligonucleotide
uuauggcuaggaugaugaacaacaggauuc

SEQ ID NO: 1543 - RNA, 30 nt, Artificial Sequence
  Description of Artificial Sequence: Synthetic oligonucleotide
guaaaugcuagucuggaggagacauuuuaa

SEQ ID NO: 1544 - RNA, 30 nt, Artificial Sequence
  Description of Artificial Sequence: Synthetic oligonucleotide
ggaaaaauaaauauauaguaguaaaugcua

SEQ ID NO: 1545 - RNA, 30 nt, Artificial Sequence
  Description of Artificial Sequence: Synthetic oligonucleotide
ggccaacuucuuuuaacaauaccuaagaau

SEQ ID NO: 1546 - RNA, 30 nt, Artificial Sequence
  Description of Artificial Sequence: Synthetic oligonucleotide
auguugcuuauuuaaaaaauuauucauugu

SEQ ID NO: 1547 - RNA, 30 nt, Artificial Sequence
  Description of Artificial Sequence: Synthetic oligonucleotide
caaacguuaucucacauuuauguugcuuau

SEQ ID NO: 1548 - RNA, 30 nt, Artificial Sequence
  Description of Artificial Sequence: Synthetic oligonucleotide
agacauuuuaaauguaacuuccaaacguua

SEQ ID NO: 1549 - RNA, 30 nt, Artificial Sequence
  Description of Artificial Sequence: Synthetic oligonucleotide
cuagaauaaaaggaaaaauaaauauauagu

SEQ ID NO: 1550 - RNA, 30 nt, Artificial Sequence
  Description of Artificial Sequence: Synthetic oligonucleotide
uuauuuuaaaaagguaucuuugauacuaac

SEQ ID NO: 1551 - RNA, 30 nt, Artificial Sequence
  Description of Artificial Sequence: Synthetic oligonucleotide
uaucaaauguaaccaguauuuuauuuuaaa

SEQ ID NO: 1552 - RNA, 30 nt, Artificial Sequence
  Description of Artificial Sequence: Synthetic oligonucleotide
uacaaucuaugguauaauuuuaucaaaugu

SEQ ID NO: 1553 - RNA, 30 nt, Artificial Sequence
  Description of Artificial Sequence: Synthetic oligonucleotide
uacauuaaacaucauuaaauuacaaucuau

SEQ ID NO: 1554 - RNA, 30 nt, Artificial Sequence
  Description of Artificial Sequence: Synthetic oligonucleotide
ugauuuucuguuaauaacuuuacauuaaac

SEQ ID NO: 1555 - RNA, 30 nt, Artificial Sequence
  Description of Artificial Sequence: Synthetic oligonucleotide
auaaauauacaaagucuacuguucauuuca

SEQ ID NO: 1556 - RNA, 30 nt, Artificial Sequence
  Description of Artificial Sequence: Synthetic oligonucleotide
gggugacagugagacucugucucuaagaaa

SEQ ID NO: 1557 - RNA, 30 nt, Artificial Sequence
  Description of Artificial Sequence: Synthetic oligonucleotide
acuuuagccugggugacagugagacucugu

SEQ ID NO: 1558 - RNA, 30 nt, Artificial Sequence
  Description of Artificial Sequence: Synthetic oligonucleotide
agccugggugacagugagacucugucucua

SEQ ID NO: 1559 - RNA, 30 nt, Artificial Sequence
  Description of Artificial Sequence: Synthetic oligonucleotide
gauugugccacugcacuuuagccuggguga

SEQ ID NO: 1560 - RNA, 30 nt, Artificial Sequence
  Description of Artificial Sequence: Synthetic oligonucleotide
aggcucagugagcuaugauugugccacugc

SEQ ID NO: 1561 - RNA, 30 nt, Artificial Sequence
  Description of Artificial Sequence: Synthetic oligonucleotide
gcaggaggacugcuugagccccagaguuca

SEQ ID NO: 1562 - RNA, 30 nt, Artificial Sequence
  Description of Artificial Sequence: Synthetic oligonucleotide
ggaggcugaggcaggaggacugcuugagcc

SEQ ID NO: 1563 - RNA, 30 nt, Artificial Sequence
  Description of Artificial Sequence: Synthetic oligonucleotide
uacuagggaggcugaggcaggaggacugcu

SEQ ID NO: 1564 - RNA, 30 nt, Artificial Sequence
  Description of Artificial Sequence: Synthetic oligonucleotide
acacgccuggcuaguagucccagcuacuag

SEQ ID NO: 1565 - RNA, 30 nt, Artificial Sequence
  Description of Artificial Sequence: Synthetic oligonucleotide
gcguggugguacacgccuggcuaguagucc

SEQ ID NO: 1566 - RNA, 30 nt, Artificial Sequence
  Description of Artificial Sequence: Synthetic oligonucleotide
aggccaagaguucaagaacccaucucuaca

SEQ ID NO: 1567 - RNA, 30 nt, Artificial Sequence
  Description of Artificial Sequence: Synthetic oligonucleotide
caaggaaggagaauugcuugaggccaagag

SEQ ID NO: 1568 - RNA, 30 nt, Artificial Sequence
  Description of Artificial Sequence: Synthetic oligonucleotide
uuugggaggccaaggaaggagaauugcuug

SEQ ID NO: 1569 - RNA, 30 nt, Artificial Sequence
  Description of Artificial Sequence: Synthetic oligonucleotide
caugcuaacucaugccuguaauccuagugc

SEQ ID NO: 1570 - RNA, 30 nt, Artificial Sequence
  Description of Artificial Sequence: Synthetic oligonucleotide
ucaaaagucuacuggcuaggcaugcuaacu

SEQ ID NO: 1571 - RNA, 30 nt, Artificial Sequence
  Description of Artificial Sequence: Synthetic oligonucleotide
cuaggaaggaauuaagcccgaaugguugac

SEQ ID NO: 1572 - RNA, 30 nt, Artificial Sequence
  Description of Artificial Sequence: Synthetic oligonucleotide
aagauaugaaagaguagaccuguuacuuuu

SEQ ID NO: 1573 - RNA, 30 nt, Artificial Sequence
  Description of Artificial Sequence: Synthetic oligonucleotide
acccacucacccccauuucuugauccaggg

SEQ ID NO: 1574 - RNA, 30 nt, Artificial Sequence
  Description of Artificial Sequence: Synthetic oligonucleotide
aguacuccuuauuccuccccaauccugaua

SEQ ID NO: 1575 - RNA, 30 nt, Artificial Sequence
  Description of Artificial Sequence: Synthetic oligonucleotide
agaauggggggagaaagugagaguacuccu

SEQ ID NO: 1576 - RNA, 30 nt, Artificial Sequence
  Description of Artificial Sequence: Synthetic oligonucleotide
auuugaggaaauuucagaggaaagagaaag

SEQ ID NO: 1577 - RNA, 30 nt, Artificial Sequence
  Description of Artificial Sequence: Synthetic oligonucleotide
uagacuacuaagcagacagauauuugagga

SEQ ID NO: 1578 - RNA, 30 nt, Artificial Sequence
  Description of Artificial Sequence: Synthetic oligonucleotide
ucuuuuauccugaggaauuauagacuacua

SEQ ID NO: 1579 - RNA, 30 nt, Artificial Sequence
  Description of Artificial Sequence: Synthetic oligonucleotide
uaaguuugaagggauuaaacgcaugcaaag

SEQ ID NO: 1580 - RNA, 30 nt, Artificial Sequence
  Description of Artificial Sequence: Synthetic oligonucleotide
ccuccuaccauguuacuucccugcucaaaa

SEQ ID NO: 1581 - RNA, 30 nt, Artificial Sequence
  Description of Artificial Sequence: Synthetic oligonucleotide
caagugcccaaucugaucaaccuccuacca

SEQ ID NO: 1582 - RNA, 30 nt, Artificial Sequence
  Description of Artificial Sequence: Synthetic oligonucleotide
auagaggguuuugaucaagugcccaaucug

SEQ ID NO: 1583 - RNA, 30 nt, Artificial Sequence
  Description of Artificial Sequence: Synthetic oligonucleotide
ccauguugggggacagcuccuaagaauggc

SEQ ID NO: 1584 - RNA, 30 nt, Artificial Sequence
  Description of Artificial Sequence: Synthetic oligonucleotide
uauacauaauuuccaggccuggccauaaaa

SEQ ID NO: 1585 - RNA, 30 nt, Artificial Sequence
  Description of Artificial Sequence: Synthetic oligonucleotide
uggcuaugacagagauuggcuaaaagcuca

SEQ ID NO: 1586 - RNA, 30 nt, Artificial Sequence
  Description of Artificial Sequence: Synthetic oligonucleotide
uagcagcucaggucccuucgauaaaauggc

SEQ ID NO: 1587 - RNA, 30 nt, Artificial Sequence
  Description of Artificial Sequence: Synthetic oligonucleotide
agauucuauauauuacauagucagaccagg

SEQ ID NO: 1588 - RNA, 30 nt, Artificial Sequence
  Description of Artificial Sequence: Synthetic oligonucleotide
agaauaaccacaugauucuauauauuacau

SEQ ID NO: 1589 - RNA, 30 nt, Artificial Sequence
  Description of Artificial Sequence: Synthetic oligonucleotide
cuaucacuguaugccucucaucucuccuuc

SEQ ID NO: 1590 - RNA, 30 nt, Artificial Sequence
  Description of Artificial Sequence: Synthetic oligonucleotide
cuaccagaguccucuugcccuagucaaauc

SEQ ID NO: 1591 - RNA, 30 nt, Artificial Sequence
  Description of Artificial Sequence: Synthetic oligonucleotide
auuccuaaacacagagcacaaacaaaaaau

SEQ ID NO: 1592 - RNA, 30 nt, Artificial Sequence
  Description of Artificial Sequence: Synthetic oligonucleotide
aaaccaauauauauaaagugacuagcauac

SEQ ID NO: 1593 - RNA, 30 nt, Artificial Sequence
  Description of Artificial Sequence: Synthetic oligonucleotide
caaagaguguuuuugaaaggaugaaauaaa

SEQ ID NO: 1594 - RNA, 30 nt, Artificial Sequence
  Description of Artificial Sequence: Synthetic oligonucleotide
gaagaggaagccugugaggucaucuacaag

SEQ ID NO: 1595 - RNA, 30 nt, Artificial Sequence
  Description of Artificial Sequence: Synthetic oligonucleotide
agacaauuggaagaggaagccugugagguc

SEQ ID NO: 1596 - RNA, 30 nt, Artificial Sequence
  Description of Artificial Sequence: Synthetic oligonucleotide
accauuuuauuugcucccuaccuuuuagaa

SEQ ID NO: 1597 - RNA, 30 nt, Artificial Sequence
  Description of Artificial Sequence: Synthetic oligonucleotide
cggagcaaggggguguugcuuuagccauuu

SEQ ID NO: 1598 - RNA, 30 nt, Artificial Sequence
  Description of Artificial Sequence: Synthetic oligonucleotide
aucuuaggcacacagacucagaaagaacuu

SEQ ID NO: 1599 - RNA, 30 nt, Artificial Sequence
  Description of Artificial Sequence: Synthetic oligonucleotide
ccuugugaggcucacaggcucucuuguuaa

SEQ ID NO: 1600 - RNA, 30 nt, Artificial Sequence
  Description of Artificial Sequence: Synthetic oligonucleotide
aaucacagcucuccaaggcuguagacauag

SEQ ID NO: 1601 - RNA, 30 nt, Artificial Sequence
  Description of Artificial Sequence: Synthetic oligonucleotide
gaggugcugcaaaggaggcuggcugcugua

SEQ ID NO: 1602 - RNA, 30 nt, Artificial Sequence
  Description of Artificial Sequence: Synthetic oligonucleotide
acuggcucaaauuuuaagaguuauaacagu

SEQ ID NO: 1603 - RNA, 30 nt, Artificial Sequence
  Description of Artificial Sequence: Synthetic oligonucleotide
uaaaugucagaccagcaaggacauaaagau

SEQ ID NO: 1604 - RNA, 30 nt, Artificial Sequence
  Description of Artificial Sequence: Synthetic oligonucleotide
uuuuucuaaauaaaaggaggaguuuuuucu

SEQ ID NO: 1605 - RNA, 30 nt, Artificial Sequence
  Description of Artificial Sequence: Synthetic oligonucleotide
agccaccgcgcccggccucaccauucuuuu

SEQ ID NO: 1606 - RNA, 30 nt, Artificial Sequence
  Description of Artificial Sequence: Synthetic oligonucleotide
cugccucggccucccaaagugcugggauua

SEQ ID NO: 1607 - RNA, 30 nt, Artificial Sequence
  Description of Artificial Sequence: Synthetic oligonucleotide
cgugaucugccugccucggccucccaaagu

SEQ ID NO: 1608 - RNA, 30 nt, Artificial Sequence
  Description of Artificial Sequence: Synthetic oligonucleotide
guauuuuuaguagagacaggguuucaccau

SEQ ID NO: 1609 - RNA, 30 nt, Artificial Sequence
  Description of Artificial Sequence: Synthetic oligonucleotide
gcaugcagcaccacgccaggcuaguuuuug

SEQ ID NO: 1610 - RNA, 30 nt, Artificial Sequence
  Description of Artificial Sequence: Synthetic oligonucleotide
caaguagcugggacuacaggcaugcagcac

SEQ ID NO: 1611 - RNA, 30 nt, Artificial Sequence
  Description of Artificial Sequence: Synthetic oligonucleotide
ccucagccucccaaguagcugggacuacag

SEQ ID NO: 1612 - RNA, 30 nt, Artificial Sequence
  Description of Artificial Sequence: Synthetic oligonucleotide
uuugggagagacagaaaucugggauuggcc

SEQ ID NO: 1613 - RNA, 30 nt, Artificial Sequence
  Description of Artificial Sequence: Synthetic oligonucleotide
accuauucacugggagguugugaggaacac

SEQ ID NO: 1614 - RNA, 30 nt, Artificial Sequence
  Description of Artificial Sequence: Synthetic oligonucleotide
ugcagagugagcauggagaagauaaugagu

SEQ ID NO: 1615 - RNA, 30 nt, Artificial Sequence
  Description of Artificial Sequence: Synthetic oligonucleotide
gguuuaggugccuguuagauaguggugcua

SEQ ID NO: 1616 - RNA, 30 nt, Artificial Sequence
  Description of Artificial Sequence: Synthetic oligonucleotide
aaaggguuuaagacagauuaccuggcuucu

SEQ ID NO: 1617 - RNA, 30 nt, Artificial Sequence
  Description of Artificial Sequence: Synthetic oligonucleotide
cuaucccucugugcauccccacacauccau

SEQ ID NO: 1618 - RNA, 30 nt, Artificial Sequence
  Description of Artificial Sequence: Synthetic oligonucleotide
uuauaggcuagagacucacucaauaaucca

SEQ ID NO: 1619 - RNA, 30 nt, Artificial Sequence
  Description of Artificial Sequence: Synthetic oligonucleotide
uaugcuuuuucacccuugaccuucaacugu

SEQ ID NO: 1620 - RNA, 30 nt, Artificial Sequence
  Description of Artificial Sequence: Synthetic oligonucleotide
cuuggggugugcaucccacugaggguaugc

SEQ ID NO: 1621 - RNA, 30 nt, Artificial Sequence
  Description of Artificial Sequence: Synthetic oligonucleotide
uacuuuaguacacauacuugggacuuuuuc

SEQ ID NO: 1622 - RNA, 30 nt, Artificial Sequence
  Description of Artificial Sequence: Synthetic oligonucleotide
caacuuaucauagcaggcuacuuuaguaca

SEQ ID NO: 1623 - RNA, 30 nt, Artificial Sequence
  Description of Artificial Sequence: Synthetic oligonucleotide
auuccaauuacaaacccuuuuucaacuuau

SEQ ID NO: 1624 - RNA, 30 nt, Artificial Sequence
  Description of Artificial Sequence: Synthetic oligonucleotide
aaaauauaguccccagaauaauuaaaacuc

SEQ ID NO: 1625 - RNA, 30 nt, Artificial Sequence
  Description of Artificial Sequence: Synthetic oligonucleotide
uagaaagaccccacaaaacuagugauugua

SEQ ID NO: 1626 - RNA, 30 nt, Artificial Sequence
  Description of Artificial Sequence: Synthetic oligonucleotide
cuccagccugggugacagagcaaaacucca

SEQ ID NO: 1627 - RNA, 30 nt, Artificial Sequence
  Description of Artificial Sequence: Synthetic oligonucleotide
uugaacccgggaggcagagguugcagugag

SEQ ID NO: 1628 - RNA, 30 nt, Artificial Sequence
  Description of Artificial Sequence: Synthetic oligonucleotide
aggcugaggcaggagaaucacuugaacccg

SEQ ID NO: 1629 - RNA, 30 nt, Artificial Sequence
  Description of Artificial Sequence: Synthetic oligonucleotide
gcuacucaggaggcugaggcaggagaauca

SEQ ID NO: 1630 - RNA, 30 nt, Artificial Sequence
  Description of Artificial Sequence: Synthetic oligonucleotide
agcacacgccuguaaucccagcuacucagg

SEQ ID NO: 1631 - RNA, 30 nt, Artificial Sequence
  Description of Artificial Sequence: Synthetic oligonucleotide
agccugaccgacaugcugaaacccagucuc

SEQ ID NO: 1632 - RNA, 30 nt, Artificial Sequence
  Description of Artificial Sequence: Synthetic oligonucleotide
guucgagaccagccugaccgacaugcugaa

SEQ ID NO: 1633 - RNA, 30 nt, Artificial Sequence
  Description of Artificial Sequence: Synthetic oligonucleotide
ggucucugggaggccaaagcggguggauca

SEQ ID NO: 1634 - RNA, 30 nt, Artificial Sequence
  Description of Artificial Sequence: Synthetic oligonucleotide
gcucacgccuguaaucccaggucucuggga

SEQ ID NO: 1635 - RNA, 30 nt, Artificial Sequence
  Description of Artificial Sequence: Synthetic oligonucleotide
gguggcucacgccuguaaucccaggucucu

SEQ ID NO: 1636 - RNA, 30 nt, Artificial Sequence
  Description of Artificial Sequence: Synthetic oligonucleotide
uuuuuaauuaacccuguugccuccacaaag

SEQ ID NO: 1637 - RNA, 30 nt, Artificial Sequence
  Description of Artificial Sequence: Synthetic oligonucleotide
uaaagagcaagggagagaaggucaaagaau

SEQ ID NO: 1638 - RNA, 30 nt, Artificial Sequence
  Description of Artificial Sequence: Synthetic oligonucleotide
ugaugacagaggucagccucccagaauaaa

SEQ ID NO: 1639 - RNA, 30 nt, Artificial Sequence
  Description of Artificial Sequence: Synthetic oligonucleotide
gcaugggagcccaaugaugacagaggucag

SEQ ID NO: 1640 - RNA, 30 nt, Artificial Sequence
  Description of Artificial Sequence: Synthetic oligonucleotide
gaagccaaagggcaugggagcccaaugaug

SEQ ID NO: 1641 - RNA, 30 nt, Artificial Sequence
  Description of Artificial Sequence: Synthetic oligonucleotide
auaucuugaccucacuuuaccuccugucuu

SEQ ID NO: 1642 - RNA, 30 nt, Artificial Sequence
  Description of Artificial Sequence: Synthetic oligonucleotide
aaccucaaagggagggaauuaggagaauaa

SEQ ID NO: 1643 - RNA, 30 nt, Artificial Sequence
  Description of Artificial Sequence: Synthetic oligonucleotide
ggacauagucagccuguggcaaccucaaag

SEQ ID NO: 1644 - RNA, 30 nt, Artificial Sequence
  Description of Artificial Sequence: Synthetic oligonucleotide
ugagaaaccacccugagaagagcaauaacc

SEQ ID NO: 1645 - RNA, 30 nt, Artificial Sequence
  Description of Artificial Sequence: Synthetic oligonucleotide
augaggggagggaaaaguggccaaaagcag

SEQ ID NO: 1646 - RNA, 30 nt, Artificial Sequence
  Description of Artificial Sequence: Synthetic oligonucleotide
ggcccaagggaugaggggagggaaaagugg

SEQ ID NO: 1647 - RNA, 30 nt, Artificial Sequence
  Description of Artificial Sequence: Synthetic oligonucleotide
acuacaucuaggcccaagggaugaggggag

SEQ ID NO: 1648 - RNA, 30 nt, Artificial Sequence
  Description of Artificial Sequence: Synthetic oligonucleotide
auaaaacccuucaauguuucccuacugucu

SEQ ID NO: 1649 - RNA, 30 nt, Artificial Sequence
  Description of Artificial Sequence: Synthetic oligonucleotide
acugcacucccucuuauaaaacccuucaau

SEQ ID NO: 1650 - RNA, 30 nt, Artificial Sequence
  Description of Artificial Sequence: Synthetic oligonucleotide
uguaaauucuaccccaauuaaagauuaaaa

SEQ ID NO: 1651 - RNA, 30 nt, Artificial Sequence
  Description of Artificial Sequence: Synthetic oligonucleotide
cucccagacccaaaucucuguuuuagaaug

SEQ ID NO: 1652 - RNA, 30 nt, Artificial Sequence
  Description of Artificial Sequence: Synthetic oligonucleotide
cccucacauccauaagaggcucuauaucau

SEQ ID NO: 1653 - RNA, 30 nt, Artificial Sequence
  Description of Artificial Sequence: Synthetic oligonucleotide
cauuuuuugcccucacauccauaagaggcu

SEQ ID NO: 1654 - RNA, 30 nt, Artificial Sequence
  Description of Artificial Sequence: Synthetic oligonucleotide
uaagcgucacccaacaccucauauaauuag

SEQ ID NO: 1655 - RNA, 30 nt, Artificial Sequence
  Description of Artificial Sequence: Synthetic oligonucleotide
cuacuuuaucccuuaagcaugaaaccugau

SEQ ID NO: 1656 - RNA, 30 nt, Artificial Sequence
  Description of Artificial Sequence: Synthetic oligonucleotide
ccaagagggagguacuauauagauucuacu

SEQ ID NO: 1657 - RNA, 30 nt, Artificial Sequence
  Description of Artificial Sequence: Synthetic oligonucleotide
gugagccaccgcgccuggccaacuucuuuu

SEQ ID NO: 1658 - RNA, 30 nt, Artificial Sequence
  Description of Artificial Sequence: Synthetic oligonucleotide
ucggccucccaaagugcugggauuacaggc

SEQ ID NO: 1659 - RNA, 20 nt, Artificial Sequence
  Description of Artificial Sequence: Synthetic oligonucleotide
ucaaggaagauggcauuucu

SEQ ID NO: 1660 - RNA, 20 nt, Artificial Sequence
  Description of Artificial Sequence: Synthetic oligonucleotide
ucaaggaagauggcauuucu

SEQ ID NO: 1661 - RNA, 20 nt, Artificial Sequence
  Description of Artificial Sequence: Synthetic oligonucleotide
ucaaggaagauggcauuucu

SEQ ID NO: 1662 - RNA, 20 nt, Artificial Sequence
  Description of Artificial Sequence: Synthetic oligonucleotide
ucaaggaagauggcauuucu

SEQ ID NO: 1663 - RNA, 20 nt, Artificial Sequence
  Description of Artificial Sequence: Synthetic oligonucleotide
cuccgguucugaagguguuc

SEQ ID NO: 1664 - RNA, 20 nt, Artificial Sequence
  Description of Artificial Sequence: Synthetic oligonucleotide
cuccgguucugaagguguuc

SEQ ID NO: 1665 - RNA, 20 nt, Artificial Sequence
  Description of Artificial Sequence: Synthetic oligonucleotide
cuccgguucugaagguguuc

SEQ ID NO: 1666 - RNA, 20 nt, Artificial Sequence
  Description of Artificial Sequence: Synthetic oligonucleotide
ucaaggaagauggcauuucu

SEQ ID NO: 1667 - RNA, 20 nt, Artificial Sequence
  Description of Artificial Sequence: Synthetic oligonucleotide
ucaaggaagauggcauuucu

SEQ ID NO: 1668 - RNA, 20 nt, Artificial Sequence
  Description of Artificial Sequence: Synthetic oligonucleotide
ucaaggaagauggcauuucu

SEQ ID NO: 1669 - RNA, 20 nt, Artificial Sequence
  Description of Artificial Sequence: Synthetic oligonucleotide
ucaaggaagauggcauuucu

SEQ ID NO: 1670 - RNA, 20 nt, Artificial Sequence
  Description of Artificial Sequence: Synthetic oligonucleotide
ucaaggaagauggcauuucu

SEQ ID NO: 1671 - RNA, 20 nt, Artificial Sequence
  Description of Artificial Sequence: Synthetic oligonucleotide
ucaaggaagauggcauuucu

SEQ ID NO: 1672 - RNA, 20 nt, Artificial Sequence
  Description of Artificial Sequence: Synthetic oligonucleotide
ucaaggaagauggcauuucu

SEQ ID NO: 1673 - RNA, 20 nt, Artificial Sequence
  Description of Artificial Sequence: Synthetic oligonucleotide
ucaaggaagauggcauuucu

SEQ ID NO: 1674 - RNA, 20 nt, Artificial Sequence
  Description of Artificial Sequence: Synthetic oligonucleotide
ucaaggaagauggcauuucu

SEQ ID NO: 1675 - RNA, 20 nt, Artificial Sequence
  Description of Artificial Sequence: Synthetic oligonucleotide
ucaaggaagauggcauuucu

SEQ ID NO: 1676 - RNA, 20 nt, Artificial Sequence
  Description of Artificial Sequence: Synthetic oligonucleotide
ucaaggaagauggcauuucu

SEQ ID NO: 1677 - RNA, 20 nt, Artificial Sequence
  Description of Artificial Sequence: Synthetic oligonucleotide
ucaaggaagauggcauuucu

SEQ ID NO: 1678 - RNA, 20 nt, Artificial Sequence
  Description of Artificial Sequence: Synthetic oligonucleotide
ucaaggaagauggcauuucu

SEQ ID NO: 1679 - RNA, 20 nt, Artificial Sequence
  Description of Artificial Sequence: Synthetic oligonucleotide
ucaaggaagauggcauuucu

SEQ ID NO: 1680 - RNA, 20 nt, Artificial Sequence
  Description of Artificial Sequence: Synthetic oligonucleotide
ucaaggaagauggcauuucu

SEQ ID NO: 1681 - RNA, 20 nt, Artificial Sequence
  Description of Artificial Sequence: Synthetic oligonucleotide
ucaaggaagauggcauuucu

SEQ ID NO: 1682 - RNA, 20 nt, Artificial Sequence
  Description of Artificial Sequence: Synthetic oligonucleotide
ucaaggaagauggcauuucu

SEQ ID NO: 1683 - RNA, 20 nt, Artificial Sequence
  Description of Artificial Sequence: Synthetic oligonucleotide
ucaaggaagauggcauuucu

SEQ ID NO: 1684 - RNA, 20 nt, Artificial Sequence
  Description of Artificial Sequence: Synthetic oligonucleotide
ucaaggaagauggcauuucu

SEQ ID NO: 1685 - RNA, 20 nt, Artificial Sequence
  Description of Artificial Sequence: Synthetic oligonucleotide
ucaaggaagauggcauuucu

SEQ ID NO: 1686 - RNA, 20 nt, Artificial Sequence
  Description of Artificial Sequence: Synthetic oligonucleotide
ucaaggaagauggcauuucu

SEQ ID NO: 1687 - RNA, 20 nt, Artificial Sequence
  Description of Artificial Sequence: Synthetic oligonucleotide
uuaaaaagucugcuaaaaug

SEQ ID NO: 1688 - RNA, 20 nt, Artificial Sequence
  Description of Artificial Sequence: Synthetic oligonucleotide
aagucugcuaaaauguuuuc

SEQ ID NO: 1689 - RNA, 20 nt, Artificial Sequence
  Description of Artificial Sequence: Synthetic oligonucleotide
ugcuaaaauguuuucauucc

SEQ ID NO: 1690 - RNA, 20 nt, Artificial Sequence
  Description of Artificial Sequence: Synthetic oligonucleotide
aaauguuuucauuccuauua

SEQ ID NO: 1691 - RNA, 20 nt, Artificial Sequence
  Description of Artificial Sequence: Synthetic oligonucleotide
uuuucauuccuauuagaucu

SEQ ID NO: 1692 - RNA, 20 nt, Artificial Sequence
  Description of Artificial Sequence: Synthetic oligonucleotide
auuccuauuagaucugucgc

SEQ ID NO: 1693 - RNA, 20 nt, Artificial Sequence
  Description of Artificial Sequence: Synthetic oligonucleotide
uauuagaucugucgcccuac

SEQ ID NO: 1694 - RNA, 20 nt, Artificial Sequence
  Description of Artificial Sequence: Synthetic oligonucleotide
gaucugucgcccuaccucuu

SEQ ID NO: 1695 - RNA, 20 nt, Artificial Sequence
  Description of Artificial Sequence: Synthetic oligonucleotide
gucgcccuaccucuuuuuuc

SEQ ID NO: 1696 - RNA, 20 nt, Artificial Sequence
  Description of Artificial Sequence: Synthetic oligonucleotide
ccuaccucuuuuuucugucu

SEQ ID NO: 1697 - RNA, 20 nt, Artificial Sequence
  Description of Artificial Sequence: Synthetic oligonucleotide
cucuuuuuucugucugacag

SEQ ID NO: 1698 - RNA, 20 nt, Artificial Sequence
  Description of Artificial Sequence: Synthetic oligonucleotide
uuuucugucugacagcuguu

SEQ ID NO: 1699 - RNA, 20 nt, Artificial Sequence
  Description of Artificial Sequence: Synthetic oligonucleotide
ugucugacagcuguuugcag

SEQ ID NO: 1700 - RNA, 20 nt, Artificial Sequence
  Description of Artificial Sequence: Synthetic oligonucleotide
gacagcuguuugcagaccuc

SEQ ID NO: 1701 - RNA, 20 nt, Artificial Sequence
  Description of Artificial Sequence: Synthetic oligonucleotide
cuguuugcagaccuccugcc

SEQ ID NO: 1702 - RNA, 20 nt, Artificial Sequence
  Description of Artificial Sequence: Synthetic oligonucleotide
ugcagaccuccugccaccgc

SEQ ID NO: 1703 - RNA, 20 nt, Artificial Sequence
  Description of Artificial Sequence: Synthetic oligonucleotide
accuccugccaccgcagauu

SEQ ID NO: 1704 - RNA, 20 nt, Artificial Sequence
  Description of Artificial Sequence: Synthetic oligonucleotide
cugccaccgcagauucaggc

SEQ ID NO: 1705 - RNA, 20 nt, Artificial Sequence
  Description of Artificial Sequence: Synthetic oligonucleotide
accgcagauucaggcuuccc

SEQ ID NO: 1706 - RNA, 20 nt, Artificial Sequence
  Description of Artificial Sequence: Synthetic oligonucleotide
agauucaggcuucccaauuu

SEQ ID NO: 1707 - RNA, 20 nt, Artificial Sequence
  Description of Artificial Sequence: Synthetic oligonucleotide
caggcuucccaauuuuuccu

SEQ ID NO: 1708 - RNA, 20 nt, Artificial Sequence
  Description of Artificial Sequence: Synthetic oligonucleotide
uucccaauuuuuccuguaga

SEQ ID NO: 1709 - RNA, 20 nt, Artificial Sequence
  Description of Artificial Sequence: Synthetic oligonucleotide
aauuuuuccuguagaauacu

SEQ ID NO: 1710 - RNA, 20 nt, Artificial Sequence
  Description of Artificial Sequence: Synthetic oligonucleotide
uuccuguagaauacuggcau

SEQ ID NO: 1711 - RNA, 20 nt, Artificial Sequence
  Description of Artificial Sequence: Synthetic oligonucleotide
guagaauacuggcaucuguu

SEQ ID NO: 1712 - RNA, 20 nt, Artificial Sequence
  Description of Artificial Sequence: Synthetic oligonucleotide
auacuggcaucuguuuuuga

SEQ ID NO: 1713 - RNA, 20 nt, Artificial Sequence
  Description of Artificial Sequence: Synthetic oligonucleotide
ggcaucuguuuuugaggauu

SEQ ID NO: 1714 - RNA, 20 nt, Artificial Sequence
  Description of Artificial Sequence: Synthetic oligonucleotide
cuguuuuugaggauugcuga

SEQ ID NO: 1715 - RNA, 20 nt, Artificial Sequence
  Description of Artificial Sequence: Synthetic oligonucleotide
uuugaggauugcugaauuau

SEQ ID NO: 1716 - RNA, 20 nt, Artificial Sequence
  Description of Artificial Sequence: Synthetic oligonucleotide
ggauugcugaauuauuucuu

SEQ ID NO: 1717 - RNA, 20 nt, Artificial Sequence
  Description of Artificial Sequence: Synthetic oligonucleotide
gcugaauuauuucuucccca

SEQ ID NO: 1718 - RNA, 20 nt, Artificial Sequence
  Description of Artificial Sequence: Synthetic oligonucleotide
auuauuucuuccccaguugc

SEQ ID NO: 1719 - RNA, 20 nt, Artificial Sequence
  Description of Artificial Sequence: Synthetic oligonucleotide
uucuuccccaguugcauuca

SEQ ID NO: 1720 - RNA, 20 nt, Artificial Sequence
  Description of Artificial Sequence: Synthetic oligonucleotide
ccccaguugcauucaauguu

SEQ ID NO: 1721 - RNA, 20 nt, Artificial Sequence
  Description of Artificial Sequence: Synthetic oligonucleotide
guugcauucaauguucugac

SEQ ID NO: 1722 - RNA, 20 nt, Artificial Sequence
  Description of Artificial Sequence: Synthetic oligonucleotide
auucaauguucugacaacag

SEQ ID NO: 1723 - RNA, 20 nt, Artificial Sequence
  Description of Artificial Sequence: Synthetic oligonucleotide
auguucugacaacaguuugc

SEQ ID NO: 1724 - RNA, 20 nt, Artificial Sequence
  Description of Artificial Sequence: Synthetic oligonucleotide
cugacaacaguuugccgcug

SEQ ID NO: 1725 - RNA, 20 nt, Artificial Sequence
  Description of Artificial Sequence: Synthetic oligonucleotide
aacaguuugccgcugcccaa

SEQ ID NO: 1726 - RNA, 20 nt, Artificial Sequence
  Description of Artificial Sequence: Synthetic oligonucleotide
uuugccgcugcccaaugcca

SEQ ID NO: 1727 - RNA, 20 nt, Artificial Sequence
  Description of Artificial Sequence: Synthetic oligonucleotide
cgcugcccaaugccauccug

SEQ ID NO: 1728 - RNA, 20 nt, Artificial Sequence
  Description of Artificial Sequence: Synthetic oligonucleotide
cccaaugccauccuggaguu

SEQ ID NO: 1729 - RNA, 20 nt, Artificial Sequence
  Description of Artificial Sequence: Synthetic oligonucleotide
ugccauccuggaguuccugu

SEQ ID NO: 1730 - RNA, 20 nt, Artificial Sequence
  Description of Artificial Sequence: Synthetic oligonucleotide
uccuggaguuccuguaagau

SEQ ID NO: 1731 - RNA, 20 nt, Artificial Sequence
  Description of Artificial Sequence: Synthetic oligonucleotide
gaguuccuguaagauaccaa

SEQ ID NO: 1732 - RNA, 20 nt, Artificial Sequence
  Description of Artificial Sequence: Synthetic oligonucleotide
ccuguaagauaccaaaaagg

SEQ ID NO: 1733 - RNA, 20 nt, Artificial Sequence
  Description of Artificial Sequence: Synthetic oligonucleotide
aagauaccaaaaaggcaaaa

SEQ ID NO: 1734 - RNA, 20 nt, Artificial Sequence
  Description of Artificial Sequence: Synthetic oligonucleotide
accaaaaaggcaaaacaaaa

SEQ ID NO: 1735 - RNA, 20 nt, Artificial Sequence
  Description of Artificial Sequence: Synthetic oligonucleotide
aaaggcaaaacaaaaaugaa

SEQ ID NO: 1736 - RNA, 20 nt, Artificial Sequence
  Description of Artificial Sequence: Synthetic oligonucleotide
caaaacaaaaaugaagcccc

SEQ ID NO: 1737 - RNA, 20 nt, Artificial Sequence
  Description of Artificial Sequence: Synthetic oligonucleotide
caaaaaugaagccccauguc

SEQ ID NO: 1738 - RNA, 20 nt, Artificial Sequence
  Description of Artificial Sequence: Synthetic oligonucleotide
augaagccccaugucuuuuu

SEQ ID NO: 1739 - RNA, 20 nt, Artificial Sequence
  Description of Artificial Sequence: Synthetic oligonucleotide
gccccaugucuuuuuauuug

SEQ ID NO: 1740 - RNA, 20 nt, Artificial Sequence
  Description of Artificial Sequence: Synthetic oligonucleotide
augucuuuuuauuugagaaa

SEQ ID NO: 1741 - RNA, 20 nt, Artificial Sequence
  Description of Artificial Sequence: Synthetic oligonucleotide
uuuuuauuugagaaaagauu

SEQ ID NO: 1742 - RNA, 20 nt, Artificial Sequence
  Description of Artificial Sequence: Synthetic oligonucleotide
auuugagaaaagauuaaaca

SEQ ID NO: 1743 - RNA, 20 nt, Artificial Sequence
  Description of Artificial Sequence: Synthetic oligonucleotide
agaaaagauuaaacagugug

SEQ ID NO: 1744 - RNA, 20 nt, Artificial Sequence
  Description of Artificial Sequence: Synthetic oligonucleotide
agauuaaacagugugcuacc

SEQ ID NO: 1745 - RNA, 20 nt, Artificial Sequence
  Description of Artificial Sequence: Synthetic oligonucleotide
aaacagugugcuaccacaug

SEQ ID NO: 1746 - RNA, 20 nt, Artificial Sequence
  Description of Artificial Sequence: Synthetic oligonucleotide
ucacucagauaguugaagcc

SEQ ID NO: 1747 - RNA, 20 nt, Artificial Sequence
  Description of Artificial Sequence: Synthetic oligonucleotide
ucacucagauaguugaagcc

SEQ ID NO: 1748 - RNA, 20 nt, Artificial Sequence
  Description of Artificial Sequence: Synthetic oligonucleotide
ucacucagauaguugaagcc

SEQ ID NO: 1749 - RNA, 20 nt, Artificial Sequence
  Description of Artificial Sequence: Synthetic oligonucleotide
ucacucagauaguugaagcc

SEQ ID NO: 1750 - RNA, 20 nt, Artificial Sequence
  Description of Artificial Sequence: Synthetic oligonucleotide
ucacucagauaguugaagcc

SEQ ID NO: 1751 - RNA, 20 nt, Artificial Sequence
  Description of Artificial Sequence: Synthetic oligonucleotide
ucacucagauaguugaagcc

SEQ ID NO: 1752 - RNA, 20 nt, Artificial Sequence
  Description of Artificial Sequence: Synthetic oligonucleotide
ucaaggaagauggcauuucu

SEQ ID NO: 1753 - RNA, 20 nt, Artificial Sequence
  Description of Artificial Sequence: Synthetic oligonucleotide
ucaaggaagauggcauuucu

SEQ ID NO: 1754 - RNA, 20 nt, Artificial Sequence
  Description of Artificial Sequence: Synthetic oligonucleotide
ucaaggaagauggcauuucu

SEQ ID NO: 1755 - RNA, 20 nt, Artificial Sequence
  Description of Artificial Sequence: Synthetic oligonucleotide
cuccgguucugaagguguuc

SEQ ID NO: 1756 - RNA, 20 nt, Artificial Sequence
  Description of Artificial Sequence: Synthetic oligonucleotide
cuccgguucugaagguguuc

SEQ ID NO: 1757 - RNA, 20 nt, Artificial Sequence
  Description of Artificial Sequence: Synthetic oligonucleotide
cuccgguucugaagguguuc

SEQ ID NO: 1758 - RNA, 20 nt, Artificial Sequence
  Description of Artificial Sequence: Synthetic oligonucleotide
ucacucagauaguugaagcc

SEQ ID NO: 1759 - RNA, 20 nt, Artificial Sequence
  Description of Artificial Sequence: Synthetic oligonucleotide
ucacucagauaguugaagcc

SEQ ID NO: 1760 - RNA, 20 nt, Artificial Sequence
  Description of Artificial Sequence: Synthetic oligonucleotide
ucacucagauaguugaagcc

SEQ ID NO: 1761 - RNA, 20 nt, Artificial Sequence
  Description of Artificial Sequence: Synthetic oligonucleotide
ucacucagauaguugaagcc

SEQ ID NO: 1762 - RNA, 20 nt, Artificial Sequence
  Description of Artificial Sequence: Synthetic oligonucleotide
ucacucagauaguugaagcc

SEQ ID NO: 1763 - RNA, 20 nt, Artificial Sequence
  Description of Artificial Sequence: Synthetic oligonucleotide
ucacucagauaguugaagcc

SEQ ID NO: 1764 - RNA, 20 nt, Artificial Sequence
  Description of Artificial Sequence: Synthetic oligonucleotide
ucacucagauaguugaagcc

SEQ ID NO: 1765 - RNA, 20 nt, Artificial Sequence
  Description of Artificial Sequence: Synthetic oligonucleotide
ucacucagauaguugaagcc

SEQ ID NO: 1766 - RNA, 20 nt, Artificial Sequence
  Description of Artificial Sequence: Synthetic oligonucleotide
ucacucagauaguugaagcc

SEQ ID NO: 1767 - RNA, 20 nt, Artificial Sequence
  Description of Artificial Sequence: Synthetic oligonucleotide
cuccgguucugaagguguuc

SEQ ID NO: 1768 - RNA, 20 nt, Artificial Sequence
  Description of Artificial Sequence: Synthetic oligonucleotide
cuccgguucugaagguguuc

SEQ ID NO: 1769 - RNA, 20 nt, Artificial Sequence
  Description of Artificial Sequence: Synthetic oligonucleotide
cuccgguucugaagguguuc

SEQ ID NO: 1770 - RNA, 20 nt, Artificial Sequence
  Description of Artificial Sequence: Synthetic oligonucleotide
cuccgguucugaagguguuc

SEQ ID NO: 1771 - RNA, 20 nt, Artificial Sequence
  Description of Artificial Sequence: Synthetic oligonucleotide
cuccgguucugaagguguuc

SEQ ID NO: 1772 - RNA, 20 nt, Artificial Sequence
  Description of Artificial Sequence: Synthetic oligonucleotide
cuccgguucugaagguguuc

SEQ ID NO: 1773 - RNA, 20 nt, Artificial Sequence
  Description of Artificial Sequence: Synthetic oligonucleotide
cuccgguucugaagguguuc

SEQ ID NO: 1774 - RNA, 20 nt, Artificial Sequence
  Description of Artificial Sequence: Synthetic oligonucleotide
ucaaggaagauggcauuucu

SEQ ID NO: 1775 - RNA, 20 nt, Artificial Sequence
  Description of Artificial Sequence: Synthetic oligonucleotide
ucaaggaagauggcauuucu

SEQ ID NO: 1776 - RNA, 20 nt, Artificial Sequence
  Description of Artificial Sequence: Synthetic oligonucleotide
ucaaggaagauggcauuucu

SEQ ID NO: 1777 - RNA, 20 nt, Artificial Sequence
  Description of Artificial Sequence: Synthetic oligonucleotide
ucaaggaagauggcauuucu

SEQ ID NO: 1778 - RNA, 20 nt, Artificial Sequence
  Description of Artificial Sequence: Synthetic oligonucleotide
ucaaggaagauggcauuucu

SEQ ID NO: 1779 - RNA, 20 nt, Artificial Sequence
  Description of Artificial Sequence: Synthetic oligonucleotide
ucaaggaagauggcauuucu

SEQ ID NO: 1780 - RNA, 20 nt, Artificial Sequence
  Description of Artificial Sequence: Synthetic oligonucleotide
ucaaggaagauggcauuucu

SEQ ID NO: 1781 - RNA, 20 nt, Artificial Sequence
  Description of Artificial Sequence: Synthetic oligonucleotide
ggcuucaacuaucugaguga

SEQ ID NO: 1782 - RNA, 20 nt, Artificial Sequence
  Description of Artificial Sequence: Synthetic oligonucleotide
gaacaccuucagaaccggag

SEQ ID NO: 1783 - RNA, 21 nt, Artificial Sequence
  Description of Artificial Sequence: Synthetic oligonucleotide
aucaaggaagauggcauuucu

SEQ ID NO: 1784 - RNA, 21 nt, Artificial Sequence
  Description of Artificial Sequence: Synthetic oligonucleotide
uucaaggaagauggcauuucu

SEQ ID NO: 1785 - RNA, 20 nt, Artificial Sequence
  Description of Artificial Sequence: Synthetic oligonucleotide
ucaaggaagauggcauuucu

SEQ ID NO: 1786 - RNA, 20 nt, Artificial Sequence
  Description of Artificial Sequence: Synthetic oligonucleotide
cuccgguucugaagguguuc

SEQ ID NO: 1787 - RNA, 20 nt, Artificial Sequence
  Description of Artificial Sequence: Synthetic oligonucleotide
cuccgguucugaagguguuc

SEQ ID NO: 1788 - RNA, 20 nt, Artificial Sequence
  Description of Artificial Sequence: Synthetic oligonucleotide
cuccgguucugaagguguuc

SEQ ID NO: 1789 - RNA, 20 nt, Artificial Sequence
  Description of Artificial Sequence: Synthetic oligonucleotide
cuccgguucugaagguguuc

SEQ ID NO: 1790 - RNA, 20 nt, Artificial Sequence
  Description of Artificial Sequence: Synthetic oligonucleotide
cuccgguucugaagguguuc

SEQ ID NO: 1791 - RNA, 20 nt, Artificial Sequence
  Description of Artificial Sequence: Synthetic oligonucleotide
cuccgguucugaagguguuc

SEQ ID NO: 1792 - RNA, 20 nt, Artificial Sequence
  Description of Artificial Sequence: Synthetic oligonucleotide
cuccgguucugaagguguuc

SEQ ID NO: 1793 - RNA, 20 nt, Artificial Sequence
  Description of Artificial Sequence: Synthetic oligonucleotide
ucacucagauaguugaagcc

SEQ ID NO: 1794 - RNA, 20 nt, Artificial Sequence
  Description of Artificial Sequence: Synthetic oligonucleotide
ucacucagauaguugaagcc

SEQ ID NO: 1795 - RNA, 20 nt, Artificial Sequence
  Description of Artificial Sequence: Synthetic oligonucleotide
ucacucagauaguugaagcc

SEQ ID NO: 1796 - DNA, 23 bp, Artificial Sequence
  Description of Artificial Sequence: Synthetic oligonucleotide
  Description of Combined DNA/RNA Molecule: Synthetic oligonucleotide
tttucacucagauaguugaagcc

SEQ ID NO: 1797 - DNA, 23 bp, Artificial Sequence
  Description of Artificial Sequence: Synthetic oligonucleotide
  Description of Combined DNA/RNA Molecule: Synthetic oligonucleotide
tttucacucagauaguugaagcc

SEQ ID NO: 1798 - DNA, 23 bp, Artificial Sequence
  Description of Artificial Sequence: Synthetic oligonucleotide
  Description of Combined DNA/RNA Molecule: Synthetic oligonucleotide
ucacucagauaguugaagccttt

SEQ ID NO: 1799 - DNA, 23 bp, Artificial Sequence
  Description of Artificial Sequence: Synthetic oligonucleotide
  Description of Combined DNA/RNA Molecule: Synthetic oligonucleotide
ucacucagauaguugaagccttt

SEQ ID NO: 1800 - RNA, 20 nt, Artificial Sequence
  Description of Artificial Sequence: Synthetic oligonucleotide
cuccgguucugaagguguuc

SEQ ID NO: 1801 - RNA, 20 nt, Artificial Sequence
  Description of Artificial Sequence: Synthetic oligonucleotide
cuccgguucugaagguguuc

SEQ ID NO: 1802 - RNA, 20 nt, Artificial Sequence
  Description of Artificial Sequence: Synthetic oligonucleotide
cuccgguucugaagguguuc

SEQ ID NO: 1803 - RNA, 20 nt, Artificial Sequence
  Description of Artificial Sequence: Synthetic oligonucleotide
cuccgguucugaagguguuc

SEQ ID NO: 1804 - RNA, 20 nt, Artificial Sequence
  Description of Artificial Sequence: Synthetic oligonucleotide
cuccgguucugaagguguuc

SEQ ID NO: 1805 - RNA, 20 nt, Artificial Sequence
  Description of Artificial Sequence: Synthetic oligonucleotide
cuccgguucugaagguguuc

SEQ ID NO: 1806 - RNA, 20 nt, Artificial Sequence
  Description of Artificial Sequence: Synthetic oligonucleotide
cuccgguucugaagguguuc

SEQ ID NO: 1807 - RNA, 20 nt, Artificial Sequence
  Description of Artificial Sequence: Synthetic oligonucleotide
cuccgguucugaagguguuc

SEQ ID NO: 1808 - RNA, 20 nt, Artificial Sequence
  Description of Artificial Sequence: Synthetic oligonucleotide
cuccgguucugaagguguuc

SEQ ID NO: 1809 - RNA, 20 nt, Artificial Sequence
  Description of Artificial Sequence: Synthetic oligonucleotide
cuccgguucugaagguguuc

SEQ ID NO: 1810 - RNA, 20 nt, Artificial Sequence
  Description of Artificial Sequence: Synthetic oligonucleotide
ucacucagauaguugaagcc

SEQ ID NO: 1811 - RNA, 20 nt, Artificial Sequence
  Description of Artificial Sequence: Synthetic oligonucleotide
ucacucagauaguugaagcc

SEQ ID NO: 1812 - RNA, 20 nt, Artificial Sequence
  Description of Artificial Sequence: Synthetic oligonucleotide
ucacucagauaguugaagcc

SEQ ID NO: 1813 - RNA, 20 nt, Artificial Sequence
  Description of Artificial Sequence: Synthetic oligonucleotide
ucacucagauaguugaagcc

SEQ ID NO: 1814 - RNA, 20 nt, Artificial Sequence
  Description of Artificial Sequence: Synthetic oligonucleotide
ucacucagauaguugaagcc

SEQ ID NO: 1815 - DNA, 34 bp, Artificial Sequence
  Description of Artificial Sequence: Synthetic oligonucleotide
  Description of Combined DNA/RNA Molecule: Synthetic oligonucleotide
gcgtggtaccacgcugccaggctggttatgacuc

SEQ ID NO: 1816 - DNA, 34 bp, Artificial Sequence; identical to SEQ ID NO: 1815
  Description of Artificial Sequence: Synthetic oligonucleotide
  Description of Combined DNA/RNA Molecule: Synthetic oligonucleotide

SEQ ID NO: 1817 - DNA, 34 bp, Artificial Sequence; identical to SEQ ID NO: 1815
  Description of Artificial Sequence: Synthetic oligonucleotide
  Description of Combined DNA/RNA Molecule: Synthetic oligonucleotide

SEQ ID NO: 1818 - DNA, 34 bp, Artificial Sequence
  Description of Artificial Sequence: Synthetic oligonucleotide
  Description of Combined DNA/RNA Molecule: Synthetic oligonucleotide
gcguggtaccacgcugccaggctggttatgacuc

SEQ ID NO: 1819 - DNA, 34 bp, Artificial Sequence; identical to SEQ ID NO: 1818
  Description of Artificial Sequence: Synthetic oligonucleotide
  Description of Combined DNA/RNA Molecule: Synthetic oligonucleotide

SEQ ID NO: 1820 - DNA, 34 bp, Artificial Sequence; identical to SEQ ID NO: 1818
  Description of Artificial Sequence: Synthetic oligonucleotide
  Description of Combined DNA/RNA Molecule: Synthetic oligonucleotide

SEQ ID NO: 1821 - DNA, 34 bp, Artificial Sequence; identical to SEQ ID NO: 1815
  Description of Artificial Sequence: Synthetic oligonucleotide
  Description of Combined DNA/RNA Molecule: Synthetic oligonucleotide

SEQ ID NO: 1822 - DNA, 34 bp, Artificial Sequence; identical to SEQ ID NO: 1815
  Description of Artificial Sequence: Synthetic oligonucleotide
  Description of Combined DNA/RNA Molecule: Synthetic oligonucleotide

SEQ ID NO: 1823 - DNA, 34 bp, Artificial Sequence; identical to SEQ ID NO: 1815
  Description of Artificial Sequence: Synthetic oligonucleotide
  Description of Combined DNA/RNA Molecule: Synthetic oligonucleotide

SEQ ID NO: 1824 - DNA, 34 bp, Artificial Sequence; identical to SEQ ID NO: 1818
  Description of Artificial Sequence: Synthetic oligonucleotide
  Description of Combined DNA/RNA Molecule: Synthetic oligonucleotide

SEQ ID NO: 1825 - DNA, 34 bp, Artificial Sequence; identical to SEQ ID NO: 1818
  Description of Artificial Sequence: Synthetic oligonucleotide
  Description of Combined DNA/RNA Molecule: Synthetic oligonucleotide

SEQ ID NO: 1826 - DNA, 34 bp, Artificial Sequence; identical to SEQ ID NO: 1818
  Description of Artificial Sequence: Synthetic oligonucleotide
  Description of Combined DNA/RNA Molecule: Synthetic oligonucleotide

SEQ ID NO: 1827 - RNA, 20 nt, Artificial Sequence
  Description of Artificial Sequence: Synthetic oligonucleotide
cuccuguucugcagcuguuc

SEQ ID NO: 1828 - RNA, 20 nt, Artificial Sequence
  Description of Artificial Sequence: Synthetic oligonucleotide
cuccuguucugcagcuguuc

SEQ ID NO: 1829 - RNA, 20 nt, Artificial Sequence
  Description of Artificial Sequence: Synthetic oligonucleotide
cuccuguucugcagcuguuc

SEQ ID NO: 1830 - RNA, 20 nt, Artificial Sequence
  Description of Artificial Sequence: Synthetic oligonucleotide
cuccuguucugcagcuguuc

SEQ ID NO: 1831 - DNA, 25 bp, Artificial Sequence
  Description of Artificial Sequence: Synthetic oligonucleotide
gttgcctccggttctgaaggtgttc

SEQ ID NO: 1832 - DNA, 20 bp, Artificial Sequence
  Description of Artificial Sequence: Synthetic oligonucleotide
ctccggttctgaaggtgttc

SEQ ID NO: 1833 - DNA, 28 bp, Artificial Sequence
  Description of Artificial Sequence: Synthetic oligonucleotide
tgcctccggttctgaaggtgttcttgta

SEQ ID NO: 1834 - RNA, 20 nt, Artificial Sequence
  Description of Artificial Sequence: Synthetic oligonucleotide
cuccgguucugaagguguuc

SEQ ID NO: 1835 - RNA, 20 nt, Artificial Sequence
  Description of Artificial Sequence: Synthetic oligonucleotide
cuccgguucugaagguguuc

SEQ ID NO: 1836 - RNA, 25 nt, Artificial Sequence
  Description of Artificial Sequence: Synthetic oligonucleotide
uuguacuucaucccacugauucuga

SEQ ID NO: 1837 - RNA, 25 nt, Artificial Sequence
  Description of Artificial Sequence: Synthetic oligonucleotide
ccgguucugaagguguucuuguacu

SEQ ID NO: 1838 - RNA, 25 nt, Artificial Sequence
  Description of Artificial Sequence: Synthetic oligonucleotide
uuguacuucaucccacugauucuga

SEQ ID NO: 1839 - RNA, 25 nt, Artificial Sequence
  Description of Artificial Sequence: Synthetic oligonucleotide
ccgguucugaagguguucuuguacu

SEQ ID NO: 1840 - RNA, 20 nt, Artificial Sequence
  Description of Artificial Sequence: Synthetic oligonucleotide
ugacuugcucaagcuuuucu

SEQ ID NO: 1841 - RNA, 20 nt, Artificial Sequence
  Description of Artificial Sequence: Synthetic oligonucleotide
caagcuuuucuuuuaguugc

SEQ ID NO: 1842 - RNA, 20 nt, Artificial Sequence
  Description of Artificial Sequence: Synthetic oligonucleotide
cuuuuaguugcugcucuuuu

SEQ ID NO: 1843 - RNA, 20 nt, Artificial Sequence
  Description of Artificial Sequence: Synthetic oligonucleotide
gcugcucuuuuccagguuca

SEQ ID NO: 1844 - RNA, 20 nt, Artificial Sequence
  Description of Artificial Sequence: Synthetic oligonucleotide
uuccagguucaagugggaua

SEQ ID NO: 1845 - RNA, 20 nt, Artificial Sequence
  Description of Artificial Sequence: Synthetic oligonucleotide
caagugggauacuagcaaug

SEQ ID NO: 1846 - RNA, 20 nt, Artificial Sequence
  Description of Artificial Sequence: Synthetic oligonucleotide
uacuagcaauguuaucugcu

SEQ ID NO: 1847 - RNA, 20 nt, Artificial Sequence
  Description of Artificial Sequence: Synthetic oligonucleotide
uguuaucugcuuccuccaac

SEQ ID NO: 1848 - RNA, 20 nt, Artificial Sequence
  Description of Artificial Sequence: Synthetic oligonucleotide
cuuccuccaaccauaaaaca

SEQ ID NO: 1849 - RNA, 20 nt, Artificial Sequence
  Description of Artificial Sequence: Synthetic oligonucleotide
ccauaaaacaaauucauuua

SEQ ID NO: 1850 - RNA, 20 nt, Artificial Sequence
  Description of Artificial Sequence: Synthetic oligonucleotide
aauucauuuaaaucucuuug

SEQ ID NO: 1851 - RNA, 20 nt, Artificial Sequence
  Description of Artificial Sequence: Synthetic oligonucleotide
aaucucuuugaaauucugac

SEQ ID NO: 1852 - RNA, 20 nt, Artificial Sequence
  Description of Artificial Sequence: Synthetic oligonucleotide
ugaaauucugacaagauauu

SEQ ID NO: 1853 - RNA, 20 nt, Artificial Sequence
  Description of Artificial Sequence: Synthetic oligonucleotide
acaagauauucuuuuguucu

SEQ ID NO: 1854 - RNA, 20 nt, Artificial Sequence
  Description of Artificial Sequence: Synthetic oligonucleotide
uauucuuuuguucuucuagc

SEQ ID NO: 1855 - RNA, 20 nt, Artificial Sequence
  Description of Artificial Sequence: Synthetic oligonucleotide
uucuuuuguucuucuagccu

SEQ ID NO: 1856 - RNA, 20 nt, Artificial Sequence
  Description of Artificial Sequence: Synthetic oligonucleotide
auccacuggagauuugucug

SEQ ID NO: 1857 - RNA, 20 nt, Artificial Sequence
  Description of Artificial Sequence: Synthetic oligonucleotide
agauuugucugcuugagcuu

SEQ ID NO: 1858 - RNA, 20 nt, Artificial Sequence
  Description of Artificial Sequence: Synthetic oligonucleotide
ugcuugagcuuauuuucaag

SEQ ID NO: 1859 - RNA, 20 nt, Artificial Sequence
  Description of Artificial Sequence: Synthetic oligonucleotide
uauuuucaaguuuaucuugc

SEQ ID NO: 1860 - RNA, 20 nt, Artificial Sequence
  Description of Artificial Sequence: Synthetic oligonucleotide
uuuaucuugcucuucugggc

SEQ ID NO: 1861 - RNA, 20 nt, Artificial Sequence
  Description of Artificial Sequence: Synthetic oligonucleotide
ucuucugggcuuaugggagc

SEQ ID NO: 1862 - RNA, 20 nt, Artificial Sequence
  Description of Artificial Sequence: Synthetic oligonucleotide
uuaugggagcacuuacaagc

SEQ ID NO: 1863 - RNA, 20 nt, Artificial Sequence
  Description of Artificial Sequence: Synthetic oligonucleotide
gcacuuacaagcacgggucc

SEQ ID NO: 1864 - RNA, 20 nt, Artificial Sequence
  Description of Artificial Sequence: Synthetic oligonucleotide
gcacggguccuccaguuuca

SEQ ID NO: 1865 - RNA, 20 nt, Artificial Sequence
  Description of Artificial Sequence: Synthetic oligonucleotide
uccaguuucauuuaauuguu

SEQ ID NO: 1866 - RNA, 20 nt, Artificial Sequence
  Description of Artificial Sequence: Synthetic oligonucleotide
uuuaauuguuugagaauucc

SEQ ID NO: 1867 - RNA, 20 nt, Artificial Sequence
  Description of Artificial Sequence: Synthetic oligonucleotide
gagaauucccuggcgcaggg

SEQ ID NO: 1868 - RNA, 20 nt, Artificial Sequence
  Description of Artificial Sequence: Synthetic oligonucleotide
cuggcgcaggggcaacucuu

SEQ ID NO: 1869 - RNA, 20 nt, Artificial Sequence
  Description of Artificial Sequence: Synthetic oligonucleotide
gcaggggcaacucuuccacc

SEQ ID NO: 1870 - RNA, 20 nt, Artificial Sequence
  Description of Artificial Sequence: Synthetic oligonucleotide
ggcaacucuuccaccaguaa

SEQ ID NO: 1871 - RNA, 20 nt, Artificial Sequence
  Description of Artificial Sequence: Synthetic oligonucleotide
cucuuccaccaguaacugaa

SEQ ID NO: 1872 - RNA, 20 nt, Artificial Sequence
  Description of Artificial Sequence: Synthetic oligonucleotide
uucgauccguaaugauuguu

SEQ ID NO: 1873 - RNA, 20 nt, Artificial Sequence
  Description of Artificial Sequence: Synthetic oligonucleotide
aaugauuguucuagccucuu

SEQ ID NO: 1874 - RNA, 20 nt, Artificial Sequence
  Description of Artificial Sequence: Synthetic oligonucleotide
cuagccucuugauugcuggu

SEQ ID NO: 1875 - RNA, 20 nt, Artificial Sequence
  Description of Artificial Sequence: Synthetic oligonucleotide
gauugcuggucuuguuuuuc

SEQ ID NO: 1876 - RNA, 20 nt, Artificial Sequence
  Description of Artificial Sequence: Synthetic oligonucleotide
cuuguuuuucaaauuuuggg

SEQ ID NO: 1877 - RNA, 20 nt, Artificial Sequence
  Description of Artificial Sequence: Synthetic oligonucleotide
aaauuuugggcagcgguaau

SEQ ID NO: 1878 - RNA, 20 nt, Artificial Sequence
  Description of Artificial Sequence: Synthetic oligonucleotide
cagcgguaaugaguucuucc

SEQ ID NO: 1879 - RNA, 20 nt, Artificial Sequence
  Description of Artificial Sequence: Synthetic oligonucleotide
gaguucuuccaacuggggac

SEQ ID NO: 1880 - RNA, 20 nt, Artificial Sequence
  Description of Artificial Sequence: Synthetic oligonucleotide
aacuggggacgccucuguuc

SEQ ID NO: 1881 - RNA, 20 nt, Artificial Sequence
  Description of Artificial Sequence: Synthetic oligonucleotide
gccucuguuccaaauccugc

SEQ ID NO: 1882 - RNA, 20 nt, Artificial Sequence
  Description of Artificial Sequence: Synthetic oligonucleotide
uguuccaaauccugcauugu

SEQ ID NO: 1883 - RNA, 20 nt, Artificial Sequence
  Description of Artificial Sequence: Synthetic oligonucleotide
caaauccugcauuguugccu

SEQ ID NO: 1884 - RNA, 20 nt, Artificial Sequence
  Description of Artificial Sequence: Synthetic oligonucleotide
cuuuuaugaaugcuucucca

SEQ ID NO: 1885 - RNA, 20 nt, Artificial Sequence
  Description of Artificial Sequence: Synthetic oligonucleotide
augcuucuccaagaggcauu

SEQ ID NO: 1886 - RNA, 20 nt, Artificial Sequence
  Description of Artificial Sequence: Synthetic oligonucleotide
aagaggcauugauauucucu

SEQ ID NO: 1887 - RNA, 20 nt, Artificial Sequence
  Description of Artificial Sequence: Synthetic oligonucleotide
gauauucucuguuaucaugu

SEQ ID NO: 1888 - RNA, 20 nt, Artificial Sequence
  Description of Artificial Sequence: Synthetic oligonucleotide
guuaucauguggacuuuucu

SEQ ID NO: 1889 - RNA, 20 nt, Artificial Sequence
  Description of Artificial Sequence: Synthetic oligonucleotide
ggacuuuucugguaucaucu

SEQ ID NO: 1890 - RNA, 20 nt, Artificial Sequence
  Description of Artificial Sequence: Synthetic oligonucleotide
gguaucaucugcagaauaau

SEQ ID NO: 1891 - RNA, 20 nt, Artificial Sequence
  Description of Artificial Sequence: Synthetic oligonucleotide
gcagaauaaucccggagaag

SEQ ID NO: 1892 - RNA, 20 nt, Artificial Sequence
  Description of Artificial Sequence: Synthetic oligonucleotide
ccggagaaguuucagggcca

SEQ ID NO: 1893 - RNA, 20 nt, Artificial Sequence
  Description of Artificial Sequence: Synthetic oligonucleotide
uuucagggccaagucauuug

SEQ ID NO: 1894 - RNA, 20 nt, Artificial Sequence
  Description of Artificial Sequence: Synthetic oligonucleotide
aagucauuugccacaucuac

SEQ ID NO: 1895 - RNA, 20 nt, Artificial Sequence
  Description of Artificial Sequence: Synthetic oligonucleotide
ccacaucuacauuugucugc

SEQ ID NO: 1896 - RNA, 20 nt, Artificial Sequence
  Description of Artificial Sequence: Synthetic oligonucleotide
auuugucugccacuggcgga

SEQ ID NO: 1897 - RNA, 20 nt, Artificial Sequence
  Description of Artificial Sequence: Synthetic oligonucleotide
cacuggcggaggucuuuggc

SEQ ID NO: 1898 - RNA, 20 nt, Artificial Sequence
  Description of Artificial Sequence: Synthetic oligonucleotide
gcggaggucuuuggccaacu

SEQ ID NO: 1899 - RNA, 20 nt, Artificial Sequence
  Description of Artificial Sequence: Synthetic oligonucleotide
ggucuuuggccaacugcuau

SEQ ID NO: 1900 - RNA, 20 nt, Artificial Sequence
  Description of Artificial Sequence: Synthetic oligonucleotide
uugccauuguuucaucagcu

SEQ ID NO: 1901 - RNA, 20 nt, Artificial Sequence
  Description of Artificial Sequence: Synthetic oligonucleotide
uuucaucagcucuuuuacuc

SEQ ID NO: 1902 - RNA, 20 nt, Artificial Sequence
  Description of Artificial Sequence: Synthetic oligonucleotide
ucuuuuacucccuuggaguc

SEQ ID NO: 1903 - RNA, 20 nt, Artificial Sequence
  Description of Artificial Sequence: Synthetic oligonucleotide
ccuuggagucuucuaggagc

SEQ ID NO: 1904 - RNA, 20 nt, Artificial Sequence
  Description of Artificial Sequence: Synthetic oligonucleotide
uucuaggagccuuuccuuac

SEQ ID NO: 1905 - RNA, 20 nt, Artificial Sequence
  Description of Artificial Sequence: Synthetic oligonucleotide
cuuuccuuacggguagcauc

SEQ ID NO: 1906 - RNA, 20 nt, Artificial Sequence
  Description of Artificial Sequence: Synthetic oligonucleotide
ggguagcauccuguaggaca

SEQ ID NO: 1907 - RNA, 20 nt, Artificial Sequence
  Description of Artificial Sequence: Synthetic oligonucleotide
cuguaggacauuggcaguug

SEQ ID NO: 1908 - RNA, 20 nt, Artificial Sequence
  Description of Artificial Sequence: Synthetic oligonucleotide
uuggcaguuguuucagcuuc

SEQ ID NO: 1909 - RNA, 20 nt, Artificial Sequence
  Description of Artificial Sequence: Synthetic oligonucleotide
uuucagcuucuguaagccag

SEQ ID NO: 1910 - RNA, 20 nt, Artificial Sequence
  Description of Artificial Sequence: Synthetic oligonucleotide
uguaagccaggcaagaaacu

SEQ ID NO: 1911 - RNA, 20 nt, Artificial Sequence
  Description of Artificial Sequence: Synthetic oligonucleotide
gcaagaaacuuuuccagguc

SEQ ID NO: 1912 - RNA, 20 nt, Artificial Sequence
  Description of Artificial Sequence: Synthetic oligonucleotide
uuuccagguccagggggaac

SEQ ID NO: 1913 - RNA, 20 nt, Artificial Sequence
  Description of Artificial Sequence: Synthetic oligonucleotide
cagggggaacuguugcagua

SEQ ID NO: 1914 - RNA, 20 nt, Artificial Sequence
  Description of Artificial Sequence: Synthetic oligonucleotide
uguugcaguaaucuaugagu

SEQ ID NO: 1915 - RNA, 20 nt, Artificial Sequence
  Description of Artificial Sequence: Synthetic oligonucleotide
aucuaugaguuucuuccaaa

SEQ ID NO: 1916 - RNA, 20 nt, Artificial Sequence
  Description of Artificial Sequence: Synthetic oligonucleotide
uucuuccaaagcagccucuc

SEQ ID NO: 1917 - RNA, 20 nt, Artificial Sequence
  Description of Artificial Sequence: Synthetic oligonucleotide
gcagccucucgcucacucac

SEQ ID NO: 1918 - RNA, 20 nt, Artificial Sequence
  Description of Artificial Sequence: Synthetic oligonucleotide
cucucgcucacucacccugc

SEQ ID NO: 1919 - RNA, 20 nt, Artificial Sequence
  Description of Artificial Sequence: Synthetic oligonucleotide
agguucaagugggauacuag

SEQ ID NO: 1920 - RNA, 20 nt, Artificial Sequence
  Description of Artificial Sequence: Synthetic oligonucleotide
uccagguucaagugggauac

SEQ ID NO: 1921 - RNA, 20 nt, Artificial Sequence
  Description of Artificial Sequence: Synthetic oligonucleotide
uugcuggucuuguuuuucaa

SEQ ID NO: 1922 - RNA, 20 nt, Artificial Sequence
  Description of Artificial Sequence: Synthetic oligonucleotide
acuggggacgccucuguucc

SEQ ID NO: 1923 - RNA, 20 nt, Artificial Sequence
  Description of Artificial Sequence: Synthetic oligonucleotide
uacauuugucugccacuggc

SEQ ID NO: 1924 - RNA, 20 nt, Artificial Sequence
  Description of Artificial Sequence: Synthetic oligonucleotide
cccggagaaguuucagggcc

SEQ ID NO: 1925 - RNA, 20 nt, Artificial Sequence
  Description of Artificial Sequence: Synthetic oligonucleotide
uccuguaggacauuggcagu

SEQ ID NO: 1926 - RNA, 20 nt, Artificial Sequence
  Description of Artificial Sequence: Synthetic oligonucleotide
gagucuucuaggagccuuuc

SEQ ID NO: 1927 - RNA, 20 nt, Artificial Sequence
  Description of Artificial Sequence: Synthetic oligonucleotide
cuugagcuuauuuucaaguu

SEQ ID NO: 1928 - RNA, 20 nt, Artificial Sequence
  Description of Artificial Sequence: Synthetic oligonucleotide
agcacuuacaagcacggguc

SEQ ID NO: 1929 - RNA, 25 nt, Artificial Sequence
  Description of Artificial Sequence: Synthetic oligonucleotide
uuguacuucaucccacugauucuga

SEQ ID NO: 1930 - RNA, 25 nt, Artificial Sequence
  Description of Artificial Sequence: Synthetic oligonucleotide
uuguacuucaucccacugauucuga

SEQ ID NO: 1931 - RNA, 25 nt, Artificial Sequence
  Description of Artificial Sequence: Synthetic oligonucleotide
uuguacuucaucccacugauucuga

SEQ ID NO: 1932 - RNA, 25 nt, Artificial Sequence
  Description of Artificial Sequence: Synthetic oligonucleotide
uuguacuucaucccacugauucuga

SEQ ID NO: 1933 - RNA, 25 nt, Artificial Sequence
  Description of Artificial Sequence: Synthetic oligonucleotide
uuguacuucaucccacugauucuga

SEQ ID NO: 1934 - RNA, 25 nt, Artificial Sequence
  Description of Artificial Sequence: Synthetic oligonucleotide
ccgguucugaagguguucuuguacu

SEQ ID NO: 1935 - RNA, 25 nt, Artificial Sequence
  Description of Artificial Sequence: Synthetic oligonucleotide
ccgguucugaagguguucuuguacu

SEQ ID NO: 1936 - RNA, 25 nt, Artificial Sequence
  Description of Artificial Sequence: Synthetic oligonucleotide
ccgguucugaagguguucuuguacu

SEQ ID NO: 1937 - RNA, 25 nt, Artificial Sequence
  Description of Artificial Sequence: Synthetic oligonucleotide
ccgguucugaagguguucuuguacu

SEQ ID NO: 1938 - RNA, 25 nt, Artificial Sequence
  Description of Artificial Sequence: Synthetic oligonucleotide
ccgguucugaagguguucuuguacu

SEQ ID NO: 1939 - RNA, 20 nt, Artificial Sequence
  Description of Artificial Sequence: Synthetic oligonucleotide
uuugccgcugcccaaugcca

SEQ ID NO: 1940 - RNA, 20 nt, Artificial Sequence
  Description of Artificial Sequence: Synthetic oligonucleotide
uuugccgcugcccaaugcca

SEQ ID NO: 1941 - RNA, 20 nt, Artificial Sequence
  Description of Artificial Sequence: Synthetic oligonucleotide
uuugccgcugcccaaugcca

SEQ ID NO: 1942 - RNA, 20 nt, Artificial Sequence
  Description of Artificial Sequence: Synthetic oligonucleotide
uuugccgcugcccaaugcca

SEQ ID NO: 1943 - RNA, 20 nt, Artificial Sequence
  Description of Artificial Sequence: Synthetic oligonucleotide
uuugccgcugcccaaugcca

SEQ ID NO: 1944 - RNA, 20 nt, Artificial Sequence
  Description of Artificial Sequence: Synthetic oligonucleotide
uuugccgcugcccaaugcca

SEQ ID NO: 1945 - RNA, 20 nt, Artificial Sequence
  Description of Artificial Sequence: Synthetic oligonucleotide
uuugccgcugcccaaugcca

SEQ ID NO: 1946 - RNA, 20 nt, Artificial Sequence
  Description of Artificial Sequence: Synthetic oligonucleotide
uuugccgcugcccaaugcca

SEQ ID NO: 1947 - RNA, 20 nt, Artificial Sequence
  Description of Artificial Sequence: Synthetic oligonucleotide
ugccauccuggaguuccugu

SEQ ID NO: 1948 - RNA, 20 nt, Artificial Sequence
  Description of Artificial Sequence: Synthetic oligonucleotide
ugccauccuggaguuccugu

SEQ ID NO: 1949 - RNA, 20 nt, Artificial Sequence
  Description of Artificial Sequence: Synthetic oligonucleotide
ugccauccuggaguuccugu

SEQ ID NO: 1950 - RNA, 20 nt, Artificial Sequence
  Description of Artificial Sequence: Synthetic oligonucleotide
ugccauccuggaguuccugu

SEQ ID NO: 1951 - RNA, 20 nt, Artificial Sequence
  Description of Artificial Sequence: Synthetic oligonucleotide
ugccauccuggaguuccugu

SEQ ID NO: 1952 - RNA, 20 nt, Artificial Sequence
  Description of Artificial Sequence: Synthetic oligonucleotide
ugccauccuggaguuccugu

SEQ ID NO: 1953 - RNA, 20 nt, Artificial Sequence
  Description of Artificial Sequence: Synthetic oligonucleotide
ugccauccuggaguuccugu

SEQ ID NO: 1954 - RNA, 20 nt, Artificial Sequence
  Description of Artificial Sequence: Synthetic oligonucleotide
ugccauccuggaguuccugu

SEQ ID NO: 1955 - RNA, 19 nt, Artificial Sequence
  Description of Artificial Sequence: Synthetic oligonucleotide
uccgguucugaagguguuc

SEQ ID NO: 1956 - RNA, 19 nt, Artificial Sequence
  Description of Artificial Sequence: Synthetic oligonucleotide
cuccgguucugaagguguu

SEQ ID NO: 1957 - RNA, 18 nt, Artificial Sequence
  Description of Artificial Sequence: Synthetic oligonucleotide
uccgguucugaagguguu

SEQ ID NO: 1958 - RNA, 20 nt, Artificial Sequence
  Description of Artificial Sequence: Synthetic oligonucleotide
uccgguucugaagguguucu

SEQ ID NO: 1959 - RNA, 20 nt, Artificial Sequence
  Description of Artificial Sequence: Synthetic oligonucleotide
ccuccgguucugaagguguu

SEQ ID NO: 1960 - RNA, 20 nt, Artificial Sequence
  Description of Artificial Sequence: Synthetic oligonucleotide
cuccgguucugaagguguuc

SEQ ID NO: 1961 - RNA, 19 nt, Artificial Sequence
  Description of Artificial Sequence: Synthetic oligonucleotide
cuccgguucugaagguguu

SEQ ID NO: 1962 - RNA, 19 nt, Artificial Sequence
  Description of Artificial Sequence: Synthetic oligonucleotide
cuccgguucugaagguguu

SEQ ID NO: 1963 - RNA, 19 nt, Artificial Sequence
  Description of Artificial Sequence: Synthetic oligonucleotide
uccgguucugaagguguuc

SEQ ID NO: 1964 - RNA, 19 nt, Artificial Sequence
  Description of Artificial Sequence: Synthetic oligonucleotide
uccgguucugaagguguuc

SEQ ID NO: 1965 - RNA, 18 nt, Artificial Sequence
  Description of Artificial Sequence: Synthetic oligonucleotide
uccgguucugaagguguu

SEQ ID NO: 1966 - RNA, 18 nt, Artificial Sequence
  Description of Artificial Sequence: Synthetic oligonucleotide
uccgguucugaagguguu

SEQ ID NO: 1967 - RNA, 20 nt, Artificial Sequence
  Description of Artificial Sequence: Synthetic oligonucleotide
cuccgguucugaagguguuc

SEQ ID NO: 1968 - RNA, 20 nt, Artificial Sequence
  Description of Artificial Sequence: Synthetic oligonucleotide
cuccgguucugaagguguuc

SEQ ID NO: 1969 - RNA, 20 nt, Artificial Sequence
  Description of Artificial Sequence: Synthetic oligonucleotide
acaaguucuccuucuggaaa

SEQ ID NO: 1970 - RNA, 20 nt, Artificial Sequence
  Description of Artificial Sequence: Synthetic oligonucleotide
cuucuggaaagguuccaaca

SEQ ID NO: 1971 - RNA, 20 nt, Artificial Sequence
  Description of Artificial Sequence: Synthetic oligonucleotide
gguuccaacauaaagccgaa

SEQ ID NO: 1972 - RNA, 20 nt, Artificial Sequence
  Description of Artificial Sequence: Synthetic oligonucleotide
aaagccgaaauacacacugc

SEQ ID NO: 1973 - RNA, 20 nt, Artificial Sequence
  Description of Artificial Sequence: Synthetic oligonucleotide
acacacugccccaaagccac

SEQ ID NO: 1974 - RNA, 20 nt, Artificial Sequence
  Description of Artificial Sequence: Synthetic oligonucleotide
caaagccacaaaacaccuug

SEQ ID NO: 1975 - RNA, 20 nt, Artificial Sequence
  Description of Artificial Sequence: Synthetic oligonucleotide
aacaccuugcuguuacgaug

SEQ ID NO: 1976 - RNA, 20 nt, Artificial Sequence
  Description of Artificial Sequence: Synthetic oligonucleotide
guuacgaugcuucccucugu

SEQ ID NO: 1977 - RNA, 20 nt, Artificial Sequence
  Description of Artificial Sequence: Synthetic oligonucleotide
ucccucugucacagauucaa

SEQ ID NO: 1978 - RNA, 20 nt, Artificial Sequence
  Description of Artificial Sequence: Synthetic oligonucleotide
cagauucaauuauauuuugc

SEQ ID NO: 1979 - RNA, 20 nt, Artificial Sequence
  Description of Artificial Sequence: Synthetic oligonucleotide
auauuuugcaguuuaucaga

SEQ ID NO: 1980 - RNA, 20 nt, Artificial Sequence
  Description of Artificial Sequence: Synthetic oligonucleotide
uuuaucagauaaaccagcuc

SEQ ID NO: 1981 - RNA, 20 nt, Artificial Sequence
  Description of Artificial Sequence: Synthetic oligonucleotide
aaccagcuccguccaggcaa

SEQ ID NO: 1982 - RNA, 20 nt, Artificial Sequence
  Description of Artificial Sequence: Synthetic oligonucleotide
uccaggcaaacucucucauc

SEQ ID NO: 1983 - RNA, 20 nt, Artificial Sequence
  Description of Artificial Sequence: Synthetic oligonucleotide
ucucucauccugacacaaaa

SEQ ID NO: 1984 - RNA, 20 nt, Artificial Sequence
  Description of Artificial Sequence: Synthetic oligonucleotide
gacacaaaaaguccauagca

SEQ ID NO: 1985 - RNA, 20 nt, Artificial Sequence
  Description of Artificial Sequence: Synthetic oligonucleotide
uccauagcaccgugcucuaa

SEQ ID NO: 1986 - RNA, 20 nt, Artificial Sequence
  Description of Artificial Sequence: Synthetic oligonucleotide
gugcucuaauauuaucauua

SEQ ID NO: 1987 - RNA, 20 nt, Artificial Sequence
  Description of Artificial Sequence: Synthetic oligonucleotide
uuaucauuaugauaauuuuc

SEQ ID NO: 1988 - RNA, 20 nt, Artificial Sequence
  Description of Artificial Sequence: Synthetic oligonucleotide
auaauuuucuuucuaguaau

SEQ ID NO: 1989 - RNA, 20 nt, Artificial Sequence
  Description of Artificial Sequence: Synthetic oligonucleotide
aaugaugacaacaacaguca

SEQ ID NO: 1990 - RNA, 20 nt, Artificial Sequence
  Description of Artificial Sequence: Synthetic oligonucleotide
caacagucaaaaguaauuuc

SEQ ID NO: 1991 - RNA, 20 nt, Artificial Sequence
  Description of Artificial Sequence: Synthetic oligonucleotide
aguaauuuccaucacccuuc

SEQ ID NO: 1992 - RNA, 20 nt, Artificial Sequence
  Description of Artificial Sequence: Synthetic oligonucleotide
ucacccuucagaaccugauc

SEQ ID NO: 1993 - RNA, 20 nt, Artificial Sequence
  Description of Artificial Sequence: Synthetic oligonucleotide
aaccugaucuuuaagaaguu

SEQ ID NO: 1994 - RNA, 20 nt, Artificial Sequence
  Description of Artificial Sequence: Synthetic oligonucleotide
uaagaaguuaaagaguccag

SEQ ID NO: 1995 - RNA, 20 nt, Artificial Sequence
  Description of Artificial Sequence: Synthetic oligonucleotide
agaguccagaugugcugaag

SEQ ID NO: 1996 - RNA, 20 nt, Artificial Sequence
  Description of Artificial Sequence: Synthetic oligonucleotide
gugcugaagauaaauacaau

SEQ ID NO: 1997 - RNA, 20 nt, Artificial Sequence
  Description of Artificial Sequence: Synthetic oligonucleotide
uaaauacaauuucgaaaaaa

SEQ ID NO: 1998 - RNA, 20 nt, Artificial Sequence
  Description of Artificial Sequence: Synthetic oligonucleotide
acaauuucgaaaaaacaaau

SEQ ID NO: 1999 - RNA, 20 nt, Artificial Sequence
  Description of Artificial Sequence: Synthetic oligonucleotide
ucgaaaaaacaaaucaaaga

SEQ ID NO: 2000 - RNA, 20 nt, Artificial Sequence
  Description of Artificial Sequence: Synthetic oligonucleotide
aaacaaaucaaagacuuacc

SEQ ID NO: 2001 - RNA, 20 nt, Artificial Sequence
  Description of Artificial Sequence: Synthetic oligonucleotide
aucaaagacuuaccuuaaga

SEQ ID NO: 2002 - RNA, 20 nt, Artificial Sequence
  Description of Artificial Sequence: Synthetic oligonucleotide
gacuuaccuuaagauaccau

SEQ ID NO: 2003 - RNA, 20 nt, Artificial Sequence
  Description of Artificial Sequence: Synthetic oligonucleotide
uuaccuuaagauaccauuug

SEQ ID NO: 2004 - RNA, 20 nt, Artificial Sequence
  Description of Artificial Sequence: Synthetic oligonucleotide
uaccuuaagauaccauuugu

SEQ ID NO: 2005 - RNA, 20 nt, Artificial Sequence
  Description of Artificial Sequence: Synthetic oligonucleotide
accuuaagauaccauuugua

SEQ ID NO: 2006 - RNA, 20 nt, Artificial Sequence
  Description of Artificial Sequence: Synthetic oligonucleotide
ccuuaagauaccauuuguau

SEQ ID NO: 2007 - RNA, 20 nt, Artificial Sequence
  Description of Artificial Sequence: Synthetic oligonucleotide
gauaccauuuguauuuagca

SEQ ID NO: 2008 - RNA, 20 nt, Artificial Sequence
  Description of Artificial Sequence: Synthetic oligonucleotide
auuuguauuuagcauguucc

SEQ ID NO: 2009 - RNA, 20 nt, Artificial Sequence
  Description of Artificial Sequence: Synthetic oligonucleotide
auuuagcauguucccaauuc

SEQ ID NO: 2010 - RNA, 20 nt, Artificial Sequence
  Description of Artificial Sequence: Synthetic oligonucleotide
cauguucccaauucucagga

SEQ ID NO: 2011 - RNA, 20 nt, Artificial Sequence
  Description of Artificial Sequence: Synthetic oligonucleotide
cccaauucucaggaauuugu

SEQ ID NO: 2012 - RNA, 20 nt, Artificial Sequence
  Description of Artificial Sequence: Synthetic oligonucleotide
ucucaggaauuugugucuuu

SEQ ID NO: 2013 - RNA, 20 nt, Artificial Sequence
  Description of Artificial Sequence: Synthetic oligonucleotide
gaauuugugucuuucugaga

SEQ ID NO: 2014 - RNA, 20 nt, Artificial Sequence
  Description of Artificial Sequence: Synthetic oligonucleotide
gugucuuucugagaaacugu

SEQ ID NO: 2015 - RNA, 20 nt, Artificial Sequence
  Description of Artificial Sequence: Synthetic oligonucleotide
uucugagaaacuguucagcu

SEQ ID NO: 2016 - RNA, 20 nt, Artificial Sequence
  Description of Artificial Sequence: Synthetic oligonucleotide
gaaacuguucagcuucuguu

SEQ ID NO: 2017 - RNA, 20 nt, Artificial Sequence
  Description of Artificial Sequence: Synthetic oligonucleotide
guucagcuucuguuagccac

SEQ ID NO: 2018 - RNA, 20 nt, Artificial Sequence
  Description of Artificial Sequence: Synthetic oligonucleotide
cuucuguuagccacugauua

SEQ ID NO: 2019 - RNA, 20 nt, Artificial Sequence
  Description of Artificial Sequence: Synthetic oligonucleotide
uuagccacugauuaaauauc

SEQ ID NO: 2020 - RNA, 20 nt, Artificial Sequence
  Description of Artificial Sequence: Synthetic oligonucleotide
acugauuaaauaucuuuaua

SEQ ID NO: 2021 - RNA, 20 nt, Artificial Sequence
  Description of Artificial Sequence: Synthetic oligonucleotide
aucuuuauaucauaaugaaa

SEQ ID NO: 2022 - RNA, 20 nt, Artificial Sequence
  Description of Artificial Sequence: Synthetic oligonucleotide
auaaugaaaacgccgccauu

SEQ ID NO: 2023 - RNA, 20 nt, Artificial Sequence
  Description of Artificial Sequence: Synthetic oligonucleotide
gccgccauuucucaacagau

SEQ ID NO: 2024 - RNA, 20 nt, Artificial Sequence
  Description of Artificial Sequence: Synthetic oligonucleotide
ucaacagaucugucaaaucg

SEQ ID NO: 2025 - RNA, 20 nt, Artificial Sequence
  Description of Artificial Sequence: Synthetic oligonucleotide
ugaagauaaauacaauuucg

SEQ ID NO: 2026 - RNA, 20 nt, Artificial Sequence
  Description of Artificial Sequence: Synthetic oligonucleotide
auuucgaaaaaacaaaucaa

SEQ ID NO: 2027 - RNA, 20 nt, Artificial Sequence
  Description of Artificial Sequence: Synthetic oligonucleotide
aaaaaacaaaucaaagacuu

SEQ ID NO: 2028 - RNA, 20 nt, Artificial Sequence
  Description of Artificial Sequence: Synthetic oligonucleotide
caaaucaaagacuuaccuua

SEQ ID NO: 2029 - RNA, 20 nt, Artificial Sequence
  Description of Artificial Sequence: Synthetic oligonucleotide
aaagacuuaccuuaagauac

SEQ ID NO: 2030 - RNA, 20 nt, Artificial Sequence
  Description of Artificial Sequence: Synthetic oligonucleotide
uaagauaccauuuguauuua

SEQ ID NO: 2031 - RNA, 20 nt, Artificial Sequence
  Description of Artificial Sequence: Synthetic oligonucleotide
accauuuguauuuagcaugu

SEQ ID NO: 2032 - RNA, 20 nt, Artificial Sequence
  Description of Artificial Sequence: Synthetic oligonucleotide
uguauuuagcauguucccaa

SEQ ID NO: 2033 - RNA, 18 nt, Artificial Sequence
  Description of Artificial Sequence: Synthetic oligonucleotide
ugcugaagauaaauacaa

SEQ ID NO: 2034 - RNA, 18 nt, Artificial Sequence
  Description of Artificial Sequence: Synthetic oligonucleotide
aaauacaauuucgaaaaa

SEQ ID NO: 2035 - RNA, 18 nt, Artificial Sequence
  Description of Artificial Sequence: Synthetic oligonucleotide
caauuucgaaaaaacaaa

SEQ ID NO: 2036 - RNA, 18 nt, Artificial Sequence
  Description of Artificial Sequence: Synthetic oligonucleotide
cgaaaaaacaaaucaaag

SEQ ID NO: 2037 - RNA, 18 nt, Artificial Sequence
  Description of Artificial Sequence: Synthetic oligonucleotide
aacaaaucaaagacuuac

SEQ ID NO: 2038 - RNA, 18 nt, Artificial Sequence
  Description of Artificial Sequence: Synthetic oligonucleotide
ucaaagacuuaccuuaag

SEQ ID NO: 2039 - RNA, 18 nt, Artificial Sequence
  Description of Artificial Sequence: Synthetic oligonucleotide
acuuaccuuaagauacca

SEQ ID NO: 2040 - RNA, 18 nt, Artificial Sequence
  Description of Artificial Sequence: Synthetic oligonucleotide
uaccuuaagauaccauuu

SEQ ID NO: 2041 - RNA, 18 nt, Artificial Sequence
  Description of Artificial Sequence: Synthetic oligonucleotide
accuuaagauaccauuug

SEQ ID NO: 2042 - RNA, 18 nt, Artificial Sequence
  Description of Artificial Sequence: Synthetic oligonucleotide
ccuuaagauaccauuugu

SEQ ID NO: 2043 - RNA, 18 nt, Artificial Sequence
  Description of Artificial Sequence: Synthetic oligonucleotide
cuuaagauaccauuugua

SEQ ID NO: 2044 - RNA, 18 nt, Artificial Sequence
  Description of Artificial Sequence: Synthetic oligonucleotide
auaccauuuguauuuagc

SEQ ID NO: 2045 - RNA, 18 nt, Artificial Sequence
  Description of Artificial Sequence: Synthetic oligonucleotide
uuuguauuuagcauguuc

SEQ ID NO: 2046 - RNA, 18 nt, Artificial Sequence
  Description of Artificial Sequence: Synthetic oligonucleotide
uuuagcauguucccaauu

SEQ ID NO: 2047 - RNA, 18 nt, Artificial Sequence
  Description of Artificial Sequence: Synthetic oligonucleotide
auguucccaauucucagg

SEQ ID NO: 2048 - RNA, 18 nt, Artificial Sequence
  Description of Artificial Sequence: Synthetic oligonucleotide
ccaauucucaggaauuug

SEQ ID NO: 2049 - RNA, 18 nt, Artificial Sequence
  Description of Artificial Sequence: Synthetic oligonucleotide
cucaggaauuugugucuu

SEQ ID NO: 2050 - RNA, 18 nt, Artificial Sequence
  Description of Artificial Sequence: Synthetic oligonucleotide
aauuugugucuuucugag

SEQ ID NO: 2051 - RNA, 18 nt, Artificial Sequence
  Description of Artificial Sequence: Synthetic oligonucleotide
ugucuuucugagaaacug

SEQ ID NO: 2052 - RNA, 18 nt, Artificial Sequence
  Description of Artificial Sequence: Synthetic oligonucleotide
ucugagaaacuguucagc

SEQ ID NO: 2053 - RNA, 18 nt, Artificial Sequence
  Description of Artificial Sequence: Synthetic oligonucleotide
aaacuguucagcuucugu

SEQ ID NO: 2054 - RNA, 18 nt, Artificial Sequence
  Description of Artificial Sequence: Synthetic oligonucleotide
uucagcuucuguuagcca

SEQ ID NO: 2055 - RNA, 18 nt, Artificial Sequence
  Description of Artificial Sequence: Synthetic oligonucleotide
uucuguuagccacugauu

SEQ ID NO: 2056 - RNA, 18 nt, Artificial Sequence
  Description of Artificial Sequence: Synthetic oligonucleotide
uagccacugauuaaauau

SEQ ID NO: 2057 - RNA, 18 nt, Artificial Sequence
  Description of Artificial Sequence: Synthetic oligonucleotide
gaagauaaauacaauuuc

SEQ ID NO: 2058 - RNA, 18 nt, Artificial Sequence
  Description of Artificial Sequence: Synthetic oligonucleotide
uuucgaaaaaacaaauca

SEQ ID NO: 2059 - RNA, 18 nt, Artificial Sequence
  Description of Artificial Sequence: Synthetic oligonucleotide
aaaaacaaaucaaagacu

SEQ ID NO: 2060 - RNA, 18 nt, Artificial Sequence
  Description of Artificial Sequence: Synthetic oligonucleotide
aaaucaaagacuuaccuu

SEQ ID NO: 2061 - RNA, 18 nt, Artificial Sequence
  Description of Artificial Sequence: Synthetic oligonucleotide
aagacuuaccuuaagaua

SEQ ID NO: 2062 - RNA, 18 nt, Artificial Sequence
  Description of Artificial Sequence: Synthetic oligonucleotide
aagauaccauuuguauuu

SEQ ID NO: 2063 - RNA, 18 nt, Artificial Sequence
  Description of Artificial Sequence: Synthetic oligonucleotide
ccauuuguauuuagcaug

SEQ ID NO: 2064 - RNA, 18 nt, Artificial Sequence
  Description of Artificial Sequence: Synthetic oligonucleotide
guauuuagcauguuccca

SEQ ID NO: 2065 - RNA, 17 nt, Artificial Sequence
  Description of Artificial Sequence: Synthetic oligonucleotide
aggaagauggcauuucu

SEQ ID NO: 2066 - RNA, 16 nt, Artificial Sequence
  Description of Artificial Sequence: Synthetic oligonucleotide
ggaagauggcauuucu

SEQ ID NO: 2067 - RNA, 15 nt, Artificial Sequence
  Description of Artificial Sequence: Synthetic oligonucleotide
gaagauggcauuucu

SEQ ID NO: 2068 - RNA, 14 nt, Artificial Sequence
  Description of Artificial Sequence: Synthetic oligonucleotide
aagauggcauuucu

SEQ ID NO: 2069 - RNA, 13 nt, Artificial Sequence
  Description of Artificial Sequence: Synthetic oligonucleotide
agauggcauuucu

SEQ ID NO: 2070 - RNA, 12 nt, Artificial Sequence
  Description of Artificial Sequence: Synthetic oligonucleotide
gauggcauuucu

SEQ ID NO: 2071 - RNA, 11 nt, Artificial Sequence
  Description of Artificial Sequence: Synthetic oligonucleotide
auggcauuucu

SEQ ID NO: 2072 - RNA, 10 nt, Artificial Sequence
  Description of Artificial Sequence: Synthetic oligonucleotide
uggcauuucu

SEQ ID NO: 2073 - RNA, 19 nt, Artificial Sequence
  Description of Artificial Sequence: Synthetic oligonucleotide
caaggaagauggcauuucu

SEQ ID NO: 2074 - RNA, 18 nt, Artificial Sequence
  Description of Artificial Sequence: Synthetic oligonucleotide
aaggaagauggcauuucu

SEQ ID NO: 2075 - RNA, 17 nt, Artificial Sequence
  Description of Artificial Sequence: Synthetic oligonucleotide
aggaagauggcauuucu

SEQ ID NO: 2076 - RNA, 16 nt, Artificial Sequence
  Description of Artificial Sequence: Synthetic oligonucleotide
ggaagauggcauuucu

SEQ ID NO: 2077 - RNA, 15 nt, Artificial Sequence
  Description of Artificial Sequence: Synthetic oligonucleotide
gaagauggcauuucu

SEQ ID NO: 2078 - RNA, 13 nt, Artificial Sequence
  Description of Artificial Sequence: Synthetic oligonucleotide
agauggcauuucu

SEQ ID NO: 2079 - RNA, 11 nt, Artificial Sequence
  Description of Artificial Sequence: Synthetic oligonucleotide
auggcauuucu

SEQ ID NO: 2080 - RNA, 10 nt, Artificial Sequence
  Description of Artificial Sequence: Synthetic oligonucleotide
uggcauuucu

SEQ ID NO: 2081 - RNA, 20 nt, Artificial Sequence
  Description of Artificial Sequence: Synthetic oligonucleotide
ucacucagauaguugaagcc

SEQ ID NO: 2082 - RNA, 20 nt, Artificial Sequence
  Description of Artificial Sequence: Synthetic oligonucleotide
ucacucagauaguugaagcc

SEQ ID NO: 2083 - RNA, 20 nt, Artificial Sequence
  Description of Artificial Sequence: Synthetic oligonucleotide
ucacucagauaguugaagcc

SEQ ID NO: 2084 - RNA, 20 nt, Artificial Sequence
  Description of Artificial Sequence: Synthetic oligonucleotide
ucacucagauaguugaagcc

SEQ ID NO: 2085 - RNA, 20 nt, Artificial Sequence
  Description of Artificial Sequence: Synthetic oligonucleotide
cuccgguucugaagguguuc

SEQ ID NO: 2086 - RNA, 20 nt, Artificial Sequence
  Description of Artificial Sequence: Synthetic oligonucleotide
cuccgguucugaagguguuc

SEQ ID NO: 2087 - RNA, 20 nt, Artificial Sequence
  Description of Artificial Sequence: Synthetic oligonucleotide
cuccgguucugaagguguuc

SEQ ID NO: 2088 - RNA, 20 nt, Artificial Sequence
  Description of Artificial Sequence: Synthetic oligonucleotide
cuccgguucugaagguguuc

SEQ ID NO: 2089 - RNA, 20 nt, Artificial Sequence
  Description of Artificial Sequence: Synthetic oligonucleotide
ucacucagauaguugaagcc

SEQ ID NO: 2090 - RNA, 20 nt, Artificial Sequence
  Description of Artificial Sequence: Synthetic oligonucleotide
ucacucagauaguugaagcc

SEQ ID NO: 2091 - RNA, 20 nt, Artificial Sequence
  Description of Artificial Sequence: Synthetic oligonucleotide
ucacucagauaguugaagcc

SEQ ID NO: 2092 - RNA, 20 nt, Artificial Sequence
  Description of Artificial Sequence: Synthetic oligonucleotide
ucaaggaagauggcauuucu

SEQ ID NO: 2093 - RNA, 20 nt, Artificial Sequence
  Description of Artificial Sequence: Synthetic oligonucleotide
ucaaggaagauggcauuucu

SEQ ID NO: 2094 - RNA, 20 nt, Artificial Sequence
  Description of Artificial Sequence: Synthetic oligonucleotide
uuugccgcugcccaaugcca

SEQ ID NO: 2095 - RNA, 20 nt, Artificial Sequence
  Description of Artificial Sequence: Synthetic oligonucleotide
uuugccgcugcccaaugcca

SEQ ID NO: 2096 - RNA, 20 nt, Artificial Sequence
  Description of Artificial Sequence: Synthetic oligonucleotide
uuugccgcugcccaaugcca

SEQ ID NO: 2097 - RNA, 20 nt, Artificial Sequence
  Description of Artificial Sequence: Synthetic oligonucleotide
ugccauccuggaguuccugu

SEQ ID NO: 2098 - RNA, 20 nt, Artificial Sequence
  Description of Artificial Sequence: Synthetic oligonucleotide
ugccauccuggaguuccugu

SEQ ID NO: 2099 - RNA, 20 nt, Artificial Sequence
  Description of Artificial Sequence: Synthetic oligonucleotide
ugccauccuggaguuccugu

SEQ ID NO: 2100 - RNA, 20 nt, Artificial Sequence
  Description of Artificial Sequence: Synthetic oligonucleotide
ucacucagauaguugaagcc

SEQ ID NO: 2101 - RNA, 20 nt, Artificial Sequence
  Description of Artificial Sequence: Synthetic oligonucleotide
uuugccgcugcccaaugcca

SEQ ID NO: 2102 - RNA, 20 nt, Artificial Sequence
  Description of Artificial Sequence: Synthetic oligonucleotide
uuugccgcugcccaaugcca

SEQ ID NO: 2103 - RNA, 20 nt, Artificial Sequence
  Description of Artificial Sequence: Synthetic oligonucleotide
uuugccgcugcccaaugcca

SEQ ID NO: 2104 - RNA, 19 nt, Artificial Sequence
  Description of Artificial Sequence: Synthetic oligonucleotide
cuccgguucugaagguguu

SEQ ID NO: 2105 - RNA, 19 nt, Artificial Sequence
  Description of Artificial Sequence: Synthetic oligonucleotide
cuccgguucugaagguguu

SEQ ID NO: 2106 - RNA, 20 nt, Artificial Sequence
  Description of Artificial Sequence: Synthetic oligonucleotide
uccgguucugaagguguucu

SEQ ID NO: 2107 - RNA, 20 nt, Artificial Sequence
  Description of Artificial Sequence: Synthetic oligonucleotide
uccgguucugaagguguucu

SEQ ID NO: 2108 - RNA, 20 nt, Artificial Sequence
  Description of Artificial Sequence: Synthetic oligonucleotide
uccgguucugaagguguucu

SEQ ID NO: 2109 - RNA, 20 nt, Artificial Sequence
  Description of Artificial Sequence: Synthetic oligonucleotide
uccgguucugaagguguucu

SEQ ID NO: 2110 - RNA, 20 nt, Artificial Sequence
  Description of Artificial Sequence: Synthetic oligonucleotide
uccgguucugaagguguucu

SEQ ID NO: 2111 - RNA, 20 nt, Artificial Sequence
  Description of Artificial Sequence: Synthetic oligonucleotide
uccgguucugaagguguucu

SEQ ID NO: 2112 - RNA, 20 nt, Artificial Sequence
  Description of Artificial Sequence: Synthetic oligonucleotide
uccgguucugaagguguucu

SEQ ID NO: 2113 - RNA, 20 nt, Artificial Sequence
  Description of Artificial Sequence: Synthetic oligonucleotide
uccgguucugaagguguucu

SEQ ID NO: 2114 - RNA, 20 nt, Artificial Sequence
  Description of Artificial Sequence: Synthetic oligonucleotide
uccgguucugaagguguucu

SEQ ID NO: 2115 - RNA, 20 nt, Artificial Sequence
  Description of Artificial Sequence: Synthetic oligonucleotide
ucacucagauaguugaagcc

SEQ ID NO: 2116 - RNA, 20 nt, Artificial Sequence
  Description of Artificial Sequence: Synthetic oligonucleotide
ucacucagauaguugaagcc

SEQ ID NO: 2117 - RNA, 20 nt, Artificial Sequence
  Description of Artificial Sequence: Synthetic oligonucleotide
ucacucagauaguugaagcc

SEQ ID NO: 2118 - RNA, 20 nt, Artificial Sequence
  Description of Artificial Sequence: Synthetic oligonucleotide
ucacucagauaguugaagcc

SEQ ID NO: 2119 - RNA, 20 nt, Artificial Sequence
  Description of Artificial Sequence: Synthetic oligonucleotide
ucacucagauaguugaagcc

SEQ ID NO: 2120 - RNA, 20 nt, Artificial Sequence
  Description of Artificial Sequence: Synthetic oligonucleotide
cuccgguucugaagguguuc

SEQ ID NO: 2121 - RNA, 20 nt, Artificial Sequence
  Description of Artificial Sequence: Synthetic oligonucleotide
cuccgguucugaagguguuc

SEQ ID NO: 2122 - RNA, 20 nt, Artificial Sequence
  Description of Artificial Sequence: Synthetic oligonucleotide
cuccgguucugaagguguuc

SEQ ID NO: 2123 - RNA, 20 nt, Artificial Sequence
  Description of Artificial Sequence: Synthetic oligonucleotide
cuccgguucugaagguguuc

SEQ ID NO: 2124 - RNA, 20 nt, Artificial Sequence
  Description of Artificial Sequence: Synthetic oligonucleotide
cuccgguucugaagguguuc

SEQ ID NO: 2125 - RNA, 20 nt, Artificial Sequence
  Description of Artificial Sequence: Synthetic oligonucleotide
uccgguucugaagguguucu

SEQ ID NO: 2126 - RNA, 20 nt, Artificial Sequence
  Description of Artificial Sequence: Synthetic oligonucleotide
uccgguucugaagguguucu

SEQ ID NO: 2127 - RNA, 20 nt, Artificial Sequence
  Description of Artificial Sequence: Synthetic oligonucleotide
uccgguucugaagguguucu

SEQ ID NO: 2128 - RNA, 20 nt, Artificial Sequence
  Description of Artificial Sequence: Synthetic oligonucleotide
uccgguucugaagguguucu

SEQ ID NO: 2129 - RNA, 20 nt, Artificial Sequence
  Description of Artificial Sequence: Synthetic oligonucleotide
cuccgguucugaagguguuc

SEQ ID NO: 2130 - RNA, 20 nt, Artificial Sequence
  Description of Artificial Sequence: Synthetic oligonucleotide
cuccgguucugaagguguuc

SEQ ID NO: 2131 - RNA, 20 nt, Artificial Sequence
  Description of Artificial Sequence: Synthetic oligonucleotide
cuccgguucugaagguguuc

SEQ ID NO: 2132 - RNA, 20 nt, Artificial Sequence
  Description of Artificial Sequence: Synthetic oligonucleotide
cuccgguucugaagguguuc

SEQ ID NO: 2133 - RNA, 20 nt, Artificial Sequence
  Description of Artificial Sequence: Synthetic oligonucleotide
uccgguucugaagguguucu

SEQ ID NO: 2134 - RNA, 20 nt, Artificial Sequence
  Description of Artificial Sequence: Synthetic oligonucleotide
uccgguucugaagguguucu

SEQ ID NO: 2135 - RNA, 20 nt, Artificial Sequence
  Description of Artificial Sequence: Synthetic oligonucleotide
ucacucagauaguugaagcc

SEQ ID NO: 2136 - RNA, 20 nt, Artificial Sequence
  Description of Artificial Sequence: Synthetic oligonucleotide
ucacucagauaguugaagcc

SEQ ID NO: 2137 - RNA, 20 nt, Artificial Sequence
  Description of Artificial Sequence: Synthetic oligonucleotide
ucacucagauaguugaagcc

SEQ ID NO: 2138 - RNA, 20 nt, Artificial Sequence
  Description of Artificial Sequence: Synthetic oligonucleotide
ucacucagauaguugaagcc

SEQ ID NO: 2139 - RNA, 20 nt, Artificial Sequence
  Description of Artificial Sequence: Synthetic oligonucleotide
ucacucagauaguugaagcc

SEQ ID NO: 2140 - RNA, 20 nt, Artificial Sequence
  Description of Artificial Sequence: Synthetic oligonucleotide
ucacucagauaguugaagcc

SEQ ID NO: 2141 - RNA, 20 nt, Artificial Sequence
  Description of Artificial Sequence: Synthetic oligonucleotide
uccgguucugaagguguucu

SEQ ID NO: 2142 - RNA, 20 nt, Artificial Sequence
  Description of Artificial Sequence: Synthetic oligonucleotide
ucacucagauaguugaagcc

SEQ ID NO: 2143 - RNA, 20 nt, Artificial Sequence
  Description of Artificial Sequence: Synthetic oligonucleotide
ucacucagauaguugaagcc

SEQ ID NO: 2144 - RNA, 20 nt, Artificial Sequence
  Description of Artificial Sequence: Synthetic oligonucleotide
cuccgguucugaagguguuc

SEQ ID NO: 2145 - RNA, 20 nt, Artificial Sequence
  Description of Artificial Sequence: Synthetic oligonucleotide
cuccgguucugaagguguuc

SEQ ID NO: 2146 - RNA, 20 nt, Artificial Sequence
  Description of Artificial Sequence: Synthetic oligonucleotide
ucacucagauaguugaagcc

SEQ ID NO: 2147 - RNA, 20 nt, Artificial Sequence
  Description of Artificial Sequence: Synthetic oligonucleotide
ucacucagauaguugaagcc

SEQ ID NO: 2148 - RNA, 20 nt, Artificial Sequence
  Description of Artificial Sequence: Synthetic oligonucleotide
ucacucagauaguugaagcc

SEQ ID NO: 2149 - RNA, 20 nt, Artificial Sequence
  Description of Artificial Sequence: Synthetic oligonucleotide
cuccgguucugaagguguuc

SEQ ID NO: 2150 - RNA, 20 nt, Artificial Sequence
  Description of Artificial Sequence: Synthetic oligonucleotide
cuccgguucugaagguguuc

SEQ ID NO: 2151 - RNA, 20 nt, Artificial Sequence
  Description of Artificial Sequence: Synthetic oligonucleotide
cuccgguucugaagguguuc

SEQ ID NO: 2152 - RNA, 20 nt, Artificial Sequence
  Description of Artificial Sequence: Synthetic oligonucleotide
cuccgguucugaagguguuc

SEQ ID NO: 2153 - RNA, 20 nt, Artificial Sequence
  Description of Artificial Sequence: Synthetic oligonucleotide
cuccgguucugaagguguuc

SEQ ID NO: 2154 - RNA, 20 nt, Artificial Sequence
  Description of Artificial Sequence: Synthetic oligonucleotide
cuccgguucugaagguguuc

SEQ ID NO: 2155 - RNA, 20 nt, Artificial Sequence
  Description of Artificial Sequence: Synthetic oligonucleotide
ucacucagauaguugaagcc

SEQ ID NO: 2156 - RNA, 20 nt, Artificial Sequence
  Description of Artificial Sequence: Synthetic oligonucleotide
ucacucagauaguugaagcc

SEQ ID NO: 2157 - RNA, 20 nt, Artificial Sequence
  Description of Artificial Sequence: Synthetic oligonucleotide
ucacucagauaguugaagcc

SEQ ID NO: 2158 - RNA, 20 nt, Artificial Sequence
  Description of Artificial Sequence: Synthetic oligonucleotide
ucacucagauaguugaagcc

SEQ ID NO: 2159 - RNA, 20 nt, Artificial Sequence
  Description of Artificial Sequence: Synthetic oligonucleotide
ucacucagauaguugaagcc

SEQ ID NO: 2160 - RNA, 20 nt, Artificial Sequence
  Description of Artificial Sequence: Synthetic oligonucleotide
ucacucagauaguugaagcc

SEQ ID NO: 2161 - RNA, 20 nt, Artificial Sequence
  Description of Artificial Sequence: Synthetic oligonucleotide
ucacucagauaguugaagcc

SEQ ID NO: 2162 - RNA, 20 nt, Artificial Sequence
  Description of Artificial Sequence: Synthetic oligonucleotide
ucaaggaagauggcauuucu

SEQ ID NO: 2163 - RNA, 20 nt, Artificial Sequence
  Description of Artificial Sequence: Synthetic oligonucleotide
ucaaggaagauggcauuucu

SEQ ID NO: 2164 - RNA, 20 nt, Artificial Sequence
  Description of Artificial Sequence: Synthetic oligonucleotide
ucaaggaagauggcauuucu

SEQ ID NO: 2165 - RNA, 20 nt, Artificial Sequence
  Description of Artificial Sequence: Synthetic oligonucleotide
ucacucagauaguugaagcc

SEQ ID NO: 2166 - RNA, 20 nt, Artificial Sequence
  Description of Artificial Sequence: Synthetic oligonucleotide
cuccgguucugaagguguuc

SEQ ID NO: 2167 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2168 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2169 - RNA, 20 nt, Artificial Sequence
  Description of Artificial Sequence: Synthetic oligonucleotide
cuccgguucugaagguguuc

SEQ ID NO: 2170 - RNA, 20 nt, Artificial Sequence
  Description of Artificial Sequence: Synthetic oligonucleotide
cuccgguucugaagguguuc

SEQ ID NO: 2171 - RNA, 20 nt, Artificial Sequence
  Description of Artificial Sequence: Synthetic oligonucleotide
cuccgguucugaagguguuc

SEQ ID NO: 2172 - RNA, 20 nt, Artificial Sequence
  Description of Artificial Sequence: Synthetic oligonucleotide
auuuagcauguucccaauuc

SEQ ID NO: 2173 - RNA, 20 nt, Artificial Sequence
  Description of Artificial Sequence: Synthetic oligonucleotide
auuuagcauguucccaauuc

SEQ ID NO: 2174 - RNA, 20 nt, Artificial Sequence
  Description of Artificial Sequence: Synthetic oligonucleotide
auuuagcauguucccaauuc

SEQ ID NO: 2175 - RNA, 20 nt, Artificial Sequence
  Description of Artificial Sequence: Synthetic oligonucleotide
auuuagcauguucccaauuc

SEQ ID NO: 2176 - RNA, 20 nt, Artificial Sequence
  Description of Artificial Sequence: Synthetic oligonucleotide
auuuagcauguucccaauuc

SEQ ID NO: 2177 - RNA, 20 nt, Artificial Sequence
  Description of Artificial Sequence: Synthetic oligonucleotide
auuuagcauguucccaauuc

SEQ ID NO: 2178 - RNA, 20 nt, Artificial Sequence
  Description of Artificial Sequence: Synthetic oligonucleotide
auuuagcauguucccaauuc

SEQ ID NO: 2179 - RNA, 20 nt, Artificial Sequence
  Description of Artificial Sequence: Synthetic oligonucleotide
auuuagcauguucccaauuc

SEQ ID NO: 2180 - RNA, 20 nt, Artificial Sequence
  Description of Artificial Sequence: Synthetic oligonucleotide
auuuagcauguucccaauuc

SEQ ID NO: 2181 - RNA, 20 nt, Artificial Sequence
  Description of Artificial Sequence: Synthetic oligonucleotide
auuuagcauguucccaauuc

SEQ ID NO: 2182 - RNA, 20 nt, Artificial Sequence
  Description of Artificial Sequence: Synthetic oligonucleotide
auuuagcauguucccaauuc

SEQ ID NO: 2183 - DNA, 20 bp, Artificial Sequence
  Description of Artificial Sequence: Synthetic oligonucleotide
atttagcatgttcccaattc

SEQ ID NO: 2184 - DNA, 20 bp, Artificial Sequence
  Description of Artificial Sequence: Synthetic oligonucleotide
atttagcatgttcccaattc

SEQ ID NO: 2185 - RNA, 20 nt, Artificial Sequence
  Description of Artificial Sequence: Synthetic oligonucleotide
gcauguucccaauucucagg

SEQ ID NO: 2186 - RNA, 20 nt, Artificial Sequence
  Description of Artificial Sequence: Synthetic oligonucleotide
agcauguucccaauucucag

SEQ ID NO: 2187 - RNA, 20 nt, Artificial Sequence
  Description of Artificial Sequence: Synthetic oligonucleotide
uagcauguucccaauucuca

SEQ ID NO: 2188 - RNA, 20 nt, Artificial Sequence
  Description of Artificial Sequence: Synthetic oligonucleotide
uuagcauguucccaauucuc

SEQ ID NO: 2189 - RNA, 20 nt, Artificial Sequence
  Description of Artificial Sequence: Synthetic oligonucleotide
uuuagcauguucccaauucu

SEQ ID NO: 2190 - RNA, 20 nt, Artificial Sequence
  Description of Artificial Sequence: Synthetic oligonucleotide
uauuuagcauguucccaauu

SEQ ID NO: 2191 - RNA, 20 nt, Artificial Sequence
  Description of Artificial Sequence: Synthetic oligonucleotide
guauuuagcauguucccaau

SEQ ID NO: 2192 - RNA, 20 nt, Artificial Sequence
  Description of Artificial Sequence: Synthetic oligonucleotide
uguauuuagcauguucccaa

SEQ ID NO: 2193 - RNA, 20 nt, Artificial Sequence
  Description of Artificial Sequence: Synthetic oligonucleotide
uuguauuuagcauguuccca

SEQ ID NO: 2194 - RNA, 20 nt, Artificial Sequence
  Description of Artificial Sequence: Synthetic oligonucleotide
uuuguauuuagcauguuccc

SEQ ID NO: 2195 - RNA, 20 nt, Artificial Sequence
  Description of Artificial Sequence: Synthetic oligonucleotide
gcugcucuuuuccagguuca

SEQ ID NO: 2196 - RNA, 20 nt, Artificial Sequence
  Description of Artificial Sequence: Synthetic oligonucleotide
cuuccuccaaccauaaaaca

SEQ ID NO: 2197 - RNA, 20 nt, Artificial Sequence
  Description of Artificial Sequence: Synthetic oligonucleotide
agguucaagugggauacuag

SEQ ID NO: 2198 - RNA, 20 nt, Artificial Sequence
  Description of Artificial Sequence: Synthetic oligonucleotide
gcacuuacaagcacgggucc

SEQ ID NO: 2199 - RNA, 20 nt, Artificial Sequence
  Description of Artificial Sequence: Synthetic oligonucleotide
ggcaacucuuccaccaguaa

SEQ ID NO: 2200 - RNA, 20 nt, Artificial Sequence
  Description of Artificial Sequence: Synthetic oligonucleotide
gaguucuuccaacuggggac

SEQ ID NO: 2201 - RNA, 20 nt, Artificial Sequence
  Description of Artificial Sequence: Synthetic oligonucleotide
gguaucaucugcagaauaau

SEQ ID NO: 2202 - RNA, 20 nt, Artificial Sequence
  Description of Artificial Sequence: Synthetic oligonucleotide
uuucagggccaagucauuug

SEQ ID NO: 2203 - RNA, 20 nt, Artificial Sequence
  Description of Artificial Sequence: Synthetic oligonucleotide
ccacaucuacauuugucugc

SEQ ID NO: 2204 - RNA, 20 nt, Artificial Sequence
  Description of Artificial Sequence: Synthetic oligonucleotide
cuuuccuuacggguagcauc

SEQ ID NO: 2205 - RNA, 20 nt, Artificial Sequence
  Description of Artificial Sequence: Synthetic oligonucleotide
uucuuccaaagcagccucuc

SEQ ID NO: 2206 - RNA, 20 nt, Artificial Sequence
  Description of Artificial Sequence: Synthetic oligonucleotide
uccuguaggacauuggcagu

SEQ ID NO: 2207 - RNA, 20 nt, Artificial Sequence
  Description of Artificial Sequence: Synthetic oligonucleotide
gcugcucuuuuccagguuca

SEQ ID NO: 2208 - RNA, 20 nt, Artificial Sequence
  Description of Artificial Sequence: Synthetic oligonucleotide
cuuccuccaaccauaaaaca

SEQ ID NO: 2209 - RNA, 20 nt, Artificial Sequence
  Description of Artificial Sequence: Synthetic oligonucleotide
agguucaagugggauacuag

SEQ ID NO: 2210 - RNA, 20 nt, Artificial Sequence
  Description of Artificial Sequence: Synthetic oligonucleotide
gcacuuacaagcacgggucc

SEQ ID NO: 2211 - RNA, 20 nt, Artificial Sequence
  Description of Artificial Sequence: Synthetic oligonucleotide
ggcaacucuuccaccaguaa

SEQ ID NO: 2212 - RNA, 20 nt, Artificial Sequence
  Description of Artificial Sequence: Synthetic oligonucleotide
gaguucuuccaacuggggac

SEQ ID NO: 2213 - RNA, 20 nt, Artificial Sequence
  Description of Artificial Sequence: Synthetic oligonucleotide
gguaucaucugcagaauaau

SEQ ID NO: 2214 - RNA, 20 nt, Artificial Sequence
  Description of Artificial Sequence: Synthetic oligonucleotide
uuucagggccaagucauuug

SEQ ID NO: 2215 - RNA, 20 nt, Artificial Sequence
  Description of Artificial Sequence: Synthetic oligonucleotide
ccacaucuacauuugucugc

SEQ ID NO: 2216 - RNA, 20 nt, Artificial Sequence
  Description of Artificial Sequence: Synthetic oligonucleotide
cuuuccuuacggguagcauc

SEQ ID NO: 2217 - RNA, 20 nt, Artificial Sequence
  Description of Artificial Sequence: Synthetic oligonucleotide
uucuuccaaagcagccucuc

SEQ ID NO: 2218 - RNA, 20 nt, Artificial Sequence
  Description of Artificial Sequence: Synthetic oligonucleotide
uccuguaggacauuggcagu

SEQ ID NO: 2219 - RNA, 20 nt, Artificial Sequence
  Description of Artificial Sequence: Synthetic oligonucleotide
cuccgguucugaagguguuc

SEQ ID NO: 2220 - RNA, 20 nt, Artificial Sequence
  Description of Artificial Sequence: Synthetic oligonucleotide
cuccgguucugaagguguuc

SEQ ID NO: 2221 - RNA, 20 nt, Artificial Sequence
  Description of Artificial Sequence: Synthetic oligonucleotide
cuccgguucugaagguguuc

SEQ ID NO: 2222 - RNA, 20 nt, Artificial Sequence
  Description of Artificial Sequence: Synthetic oligonucleotide
cuccgguucugaagguguuc

SEQ ID NO: 2223 - RNA, 20 nt, Artificial Sequence
  Description of Artificial Sequence: Synthetic oligonucleotide
ucacucagauaguugaagcc

SEQ ID NO: 2224 - RNA, 20 nt, Artificial Sequence
  Description of Artificial Sequence: Synthetic oligonucleotide
ucacucagauaguugaagcc

SEQ ID NO: 2225 - RNA, 20 nt, Artificial Sequence
  Description of Artificial Sequence: Synthetic oligonucleotide
cuccgguucugaagguguuc

SEQ ID NO: 2226 - RNA, 20 nt, Artificial Sequence
  Description of Artificial Sequence: Synthetic oligonucleotide
cuccgguucugaagguguuc

SEQ ID NO: 2227 - RNA, 20 nt, Artificial Sequence
  Description of Artificial Sequence: Synthetic oligonucleotide
cuccgguucugaagguguuc

SEQ ID NO: 2228 - RNA, 19 nt, Artificial Sequence
  Description of Artificial Sequence: Synthetic oligonucleotide
ccgguucugaagguguucu

SEQ ID NO: 2229 - RNA, 19 nt, Artificial Sequence
  Description of Artificial Sequence: Synthetic oligonucleotide
uccgguucugaagguguuc

SEQ ID NO: 2230 - RNA, 19 nt, Artificial Sequence
  Description of Artificial Sequence: Synthetic oligonucleotide
uccgguucugaagguguuc

SEQ ID NO: 2231 - RNA, 18 nt, Artificial Sequence
  Description of Artificial Sequence: Synthetic oligonucleotide
ccgguucugaagguguuc

SEQ ID NO: 2232 - RNA, 18 nt, Artificial Sequence
  Description of Artificial Sequence: Synthetic oligonucleotide
uccgguucugaagguguu

SEQ ID NO: 2233 - RNA, 18 nt, Artificial Sequence
  Description of Artificial Sequence: Synthetic oligonucleotide
uccgguucugaagguguu

SEQ ID NO: 2234 - RNA, 20 nt, Artificial Sequence
  Description of Artificial Sequence: Synthetic oligonucleotide
cuccgguucugaagguguuc

SEQ ID NO: 2235 - RNA, 20 nt, Artificial Sequence
  Description of Artificial Sequence: Synthetic oligonucleotide
ucacucagauaguugaagcc

SEQ ID NO: 2236 - RNA, 19 nt, Artificial Sequence
  Description of Artificial Sequence: Synthetic oligonucleotide
caaggaagauggcauuucu

SEQ ID NO: 2237 - RNA, 18 nt, Artificial Sequence
  Description of Artificial Sequence: Synthetic oligonucleotide
aaggaagauggcauuucu

SEQ ID NO: 2238 - RNA, 20 nt, Artificial Sequence
  Description of Artificial Sequence: Synthetic oligonucleotide
ucaaggaagauggcauuucu

SEQ ID NO: 2239 - RNA, 21 nt, Artificial Sequence
  Description of Artificial Sequence: Synthetic oligonucleotide
uucaaggaagauggcauuucu

SEQ ID NO: 2240 - RNA, 20 nt, Artificial Sequence
  Description of Artificial Sequence: Synthetic oligonucleotide
ucacucagauaguugaagcc

SEQ ID NO: 2241 - RNA, 20 nt, Artificial Sequence
  Description of Artificial Sequence: Synthetic oligonucleotide
ucacucagauaguugaagcc

SEQ ID NO: 2242 - RNA, 20 nt, Artificial Sequence
  Description of Artificial Sequence: Synthetic oligonucleotide
ucacucagauaguugaagcc

SEQ ID NO: 2243 - RNA, 20 nt, Artificial Sequence
  Description of Artificial Sequence: Synthetic oligonucleotide
ucacucagauaguugaagcc

SEQ ID NO: 2244 - RNA, 20 nt, Artificial Sequence
  Description of Artificial Sequence: Synthetic oligonucleotide
ucacucagauaguugaagcc

SEQ ID NO: 2245 - RNA, 20 nt, Artificial Sequence
  Description of Artificial Sequence: Synthetic oligonucleotide
ucacucagauaguugaagcc

SEQ ID NO: 2246 - RNA, 20 nt, Artificial Sequence
  Description of Artificial Sequence: Synthetic oligonucleotide
ucacucagauaguugaagcc

SEQ ID NO: 2247 - RNA, 20 nt, Artificial Sequence
  Description of Artificial Sequence: Synthetic oligonucleotide
ucacucagauaguugaagcc

SEQ ID NO: 2248 - RNA, 20 nt, Artificial Sequence
  Description of Artificial Sequence: Synthetic oligonucleotide
ucacucagauaguugaagcc

SEQ ID NO: 2249 - RNA, 20 nt, Artificial Sequence
  Description of Artificial Sequence: Synthetic oligonucleotide
ucacucagauaguugaagcc

SEQ ID NO: 2250 - RNA, 20 nt, Artificial Sequence
  Description of Artificial Sequence: Synthetic oligonucleotide
ucacucagauaguugaagcc

SEQ ID NO: 2251 - RNA, 20 nt, Artificial Sequence
  Description of Artificial Sequence: Synthetic oligonucleotide
ucacucagauaguugaagcc

SEQ ID NO: 2252 - RNA, 20 nt, Artificial Sequence
  Description of Artificial Sequence: Synthetic oligonucleotide
ucacucagauaguugaagcc

SEQ ID NO: 2253 - RNA, 17 nt, Artificial Sequence
  Description of Artificial Sequence: Synthetic oligonucleotide
gguucugaagguguucu

SEQ ID NO: 2254 - RNA, 20 nt, Artificial Sequence
  Description of Artificial Sequence: Synthetic oligonucleotide
uccgguucugaagguguucu

SEQ ID NO: 2255 - RNA, 21 nt, Artificial Sequence
  Description of Artificial Sequence: Synthetic oligonucleotide
guccgguucugaagguguucu

SEQ ID NO: 2256 - RNA, 18 nt, Artificial Sequence
  Description of Artificial Sequence: Synthetic oligonucleotide
ccgguucugaagguguuc

SEQ ID NO: 2257 - RNA, 20 nt, Artificial Sequence
  Description of Artificial Sequence: Synthetic oligonucleotide
cuccgguucugaagguguuc

SEQ ID NO: 2258 - RNA, 21 nt, Artificial Sequence
  Description of Artificial Sequence: Synthetic oligonucleotide
ccuccgguucugaagguguuc

SEQ ID NO: 2259 - RNA, 18 nt, Artificial Sequence
  Description of Artificial Sequence: Synthetic oligonucleotide
ccgguucugaagguguuc

SEQ ID NO: 2260 - RNA, 20 nt, Artificial Sequence
  Description of Artificial Sequence: Synthetic oligonucleotide
cuccgguucugaagguguuc

SEQ ID NO: 2261 - RNA, 21 nt, Artificial Sequence
  Description of Artificial Sequence: Synthetic oligonucleotide
ccuccgguucugaagguguuc

SEQ ID NO: 2262 - RNA, 32 nt, Artificial Sequence
  Description of Artificial Sequence: Synthetic oligonucleotide
cagaguaacagucugaguagguuuuagagcua

SEQ ID NO: 2263 - RNA, 30 nt, Artificial Sequence
  Description of Artificial Sequence: Synthetic oligonucleotide
gaguaacagucugaguagguuuuagagcua

SEQ ID NO: 2264 - RNA, 30 nt, Artificial Sequence; identical to SEQ ID NO: 2263
  Description of Artificial Sequence: Synthetic oligonucleotide

SEQ ID NO: 2265 - RNA, 30 nt, Artificial Sequence; identical to SEQ ID NO: 2263
  Description of Artificial Sequence: Synthetic oligonucleotide

SEQ ID NO: 2266 - RNA, 30 nt, Artificial Sequence; identical to SEQ ID NO: 2263
  Description of Artificial Sequence: Synthetic oligonucleotide

SEQ ID NO: 2267 - RNA, 30 nt, Artificial Sequence; identical to SEQ ID NO: 2263
  Description of Artificial Sequence: Synthetic oligonucleotide

SEQ ID NO: 2268 - RNA, 30 nt, Artificial Sequence; identical to SEQ ID NO: 2263
  Description of Artificial Sequence: Synthetic oligonucleotide

SEQ ID NO: 2269 - RNA, 30 nt, Artificial Sequence; identical to SEQ ID NO: 2263
  Description of Artificial Sequence: Synthetic oligonucleotide

SEQ ID NO: 2270 - RNA, 30 nt, Artificial Sequence; identical to SEQ ID NO: 2263
  Description of Artificial Sequence: Synthetic oligonucleotide

SEQ ID NO: 2271 - RNA, 30 nt, Artificial Sequence; identical to SEQ ID NO: 2263
  Description of Artificial Sequence: Synthetic oligonucleotide

SEQ ID NO: 2272 - RNA, 30 nt, Artificial Sequence; identical to SEQ ID NO: 2263
  Description of Artificial Sequence: Synthetic oligonucleotide

SEQ ID NO: 2273 - RNA, 30 nt, Artificial Sequence; identical to SEQ ID NO: 2263
  Description of Artificial Sequence: Synthetic oligonucleotide

SEQ ID NO: 2274 - RNA, 30 nt, Artificial Sequence; identical to SEQ ID NO: 2263
  Description of Artificial Sequence: Synthetic oligonucleotide

SEQ ID NO: 2275 - RNA, 30 nt, Artificial Sequence; identical to SEQ ID NO: 2263
  Description of Artificial Sequence: Synthetic oligonucleotide

SEQ ID NO: 2276 - RNA, 30 nt, Artificial Sequence; identical to SEQ ID NO: 2263
  Description of Artificial Sequence: Synthetic oligonucleotide

SEQ ID NO: 2277 - RNA, 20 nt, Artificial Sequence
  Description of Artificial Sequence: Synthetic oligonucleotide
ucaaggaagauggcauuucu

SEQ ID NO: 2278 - RNA, 20 nt, Artificial Sequence
  Description of Artificial Sequence: Synthetic oligonucleotide
ucaaggaagauggcauuucu

SEQ ID NO: 2279 - RNA, 20 nt, Artificial Sequence
  Description of Artificial Sequence: Synthetic oligonucleotide
ucaaggaagauggcauuucu

SEQ ID NO: 2280 - RNA, 20 nt, Artificial Sequence
  Description of Artificial Sequence: Synthetic oligonucleotide
ucaaggaagauggcauuucu

SEQ ID NO: 2281 - RNA, 20 nt, Artificial Sequence
  Description of Artificial Sequence: Synthetic oligonucleotide
ucaaggaagauggcauuucu

SEQ ID NO: 2282 - RNA, 20 nt, Artificial Sequence
  Description of Artificial Sequence: Synthetic oligonucleotide
ucaaggaagauggcauuucu

SEQ ID NO: 2283 - RNA, 20 nt, Artificial Sequence
  Description of Artificial Sequence: Synthetic oligonucleotide
ucaaggaagauggcauuucu

SEQ ID NO: 2284 - RNA, 20 nt, Artificial Sequence
  Description of Artificial Sequence: Synthetic oligonucleotide
ucaaggaagauggcauuucu

SEQ ID NO: 2285 - RNA, 30 nt, Artificial Sequence; identical to SEQ ID NO: 2263
  Description of Artificial Sequence: Synthetic oligonucleotide

SEQ ID NO: 2286 - RNA, 30 nt, Artificial Sequence; identical to SEQ ID NO: 2263
  Description of Artificial Sequence: Synthetic oligonucleotide

SEQ ID NO: 2287 - RNA, 30 nt, Artificial Sequence; identical to SEQ ID NO: 2263
  Description of Artificial Sequence: Synthetic oligonucleotide

SEQ ID NO: 2288 - RNA, 20 nt, Artificial Sequence
  Description of Artificial Sequence: Synthetic oligonucleotide
ccuacccuauguacaucguu

SEQ ID NO: 2289 - RNA, 20 nt, Artificial Sequence
  Description of Artificial Sequence: Synthetic oligonucleotide
ccuauguacaucguucugcu

SEQ ID NO: 2290 - RNA, 20 nt, Artificial Sequence
  Description of Artificial Sequence: Synthetic oligonucleotide
guacaucguucugcuucuga

SEQ ID NO: 2291 - RNA, 20 nt, Artificial Sequence
  Description of Artificial Sequence: Synthetic oligonucleotide
ucguucugcuucugaacugc

SEQ ID NO: 2292 - RNA, 20 nt, Artificial Sequence
  Description of Artificial Sequence: Synthetic oligonucleotide
ucugcuucugaacugcugga

SEQ ID NO: 2293 - RNA, 20 nt, Artificial Sequence
  Description of Artificial Sequence: Synthetic oligonucleotide
uucugaacugcuggaaaguc

SEQ ID NO: 2294 - RNA, 20 nt, Artificial Sequence
  Description of Artificial Sequence: Synthetic oligonucleotide
aacugcuggaaagucgccuc

SEQ ID NO: 2295 - RNA, 20 nt, Artificial Sequence
  Description of Artificial Sequence: Synthetic oligonucleotide
aagucgccuccaauaggugc

SEQ ID NO: 2296 - RNA, 20 nt, Artificial Sequence
  Description of Artificial Sequence: Synthetic oligonucleotide
gccuccaauaggugccugcc

SEQ ID NO: 2297 - RNA, 20 nt, Artificial Sequence
  Description of Artificial Sequence: Synthetic oligonucleotide
caauaggugccugccggcuu

SEQ ID NO: 2298 - RNA, 20 nt, Artificial Sequence
  Description of Artificial Sequence: Synthetic oligonucleotide
ggugccugccggcuuaauuc

SEQ ID NO: 2299 - RNA, 20 nt, Artificial Sequence
  Description of Artificial Sequence: Synthetic oligonucleotide
cugccggcuuaauucaucau

SEQ ID NO: 2300 - RNA, 20 nt, Artificial Sequence
  Description of Artificial Sequence: Synthetic oligonucleotide
ggcuuaauucaucaucuuuc

SEQ ID NO: 2301 - RNA, 20 nt, Artificial Sequence
  Description of Artificial Sequence: Synthetic oligonucleotide
aauucaucaucuuucagcug

SEQ ID NO: 2302 - RNA, 20 nt, Artificial Sequence
  Description of Artificial Sequence: Synthetic oligonucleotide
aucaucuuucagcuguagcc

SEQ ID NO: 2303 - RNA, 20 nt, Artificial Sequence
  Description of Artificial Sequence: Synthetic oligonucleotide
cuuucagcuguagccacacc

SEQ ID NO: 2304 - RNA, 20 nt, Artificial Sequence
  Description of Artificial Sequence: Synthetic oligonucleotide
agcuguagccacaccagaag

SEQ ID NO: 2305 - RNA, 20 nt, Artificial Sequence
  Description of Artificial Sequence: Synthetic oligonucleotide
uagccacaccagaaguuccu

SEQ ID NO: 2306 - RNA, 20 nt, Artificial Sequence
  Description of Artificial Sequence: Synthetic oligonucleotide
acaccagaaguuccugcaga

SEQ ID NO: 2307 - RNA, 20 nt, Artificial Sequence
  Description of Artificial Sequence: Synthetic oligonucleotide
agaaguuccugcagagaaag

SEQ ID NO: 2308 - RNA, 20 nt, Artificial Sequence
  Description of Artificial Sequence: Synthetic oligonucleotide
uccugcagagaaaggugcag

SEQ ID NO: 2309 - RNA, 20 nt, Artificial Sequence
  Description of Artificial Sequence: Synthetic oligonucleotide
cagagaaaggugcagacgcu

SEQ ID NO: 2310 - RNA, 20 nt, Artificial Sequence
  Description of Artificial Sequence: Synthetic oligonucleotide
aaaggugcagacgcuuccac

SEQ ID NO: 2311 - RNA, 20 nt, Artificial Sequence
  Description of Artificial Sequence: Synthetic oligonucleotide
ugcagacgcuuccacugguc

SEQ ID NO: 2312 - RNA, 20 nt, Artificial Sequence
  Description of Artificial Sequence: Synthetic oligonucleotide
acgcuuccacuggucagaac

SEQ ID NO: 2313 - RNA, 20 nt, Artificial Sequence
  Description of Artificial Sequence: Synthetic oligonucleotide
uccacuggucagaacuggcu

SEQ ID NO: 2314 - RNA, 20 nt, Artificial Sequence
  Description of Artificial Sequence: Synthetic oligonucleotide
uggucagaacuggcuuccaa

SEQ ID NO: 2315 - RNA, 20 nt, Artificial Sequence
  Description of Artificial Sequence: Synthetic oligonucleotide
agaacuggcuuccaaauggg

SEQ ID NO: 2316 - RNA, 20 nt, Artificial Sequence
  Description of Artificial Sequence: Synthetic oligonucleotide
uggcuuccaaaugggaccug

SEQ ID NO: 2317 - RNA, 20 nt, Artificial Sequence
  Description of Artificial Sequence: Synthetic oligonucleotide
aggcacgaggcuuaaaaaug

SEQ ID NO: 2318 - RNA, 20 nt, Artificial Sequence
  Description of Artificial Sequence: Synthetic oligonucleotide
ggcacgaggcuuaaaaaugu

SEQ ID NO: 2319 - RNA, 20 nt, Artificial Sequence
  Description of Artificial Sequence: Synthetic oligonucleotide
gcacgaggcuuaaaaauguc

SEQ ID NO: 2320 - RNA, 20 nt, Artificial Sequence
  Description of Artificial Sequence: Synthetic oligonucleotide
cacgaggcuuaaaaaugucc

SEQ ID NO: 2321 - RNA, 20 nt, Artificial Sequence
  Description of Artificial Sequence: Synthetic oligonucleotide
acgaggcuuaaaaauguccu

SEQ ID NO: 2322 - RNA, 20 nt, Artificial Sequence
  Description of Artificial Sequence: Synthetic oligonucleotide
cgaggcuuaaaaauguccua

SEQ ID NO: 2323 - RNA, 20 nt, Artificial Sequence
  Description of Artificial Sequence: Synthetic oligonucleotide
gaggcuuaaaaauguccuac

SEQ ID NO: 2324 - RNA, 20 nt, Artificial Sequence
  Description of Artificial Sequence: Synthetic oligonucleotide
aggcuuaaaaauguccuacc

SEQ ID NO: 2325 - RNA, 20 nt, Artificial Sequence
  Description of Artificial Sequence: Synthetic oligonucleotide
ggcuuaaaaauguccuaccc

SEQ ID NO: 2326 - RNA, 20 nt, Artificial Sequence
  Description of Artificial Sequence: Synthetic oligonucleotide
gcuuaaaaauguccuacccu

SEQ ID NO: 2327 - RNA, 20 nt, Artificial Sequence
  Description of Artificial Sequence: Synthetic oligonucleotide
cuuaaaaauguccuacccua

SEQ ID NO: 2328 - RNA, 20 nt, Artificial Sequence
  Description of Artificial Sequence: Synthetic oligonucleotide
uuaaaaauguccuacccuau

SEQ ID NO: 2329 - RNA, 20 nt, Artificial Sequence
  Description of Artificial Sequence: Synthetic oligonucleotide
uaaaaauguccuacccuaug

SEQ ID NO: 2330 - RNA, 20 nt, Artificial Sequence
  Description of Artificial Sequence: Synthetic oligonucleotide
aaaaauguccuacccuaugu

SEQ ID NO: 2331 - RNA, 20 nt, Artificial Sequence
  Description of Artificial Sequence: Synthetic oligonucleotide
aaaauguccuacccuaugua

SEQ ID NO: 2332 - RNA, 20 nt, Artificial Sequence
  Description of Artificial Sequence: Synthetic oligonucleotide
aaauguccuacccuauguac

SEQ ID NO: 2333 - RNA, 20 nt, Artificial Sequence
  Description of Artificial Sequence: Synthetic oligonucleotide
aauguccuacccuauguaca

SEQ ID NO: 2334 - RNA, 20 nt, Artificial Sequence
  Description of Artificial Sequence: Synthetic oligonucleotide
auguccuacccuauguacau

SEQ ID NO: 2335 - RNA, 20 nt, Artificial Sequence
  Description of Artificial Sequence: Synthetic oligonucleotide
uguccuacccuauguacauc

SEQ ID NO: 2336 - RNA, 20 nt, Artificial Sequence
  Description of Artificial Sequence: Synthetic oligonucleotide
guccuacccuauguacaucg

SEQ ID NO: 2337 - RNA, 20 nt, Artificial Sequence
  Description of Artificial Sequence: Synthetic oligonucleotide
uccuacccuauguacaucgu

SEQ ID NO: 2338 - RNA, 20 nt, Artificial Sequence
  Description of Artificial Sequence: Synthetic oligonucleotide
cuacccuauguacaucguuc

SEQ ID NO: 2339 - RNA, 20 nt, Artificial Sequence
  Description of Artificial Sequence: Synthetic oligonucleotide
uacccuauguacaucguucu

SEQ ID NO: 2340 - RNA, 20 nt, Artificial Sequence
  Description of Artificial Sequence: Synthetic oligonucleotide
uucgaaaaaacaaaucaaag

SEQ ID NO: 2341 - RNA, 20 nt, Artificial Sequence
  Description of Artificial Sequence: Synthetic oligonucleotide
ucgaaaaaacaaaucaaaga

SEQ ID NO: 2342 - RNA, 20 nt, Artificial Sequence
  Description of Artificial Sequence: Synthetic oligonucleotide
cgaaaaaacaaaucaaagac

SEQ ID NO: 2343 - RNA, 20 nt, Artificial Sequence
  Description of Artificial Sequence: Synthetic oligonucleotide
gaaaaaacaaaucaaagacu

SEQ ID NO: 2344 - RNA, 20 nt, Artificial Sequence
  Description of Artificial Sequence: Synthetic oligonucleotide
aaaaaacaaaucaaagacuu

SEQ ID NO: 2345 - RNA, 20 nt, Artificial Sequence
  Description of Artificial Sequence: Synthetic oligonucleotide
aaaaacaaaucaaagacuua

SEQ ID NO: 2346 - RNA, 20 nt, Artificial Sequence
  Description of Artificial Sequence: Synthetic oligonucleotide
aaaacaaaucaaagacuuac

SEQ ID NO: 2347 - RNA, 20 nt, Artificial Sequence
  Description of Artificial Sequence: Synthetic oligonucleotide
aaacaaaucaaagacuuacc

SEQ ID NO: 2348 - RNA, 20 nt, Artificial Sequence
  Description of Artificial Sequence: Synthetic oligonucleotide
aacaaaucaaagacuuaccu

SEQ ID NO: 2349 - RNA, 20 nt, Artificial Sequence
  Description of Artificial Sequence: Synthetic oligonucleotide
acaaaucaaagacuuaccuu

SEQ ID NO: 2350 - RNA, 20 nt, Artificial Sequence
  Description of Artificial Sequence: Synthetic oligonucleotide
caaaucaaagacuuaccuua

SEQ ID NO: 2351 - RNA, 20 nt, Artificial Sequence
  Description of Artificial Sequence: Synthetic oligonucleotide
aaaucaaagacuuaccuuaa

SEQ ID NO: 2352 - RNA, 20 nt, Artificial Sequence
  Description of Artificial Sequence: Synthetic oligonucleotide
aaucaaagacuuaccuuaag

SEQ ID NO: 2353 - RNA, 20 nt, Artificial Sequence
  Description of Artificial Sequence: Synthetic oligonucleotide
aucaaagacuuaccuuaaga

SEQ ID NO: 2354 - RNA, 20 nt, Artificial Sequence
  Description of Artificial Sequence: Synthetic oligonucleotide
ucaaagacuuaccuuaagau

SEQ ID NO: 2355 - RNA, 20 nt, Artificial Sequence
  Description of Artificial Sequence: Synthetic oligonucleotide
caaagacuuaccuuaagaua

SEQ ID NO: 2356 - RNA, 20 nt, Artificial Sequence
  Description of Artificial Sequence: Synthetic oligonucleotide
aaagacuuaccuuaagauac

SEQ ID NO: 2357 - RNA, 20 nt, Artificial Sequence
  Description of Artificial Sequence: Synthetic oligonucleotide
aagacuuaccuuaagauacc

SEQ ID NO: 2358 - RNA, 20 nt, Artificial Sequence
  Description of Artificial Sequence: Synthetic oligonucleotide
agacuuaccuuaagauacca

SEQ ID NO: 2359 - RNA, 20 nt, Artificial Sequence
  Description of Artificial Sequence: Synthetic oligonucleotide
gacuuaccuuaagauaccau

SEQ ID NO: 2360 - RNA, 20 nt, Artificial Sequence
  Description of Artificial Sequence: Synthetic oligonucleotide
acuuaccuuaagauaccauu

SEQ ID NO: 2361 - RNA, 20 nt, Artificial Sequence
  Description of Artificial Sequence: Synthetic oligonucleotide
cuuaccuuaagauaccauuu

SEQ ID NO: 2362 - RNA, 20 nt, Artificial Sequence
  Description of Artificial Sequence: Synthetic oligonucleotide
uuaccuuaagauaccauuug

SEQ ID NO: 2363 - RNA, 20 nt, Artificial Sequence
  Description of Artificial Sequence: Synthetic oligonucleotide
uaccuuaagauaccauuugu

SEQ ID NO: 2364 - RNA, 20 nt, Artificial Sequence
  Description of Artificial Sequence: Synthetic oligonucleotide
aggcaaaacaaaaaugaagc

SEQ ID NO: 2365 - RNA, 20 nt, Artificial Sequence
  Description of Artificial Sequence: Synthetic oligonucleotide
gcaaaacaaaaaugaagccc

SEQ ID NO: 2366 - RNA, 20 nt, Artificial Sequence
  Description of Artificial Sequence: Synthetic oligonucleotide
aaaacaaaaaugaagcccca

SEQ ID NO: 2367 - RNA, 20 nt, Artificial Sequence
  Description of Artificial Sequence: Synthetic oligonucleotide
aacaaaaaugaagccccaug

SEQ ID NO: 2368 - RNA, 20 nt, Artificial Sequence
  Description of Artificial Sequence: Synthetic oligonucleotide
caaaaaugaagccccauguc

SEQ ID NO: 2369 - RNA, 20 nt, Artificial Sequence
  Description of Artificial Sequence: Synthetic oligonucleotide
aaaaugaagccccaugucuu

SEQ ID NO: 2370 - RNA, 20 nt, Artificial Sequence
  Description of Artificial Sequence: Synthetic oligonucleotide
aaugaagccccaugucuuuu

SEQ ID NO: 2371 - RNA, 20 nt, Artificial Sequence
  Description of Artificial Sequence: Synthetic oligonucleotide
augaagccccaugucuuuuu

SEQ ID NO: 2372 - RNA, 20 nt, Artificial Sequence
  Description of Artificial Sequence: Synthetic oligonucleotide
gaagccccaugucuuuuuau

SEQ ID NO: 2373 - RNA, 20 nt, Artificial Sequence
  Description of Artificial Sequence: Synthetic oligonucleotide
agccccaugucuuuuuauuu

SEQ ID NO: 2374 - RNA, 20 nt, Artificial Sequence
  Description of Artificial Sequence: Synthetic oligonucleotide
ccccaugucuuuuuauuuga

SEQ ID NO: 2375 - RNA, 20 nt, Artificial Sequence
  Description of Artificial Sequence: Synthetic oligonucleotide
ugaagccccaugucuuuuua

SEQ ID NO: 2376 - RNA, 20 nt, Artificial Sequence
  Description of Artificial Sequence: Synthetic oligonucleotide
aagccccaugucuuuuuauu

SEQ ID NO: 2377 - RNA, 20 nt, Artificial Sequence
  Description of Artificial Sequence: Synthetic oligonucleotide
gccccaugucuuuuuauuug

SEQ ID NO: 2378 - RNA, 20 nt, Artificial Sequence
  Description of Artificial Sequence: Synthetic oligonucleotide
ucacucagauaguugaagcc

SEQ ID NO: 2379 - RNA, 20 nt, Artificial Sequence
  Description of Artificial Sequence: Synthetic oligonucleotide
ucacucagauaguugaagcc

SEQ ID NO: 2380 - RNA, 20 nt, Artificial Sequence
  Description of Artificial Sequence: Synthetic oligonucleotide
ccuacccuauguacaucguu

SEQ ID NO: 2381 - RNA, 20 nt, Artificial Sequence
  Description of Artificial Sequence: Synthetic oligonucleotide
ccuauguacaucguucugcu

SEQ ID NO: 2382 - RNA, 20 nt, Artificial Sequence
  Description of Artificial Sequence: Synthetic oligonucleotide
guacaucguucugcuucuga

SEQ ID NO: 2383 - RNA, 20 nt, Artificial Sequence
  Description of Artificial Sequence: Synthetic oligonucleotide
ucguucugcuucugaacugc

SEQ ID NO: 2384 - RNA, 20 nt, Artificial Sequence
  Description of Artificial Sequence: Synthetic oligonucleotide
ucugcuucugaacugcugga

SEQ ID NO: 2385 - RNA, 20 nt, Artificial Sequence
  Description of Artificial Sequence: Synthetic oligonucleotide
uucugaacugcuggaaaguc

SEQ ID NO: 2386 - RNA, 20 nt, Artificial Sequence
  Description of Artificial Sequence: Synthetic oligonucleotide
aacugcuggaaagucgccuc

SEQ ID NO: 2387 - RNA, 20 nt, Artificial Sequence
  Description of Artificial Sequence: Synthetic oligonucleotide
aagucgccuccaauaggugc

SEQ ID NO: 2388 - RNA, 20 nt, Artificial Sequence
  Description of Artificial Sequence: Synthetic oligonucleotide
gccuccaauaggugccugcc

SEQ ID NO: 2389 - RNA, 20 nt, Artificial Sequence
  Description of Artificial Sequence: Synthetic oligonucleotide
caauaggugccugccggcuu

SEQ ID NO: 2390 - RNA, 20 nt, Artificial Sequence
  Description of Artificial Sequence: Synthetic oligonucleotide
ggugccugccggcuuaauuc

SEQ ID NO: 2391 - RNA, 20 nt, Artificial Sequence
  Description of Artificial Sequence: Synthetic oligonucleotide
cugccggcuuaauucaucau

SEQ ID NO: 2392 - RNA, 20 nt, Artificial Sequence
  Description of Artificial Sequence: Synthetic oligonucleotide
ggcuuaauucaucaucuuuc

SEQ ID NO: 2393 - RNA, 20 nt, Artificial Sequence
  Description of Artificial Sequence: Synthetic oligonucleotide
aauucaucaucuuucagcug

SEQ ID NO: 2394 - RNA, 20 nt, Artificial Sequence
  Description of Artificial Sequence: Synthetic oligonucleotide
aucaucuuucagcuguagcc

SEQ ID NO: 2395 - RNA, 20 nt, Artificial Sequence
  Description of Artificial Sequence: Synthetic oligonucleotide
cuuucagcuguagccacacc

SEQ ID NO: 2396 - RNA, 20 nt, Artificial Sequence
  Description of Artificial Sequence: Synthetic oligonucleotide
agcuguagccacaccagaag

SEQ ID NO: 2397 - RNA, 20 nt, Artificial Sequence
  Description of Artificial Sequence: Synthetic oligonucleotide
uagccacaccagaaguuccu

SEQ ID NO: 2398 - RNA, 20 nt, Artificial Sequence
  Description of Artificial Sequence: Synthetic oligonucleotide
acaccagaaguuccugcaga

SEQ ID NO: 2399 - RNA, 20 nt, Artificial Sequence
  Description of Artificial Sequence: Synthetic oligonucleotide
agaaguuccugcagagaaag

SEQ ID NO: 2400 - RNA, 20 nt, Artificial Sequence
  Description of Artificial Sequence: Synthetic oligonucleotide
uccugcagagaaaggugcag

SEQ ID NO: 2401 - RNA, 20 nt, Artificial Sequence
  Description of Artificial Sequence: Synthetic oligonucleotide
cagagaaaggugcagacgcu

SEQ ID NO: 2402 - RNA, 20 nt, Artificial Sequence
  Description of Artificial Sequence: Synthetic oligonucleotide
aaaggugcagacgcuuccac

SEQ ID NO: 2403 - RNA, 20 nt, Artificial Sequence
  Description of Artificial Sequence: Synthetic oligonucleotide
ugcagacgcuuccacugguc

SEQ ID NO: 2404 - RNA, 20 nt, Artificial Sequence
  Description of Artificial Sequence: Synthetic oligonucleotide
acgcuuccacuggucagaac

SEQ ID NO: 2405 - RNA, 20 nt, Artificial Sequence
  Description of Artificial Sequence: Synthetic oligonucleotide
uccacuggucagaacuggcu

SEQ ID NO: 2406 - RNA, 20 nt, Artificial Sequence
  Description of Artificial Sequence: Synthetic oligonucleotide
uggucagaacuggcuuccaa

SEQ ID NO: 2407 - RNA, 20 nt, Artificial Sequence
  Description of Artificial Sequence: Synthetic oligonucleotide
agaacuggcuuccaaauggg

SEQ ID NO: 2408 - RNA, 20 nt, Artificial Sequence
  Description of Artificial Sequence: Synthetic oligonucleotide
uggcuuccaaaugggaccug

SEQ ID NO: 2409 - RNA, 20 nt, Artificial Sequence
  Description of Artificial Sequence: Synthetic oligonucleotide
aggcacgaggcuuaaaaaug

SEQ ID NO: 2410 - RNA, 20 nt, Artificial Sequence
  Description of Artificial Sequence: Synthetic oligonucleotide
ggcacgaggcuuaaaaaugu

SEQ ID NO: 2411 - RNA, 20 nt, Artificial Sequence
  Description of Artificial Sequence: Synthetic oligonucleotide
gcacgaggcuuaaaaauguc

SEQ ID NO: 2412 - RNA, 20 nt, Artificial Sequence
  Description of Artificial Sequence: Synthetic oligonucleotide
cacgaggcuuaaaaaugucc

SEQ ID NO: 2413 - RNA, 20 nt, Artificial Sequence
  Description of Artificial Sequence: Synthetic oligonucleotide
acgaggcuuaaaaauguccu

SEQ ID NO: 2414 - RNA, 20 nt, Artificial Sequence
  Description of Artificial Sequence: Synthetic oligonucleotide
cgaggcuuaaaaauguccua

SEQ ID NO: 2415 - RNA, 20 nt, Artificial Sequence
  Description of Artificial Sequence: Synthetic oligonucleotide
gaggcuuaaaaauguccuac

SEQ ID NO: 2416 - RNA, 20 nt, Artificial Sequence
  Description of Artificial Sequence: Synthetic oligonucleotide
aggcuuaaaaauguccuacc

SEQ ID NO: 2417 - RNA, 20 nt, Artificial Sequence
  Description of Artificial Sequence: Synthetic oligonucleotide
ggcuuaaaaauguccuaccc

SEQ ID NO: 2418 - RNA, 20 nt, Artificial Sequence
  Description of Artificial Sequence: Synthetic oligonucleotide
gcuuaaaaauguccuacccu

SEQ ID NO: 2419 - RNA, 20 nt, Artificial Sequence
  Description of Artificial Sequence: Synthetic oligonucleotide
cuuaaaaauguccuacccua

SEQ ID NO: 2420 - RNA, 20 nt, Artificial Sequence
  Description of Artificial Sequence: Synthetic oligonucleotide
uuaaaaauguccuacccuau

SEQ ID NO: 2421 - RNA, 20 nt, Artificial Sequence
  Description of Artificial Sequence: Synthetic oligonucleotide
uaaaaauguccuacccuaug

SEQ ID NO: 2422 - RNA, 20 nt, Artificial Sequence
  Description of Artificial Sequence: Synthetic oligonucleotide
aaaaauguccuacccuaugu

SEQ ID NO: 2423 - RNA, 20 nt, Artificial Sequence
  Description of Artificial Sequence: Synthetic oligonucleotide
aaaauguccuacccuaugua

SEQ ID NO: 2424 - RNA, 20 nt, Artificial Sequence
  Description of Artificial Sequence: Synthetic oligonucleotide
aaauguccuacccuauguac

SEQ ID NO: 2425 - RNA, 20 nt, Artificial Sequence
  Description of Artificial Sequence: Synthetic oligonucleotide
aauguccuacccuauguaca

SEQ ID NO: 2426 - RNA, 20 nt, Artificial Sequence
  Description of Artificial Sequence: Synthetic oligonucleotide
auguccuacccuauguacau

SEQ ID NO: 2427 - RNA, 20 nt, Artificial Sequence
  Description of Artificial Sequence: Synthetic oligonucleotide
uguccuacccuauguacauc

SEQ ID NO: 2428 - RNA, 20 nt, Artificial Sequence
  Description of Artificial Sequence: Synthetic oligonucleotide
guccuacccuauguacaucg

SEQ ID NO: 2429 - RNA, 20 nt, Artificial Sequence
  Description of Artificial Sequence: Synthetic oligonucleotide
uccuacccuauguacaucgu

SEQ ID NO: 2430 - RNA, 20 nt, Artificial Sequence
  Description of Artificial Sequence: Synthetic oligonucleotide
cuacccuauguacaucguuc

SEQ ID NO: 2431 - RNA, 20 nt, Artificial Sequence
  Description of Artificial Sequence: Synthetic oligonucleotide
uacccuauguacaucguucu

SEQ ID NO: 2432 - RNA, 20 nt, Artificial Sequence
  Description of Artificial Sequence: Synthetic oligonucleotide
ccuucccugaagguuccucc

SEQ ID NO: 2433 - RNA, 20 nt, Artificial Sequence
  Description of Artificial Sequence: Synthetic oligonucleotide
ccuucccugaagguuccucc

SEQ ID NO: 2434 - RNA, 20 nt, Artificial Sequence
  Description of Artificial Sequence: Synthetic oligonucleotide
ccuucccugaagguuccucc

SEQ ID NO: 2435 - RNA, 20 nt, Artificial Sequence
  Description of Artificial Sequence: Synthetic oligonucleotide
ccuucccugaagguuccucc

SEQ ID NO: 2436 - RNA, 20 nt, Artificial Sequence
  Description of Artificial Sequence: Synthetic oligonucleotide
ccuucccugaagguuccucc

SEQ ID NO: 2437 - RNA, 20 nt, Artificial Sequence
  Description of Artificial Sequence: Synthetic oligonucleotide
ccuucccugaagguuccucc

SEQ ID NO: 2438 - RNA, 20 nt, Artificial Sequence
  Description of Artificial Sequence: Synthetic oligonucleotide
cuucugccaacuuuuaucau

SEQ ID NO: 2439 - RNA, 20 nt, Artificial Sequence
  Description of Artificial Sequence: Synthetic oligonucleotide
uucugccaacuuuuaucauu

SEQ ID NO: 2440 - RNA, 20 nt, Artificial Sequence
  Description of Artificial Sequence: Synthetic oligonucleotide
ucugccaacuuuuaucauuu

SEQ ID NO: 2441 - RNA, 20 nt, Artificial Sequence
  Description of Artificial Sequence: Synthetic oligonucleotide
cugccaacuuuuaucauuuu

SEQ ID NO: 2442 - RNA, 20 nt, Artificial Sequence
  Description of Artificial Sequence: Synthetic oligonucleotide
ugccaacuuuuaucauuuuu

SEQ ID NO: 2443 - RNA, 20 nt, Artificial Sequence
  Description of Artificial Sequence: Synthetic oligonucleotide
gccaacuuuuaucauuuuuu

SEQ ID NO: 2444 - RNA, 20 nt, Artificial Sequence
  Description of Artificial Sequence: Synthetic oligonucleotide
ccaacuuuuaucauuuuuuc

SEQ ID NO: 2445 - RNA, 20 nt, Artificial Sequence
  Description of Artificial Sequence: Synthetic oligonucleotide
caacuuuuaucauuuuuucu

SEQ ID NO: 2446 - RNA, 20 nt, Artificial Sequence
  Description of Artificial Sequence: Synthetic oligonucleotide
aacuuuuaucauuuuuucuc

SEQ ID NO: 2447 - RNA, 20 nt, Artificial Sequence
  Description of Artificial Sequence: Synthetic oligonucleotide
acuuuuaucauuuuuucuca

SEQ ID NO: 2448 - RNA, 20 nt, Artificial Sequence
  Description of Artificial Sequence: Synthetic oligonucleotide
cuuuuaucauuuuuucucau

SEQ ID NO: 2449 - RNA, 20 nt, Artificial Sequence
  Description of Artificial Sequence: Synthetic oligonucleotide
uuuuaucauuuuuucucaua

SEQ ID NO: 2450 - RNA, 20 nt, Artificial Sequence
  Description of Artificial Sequence: Synthetic oligonucleotide
uuuaucauuuuuucucauac

SEQ ID NO: 2451 - RNA, 20 nt, Artificial Sequence
  Description of Artificial Sequence: Synthetic oligonucleotide
uuaucauuuuuucucauacc

SEQ ID NO: 2452 - RNA, 20 nt, Artificial Sequence
  Description of Artificial Sequence: Synthetic oligonucleotide
uaucauuuuuucucauaccu

SEQ ID NO: 2453 - RNA, 20 nt, Artificial Sequence
  Description of Artificial Sequence: Synthetic oligonucleotide
aucauuuuuucucauaccuu

SEQ ID NO: 2454 - RNA, 20 nt, Artificial Sequence
  Description of Artificial Sequence: Synthetic oligonucleotide
ucauuuuuucucauaccuuc

SEQ ID NO: 2455 - RNA, 20 nt, Artificial Sequence
  Description of Artificial Sequence: Synthetic oligonucleotide
cauuuuuucucauaccuucu

SEQ ID NO: 2456 - RNA, 20 nt, Artificial Sequence
  Description of Artificial Sequence: Synthetic oligonucleotide
auuuuuucucauaccuucug

SEQ ID NO: 2457 - RNA, 20 nt, Artificial Sequence
  Description of Artificial Sequence: Synthetic oligonucleotide
uuuuuucucauaccuucugc

SEQ ID NO: 2458 - RNA, 20 nt, Artificial Sequence
  Description of Artificial Sequence: Synthetic oligonucleotide
uuuuucucauaccuucugcu

SEQ ID NO: 2459 - RNA, 20 nt, Artificial Sequence
  Description of Artificial Sequence: Synthetic oligonucleotide
uuuucucauaccuucugcuu

SEQ ID NO: 2460 - RNA, 20 nt, Artificial Sequence
  Description of Artificial Sequence: Synthetic oligonucleotide
uuucucauaccuucugcuug

SEQ ID NO: 2461 - RNA, 20 nt, Artificial Sequence
  Description of Artificial Sequence: Synthetic oligonucleotide
uucucauaccuucugcuuga

SEQ ID NO: 2462 - RNA, 20 nt, Artificial Sequence
  Description of Artificial Sequence: Synthetic oligonucleotide
ucucauaccuucugcuugau

SEQ ID NO: 2463 - RNA, 20 nt, Artificial Sequence
  Description of Artificial Sequence: Synthetic oligonucleotide
cucauaccuucugcuugaug

SEQ ID NO: 2464 - RNA, 20 nt, Artificial Sequence
  Description of Artificial Sequence: Synthetic oligonucleotide
ucauaccuucugcuugauga

SEQ ID NO: 2465 - RNA, 20 nt, Artificial Sequence
  Description of Artificial Sequence: Synthetic oligonucleotide
cauaccuucugcuugaugau

SEQ ID NO: 2466 - RNA, 20 nt, Artificial Sequence
  Description of Artificial Sequence: Synthetic oligonucleotide
auaccuucugcuugaugauc

SEQ ID NO: 2467 - RNA, 20 nt, Artificial Sequence
  Description of Artificial Sequence: Synthetic oligonucleotide
uaccuucugcuugaugauca

SEQ ID NO: 2468 - RNA, 20 nt, Artificial Sequence
  Description of Artificial Sequence: Synthetic oligonucleotide
accuucugcuugaugaucau

SEQ ID NO: 2469 - RNA, 20 nt, Artificial Sequence
  Description of Artificial Sequence: Synthetic oligonucleotide
ccuucugcuugaugaucauc

SEQ ID NO: 2470 - RNA, 20 nt, Artificial Sequence
  Description of Artificial Sequence: Synthetic oligonucleotide
cuucugcuugaugaucaucu

SEQ ID NO: 2471 - RNA, 20 nt, Artificial Sequence
  Description of Artificial Sequence: Synthetic oligonucleotide
uucugcuugaugaucaucuc

SEQ ID NO: 2472 - RNA, 20 nt, Artificial Sequence
  Description of Artificial Sequence: Synthetic oligonucleotide
ucugcuugaugaucaucucg

SEQ ID NO: 2473 - RNA, 20 nt, Artificial Sequence
  Description of Artificial Sequence: Synthetic oligonucleotide
cugcuugaugaucaucucgu

SEQ ID NO: 2474 - RNA, 20 nt, Artificial Sequence
  Description of Artificial Sequence: Synthetic oligonucleotide
ugcuugaugaucaucucguu

SEQ ID NO: 2475 - RNA, 20 nt, Artificial Sequence
  Description of Artificial Sequence: Synthetic oligonucleotide
gcuugaugaucaucucguug

SEQ ID NO: 2476 - RNA, 20 nt, Artificial Sequence
  Description of Artificial Sequence: Synthetic oligonucleotide
cuugaugaucaucucguuga

SEQ ID NO: 2477 - RNA, 20 nt, Artificial Sequence
  Description of Artificial Sequence: Synthetic oligonucleotide
uugaugaucaucucguugau

SEQ ID NO: 2478 - RNA, 20 nt, Artificial Sequence
  Description of Artificial Sequence: Synthetic oligonucleotide
ugaugaucaucucguugaua

SEQ ID NO: 2479 - RNA, 20 nt, Artificial Sequence
  Description of Artificial Sequence: Synthetic oligonucleotide
gaugaucaucucguugauau

SEQ ID NO: 2480 - RNA, 20 nt, Artificial Sequence
  Description of Artificial Sequence: Synthetic oligonucleotide
augaucaucucguugauauc

SEQ ID NO: 2481 - RNA, 20 nt, Artificial Sequence
  Description of Artificial Sequence: Synthetic oligonucleotide
ugaucaucucguugauaucc

SEQ ID NO: 2482 - RNA, 20 nt, Artificial Sequence
  Description of Artificial Sequence: Synthetic oligonucleotide
gaucaucucguugauauccu

SEQ ID NO: 2483 - RNA, 20 nt, Artificial Sequence
  Description of Artificial Sequence: Synthetic oligonucleotide
aucaucucguugauauccuc

SEQ ID NO: 2484 - RNA, 20 nt, Artificial Sequence
  Description of Artificial Sequence: Synthetic oligonucleotide
ucaucucguugauauccuca

SEQ ID NO: 2485 - RNA, 20 nt, Artificial Sequence
  Description of Artificial Sequence: Synthetic oligonucleotide
caucucguugauauccucaa

SEQ ID NO: 2486 - RNA, 20 nt, Artificial Sequence
  Description of Artificial Sequence: Synthetic oligonucleotide
aucucguugauauccucaag

SEQ ID NO: 2487 - RNA, 20 nt, Artificial Sequence
  Description of Artificial Sequence: Synthetic oligonucleotide
ucucguugauauccucaagg

SEQ ID NO: 2488 - RNA, 20 nt, Artificial Sequence
  Description of Artificial Sequence: Synthetic oligonucleotide
cucguugauauccucaaggu

SEQ ID NO: 2489 - RNA, 20 nt, Artificial Sequence
  Description of Artificial Sequence: Synthetic oligonucleotide
ucguugauauccucaagguc

SEQ ID NO: 2490 - RNA, 20 nt, Artificial Sequence
  Description of Artificial Sequence: Synthetic oligonucleotide
cguugauauccucaagguca

SEQ ID NO: 2491 - RNA, 20 nt, Artificial Sequence
  Description of Artificial Sequence: Synthetic oligonucleotide
guugauauccucaaggucac

SEQ ID NO: 2492 - RNA, 20 nt, Artificial Sequence
  Description of Artificial Sequence: Synthetic oligonucleotide
uugauauccucaaggucacc

SEQ ID NO: 2493 - RNA, 20 nt, Artificial Sequence
  Description of Artificial Sequence: Synthetic oligonucleotide
ugauauccucaaggucaccc

SEQ ID NO: 2494 - RNA, 20 nt, Artificial Sequence
  Description of Artificial Sequence: Synthetic oligonucleotide
gauauccucaaggucaccca

SEQ ID NO: 2495 - RNA, 20 nt, Artificial Sequence
  Description of Artificial Sequence: Synthetic oligonucleotide
auauccucaaggucacccac

SEQ ID NO: 2496 - RNA, 20 nt, Artificial Sequence
  Description of Artificial Sequence: Synthetic oligonucleotide
uauccucaaggucacccacc

SEQ ID NO: 2497 - RNA, 20 nt, Artificial Sequence
  Description of Artificial Sequence: Synthetic oligonucleotide
auccucaaggucacccacca

SEQ ID NO: 2498 - RNA, 20 nt, Artificial Sequence
  Description of Artificial Sequence: Synthetic oligonucleotide
uccucaaggucacccaccau

SEQ ID NO: 2499 - RNA, 20 nt, Artificial Sequence
  Description of Artificial Sequence: Synthetic oligonucleotide
ccucaaggucacccaccauc

SEQ ID NO: 2500 - RNA, 20 nt, Artificial Sequence
  Description of Artificial Sequence: Synthetic oligonucleotide
cucaaggucacccaccauca

SEQ ID NO: 2501 - RNA, 20 nt, Artificial Sequence
  Description of Artificial Sequence: Synthetic oligonucleotide
ucaaggucacccaccaucac

SEQ ID NO: 2502 - RNA, 20 nt, Artificial Sequence
  Description of Artificial Sequence: Synthetic oligonucleotide
caaggucacccaccaucacc

SEQ ID NO: 2503 - RNA, 20 nt, Artificial Sequence
  Description of Artificial Sequence: Synthetic oligonucleotide
aaggucacccaccaucaccc

SEQ ID NO: 2504 - RNA, 20 nt, Artificial Sequence
  Description of Artificial Sequence: Synthetic oligonucleotide
aggucacccaccaucacccu

SEQ ID NO: 2505 - RNA, 20 nt, Artificial Sequence
  Description of Artificial Sequence: Synthetic oligonucleotide
ggucacccaccaucacccuc

SEQ ID NO: 2506 - RNA, 20 nt, Artificial Sequence
  Description of Artificial Sequence: Synthetic oligonucleotide
gucacccaccaucacccucu

SEQ ID NO: 2507 - RNA, 20 nt, Artificial Sequence
  Description of Artificial Sequence: Synthetic oligonucleotide
ucacccaccaucacccucug

SEQ ID NO: 2508 - RNA, 20 nt, Artificial Sequence
  Description of Artificial Sequence: Synthetic oligonucleotide
cacccaccaucacccucugu

SEQ ID NO: 2509 - RNA, 20 nt, Artificial Sequence
  Description of Artificial Sequence: Synthetic oligonucleotide
acccaccaucacccucugug

SEQ ID NO: 2510 - RNA, 20 nt, Artificial Sequence
  Description of Artificial Sequence: Synthetic oligonucleotide
cccaccaucacccucuguga

SEQ ID NO: 2511 - RNA, 20 nt, Artificial Sequence
  Description of Artificial Sequence: Synthetic oligonucleotide
ccaccaucacccucugugau

SEQ ID NO: 2512 - RNA, 20 nt, Artificial Sequence
  Description of Artificial Sequence: Synthetic oligonucleotide
caccaucacccucugugauu

SEQ ID NO: 2513 - RNA, 20 nt, Artificial Sequence
  Description of Artificial Sequence: Synthetic oligonucleotide
accaucacccucugugauuu

SEQ ID NO: 2514 - RNA, 20 nt, Artificial Sequence
  Description of Artificial Sequence: Synthetic oligonucleotide
ccaucacccucugugauuuu

SEQ ID NO: 2515 - RNA, 20 nt, Artificial Sequence
  Description of Artificial Sequence: Synthetic oligonucleotide
caucacccucugugauuuua

SEQ ID NO: 2516 - RNA, 20 nt, Artificial Sequence
  Description of Artificial Sequence: Synthetic oligonucleotide
aucacccucugugauuuuau

SEQ ID NO: 2517 - RNA, 20 nt, Artificial Sequence
  Description of Artificial Sequence: Synthetic oligonucleotide
ucacccucugugauuuuaua

SEQ ID NO: 2518 - RNA, 20 nt, Artificial Sequence
  Description of Artificial Sequence: Synthetic oligonucleotide
cacccucugugauuuuauaa

SEQ ID NO: 2519 - RNA, 20 nt, Artificial Sequence
  Description of Artificial Sequence: Synthetic oligonucleotide
acccucugugauuuuauaac

SEQ ID NO: 2520 - RNA, 20 nt, Artificial Sequence
  Description of Artificial Sequence: Synthetic oligonucleotide
cccucugugauuuuauaacu

SEQ ID NO: 2521 - RNA, 20 nt, Artificial Sequence
  Description of Artificial Sequence: Synthetic oligonucleotide
ccucugugauuuuauaacuu

SEQ ID NO: 2522 - RNA, 20 nt, Artificial Sequence
  Description of Artificial Sequence: Synthetic oligonucleotide
cucugugauuuuauaacuug

SEQ ID NO: 2523 - RNA, 20 nt, Artificial Sequence
  Description of Artificial Sequence: Synthetic oligonucleotide
ucugugauuuuauaacuuga

SEQ ID NO: 2524 - RNA, 20 nt, Artificial Sequence
  Description of Artificial Sequence: Synthetic oligonucleotide
cugugauuuuauaacuugau

SEQ ID NO: 2525 - RNA, 20 nt, Artificial Sequence
  Description of Artificial Sequence: Synthetic oligonucleotide
ugugauuuuauaacuugauc

SEQ ID NO: 2526 - RNA, 20 nt, Artificial Sequence
  Description of Artificial Sequence: Synthetic oligonucleotide
gugauuuuauaacuugauca

SEQ ID NO: 2527 - RNA, 20 nt, Artificial Sequence
  Description of Artificial Sequence: Synthetic oligonucleotide
ugauuuuauaacuugaucaa

SEQ ID NO: 2528 - RNA, 20 nt, Artificial Sequence
  Description of Artificial Sequence: Synthetic oligonucleotide
gauuuuauaacuugaucaag

SEQ ID NO: 2529 - RNA, 20 nt, Artificial Sequence
  Description of Artificial Sequence: Synthetic oligonucleotide
auuuuauaacuugaucaagc

SEQ ID NO: 2530 - RNA, 20 nt, Artificial Sequence
  Description of Artificial Sequence: Synthetic oligonucleotide
uuuuauaacuugaucaagca

SEQ ID NO: 2531 - RNA, 20 nt, Artificial Sequence
  Description of Artificial Sequence: Synthetic oligonucleotide
uuuauaacuugaucaagcag

SEQ ID NO: 2532 - RNA, 20 nt, Artificial Sequence
  Description of Artificial Sequence: Synthetic oligonucleotide
uuauaacuugaucaagcaga

SEQ ID NO: 2533 - RNA, 20 nt, Artificial Sequence
  Description of Artificial Sequence: Synthetic oligonucleotide
uauaacuugaucaagcagag

SEQ ID NO: 2534 - RNA, 20 nt, Artificial Sequence
  Description of Artificial Sequence: Synthetic oligonucleotide
auaacuugaucaagcagaga

SEQ ID NO: 2535 - RNA, 20 nt, Artificial Sequence
  Description of Artificial Sequence: Synthetic oligonucleotide
uaacuugaucaagcagagaa

SEQ ID NO: 2536 - RNA, 20 nt, Artificial Sequence
  Description of Artificial Sequence: Synthetic oligonucleotide
aacuugaucaagcagagaaa

SEQ ID NO: 2537 - RNA, 20 nt, Artificial Sequence
  Description of Artificial Sequence: Synthetic oligonucleotide
acuugaucaagcagagaaag

SEQ ID NO: 2538 - RNA, 20 nt, Artificial Sequence
  Description of Artificial Sequence: Synthetic oligonucleotide
cuugaucaagcagagaaagc

SEQ ID NO: 2539 - RNA, 20 nt, Artificial Sequence
  Description of Artificial Sequence: Synthetic oligonucleotide
uugaucaagcagagaaagcc

SEQ ID NO: 2540 - RNA, 20 nt, Artificial Sequence
  Description of Artificial Sequence: Synthetic oligonucleotide
ugaucaagcagagaaagcca

SEQ ID NO: 2541 - RNA, 20 nt, Artificial Sequence
  Description of Artificial Sequence: Synthetic oligonucleotide
gaucaagcagagaaagccag

SEQ ID NO: 2542 - RNA, 20 nt, Artificial Sequence
  Description of Artificial Sequence: Synthetic oligonucleotide
aucaagcagagaaagccagu

SEQ ID NO: 2543 - RNA, 20 nt, Artificial Sequence
  Description of Artificial Sequence: Synthetic oligonucleotide
ucaagcagagaaagccaguc

SEQ ID NO: 2544 - RNA, 20 nt, Artificial Sequence
  Description of Artificial Sequence: Synthetic oligonucleotide
caagcagagaaagccagucg

SEQ ID NO: 2545 - RNA, 20 nt, Artificial Sequence
  Description of Artificial Sequence: Synthetic oligonucleotide
aagcagagaaagccagucgg

SEQ ID NO: 2546 - RNA, 20 nt, Artificial Sequence
  Description of Artificial Sequence: Synthetic oligonucleotide
agcagagaaagccagucggu

SEQ ID NO: 2547 - RNA, 20 nt, Artificial Sequence
  Description of Artificial Sequence: Synthetic oligonucleotide
gcagagaaagccagucggua

SEQ ID NO: 2548 - RNA, 20 nt, Artificial Sequence
  Description of Artificial Sequence: Synthetic oligonucleotide
cagagaaagccagucgguaa

SEQ ID NO: 2549 - RNA, 20 nt, Artificial Sequence
  Description of Artificial Sequence: Synthetic oligonucleotide
agagaaagccagucgguaag

SEQ ID NO: 2550 - RNA, 20 nt, Artificial Sequence
  Description of Artificial Sequence: Synthetic oligonucleotide
gagaaagccagucgguaagu

SEQ ID NO: 2551 - RNA, 20 nt, Artificial Sequence
  Description of Artificial Sequence: Synthetic oligonucleotide
agaaagccagucgguaaguu

SEQ ID NO: 2552 - RNA, 20 nt, Artificial Sequence
  Description of Artificial Sequence: Synthetic oligonucleotide
gaaagccagucgguaaguuc

SEQ ID NO: 2553 - RNA, 20 nt, Artificial Sequence
  Description of Artificial Sequence: Synthetic oligonucleotide
aaagccagucgguaaguucu

SEQ ID NO: 2554 - RNA, 20 nt, Artificial Sequence
  Description of Artificial Sequence: Synthetic oligonucleotide
aagccagucgguaaguucug

SEQ ID NO: 2555 - RNA, 20 nt, Artificial Sequence
  Description of Artificial Sequence: Synthetic oligonucleotide
agccagucgguaaguucugu

SEQ ID NO: 2556 - RNA, 20 nt, Artificial Sequence
  Description of Artificial Sequence: Synthetic oligonucleotide
gccagucgguaaguucuguc

SEQ ID NO: 2557 - RNA, 20 nt, Artificial Sequence
  Description of Artificial Sequence: Synthetic oligonucleotide
ccagucgguaaguucugucc

SEQ ID NO: 2558 - RNA, 20 nt, Artificial Sequence
  Description of Artificial Sequence: Synthetic oligonucleotide
cagucgguaaguucugucca

SEQ ID NO: 2559 - RNA, 20 nt, Artificial Sequence
  Description of Artificial Sequence: Synthetic oligonucleotide
agucgguaaguucuguccaa

SEQ ID NO: 2560 - RNA, 20 nt, Artificial Sequence
  Description of Artificial Sequence: Synthetic oligonucleotide
gucgguaaguucuguccaag

SEQ ID NO: 2561 - RNA, 20 nt, Artificial Sequence
  Description of Artificial Sequence: Synthetic oligonucleotide
ucgguaaguucuguccaagc

SEQ ID NO: 2562 - RNA, 20 nt, Artificial Sequence
  Description of Artificial Sequence: Synthetic oligonucleotide
cgguaaguucuguccaagcc

SEQ ID NO: 2563 - RNA, 20 nt, Artificial Sequence
  Description of Artificial Sequence: Synthetic oligonucleotide
gguaaguucuguccaagccc

SEQ ID NO: 2564 - RNA, 20 nt, Artificial Sequence
  Description of Artificial Sequence: Synthetic oligonucleotide
guaaguucuguccaagcccg

SEQ ID NO: 2565 - RNA, 20 nt, Artificial Sequence
  Description of Artificial Sequence: Synthetic oligonucleotide
uaaguucuguccaagcccgg

SEQ ID NO: 2566 - RNA, 20 nt, Artificial Sequence
  Description of Artificial Sequence: Synthetic oligonucleotide
aaguucuguccaagcccggu

SEQ ID NO: 2567 - RNA, 20 nt, Artificial Sequence
  Description of Artificial Sequence: Synthetic oligonucleotide
aguucuguccaagcccgguu

SEQ ID NO: 2568 - RNA, 20 nt, Artificial Sequence
  Description of Artificial Sequence: Synthetic oligonucleotide
guucuguccaagcccgguug

SEQ ID NO: 2569 - RNA, 20 nt, Artificial Sequence
  Description of Artificial Sequence: Synthetic oligonucleotide
uucuguccaagcccgguuga

SEQ ID NO: 2570 - RNA, 20 nt, Artificial Sequence
  Description of Artificial Sequence: Synthetic oligonucleotide
ucuguccaagcccgguugaa

SEQ ID NO: 2571 - RNA, 20 nt, Artificial Sequence
  Description of Artificial Sequence: Synthetic oligonucleotide
cuguccaagcccgguugaaa

SEQ ID NO: 2572 - RNA, 20 nt, Artificial Sequence
  Description of Artificial Sequence: Synthetic oligonucleotide
uguccaagcccgguugaaau

SEQ ID NO: 2573 - RNA, 20 nt, Artificial Sequence
  Description of Artificial Sequence: Synthetic oligonucleotide
guccaagcccgguugaaauc

SEQ ID NO: 2574 - RNA, 20 nt, Artificial Sequence
  Description of Artificial Sequence: Synthetic oligonucleotide
uccaagcccgguugaaaucu

SEQ ID NO: 2575 - RNA, 20 nt, Artificial Sequence
  Description of Artificial Sequence: Synthetic oligonucleotide
ccaagcccgguugaaaucug

SEQ ID NO: 2576 - RNA, 20 nt, Artificial Sequence
  Description of Artificial Sequence: Synthetic oligonucleotide
caagcccgguugaaaucugc

SEQ ID NO: 2577 - RNA, 20 nt, Artificial Sequence
  Description of Artificial Sequence: Synthetic oligonucleotide
aagcccgguugaaaucugcc

SEQ ID NO: 2578 - RNA, 20 nt, Artificial Sequence
  Description of Artificial Sequence: Synthetic oligonucleotide
agcccgguugaaaucugcca

SEQ ID NO: 2579 - RNA, 20 nt, Artificial Sequence
  Description of Artificial Sequence: Synthetic oligonucleotide
gcccgguugaaaucugccag

SEQ ID NO: 2580 - RNA, 20 nt, Artificial Sequence
  Description of Artificial Sequence: Synthetic oligonucleotide
cccgguugaaaucugccaga

SEQ ID NO: 2581 - RNA, 20 nt, Artificial Sequence
  Description of Artificial Sequence: Synthetic oligonucleotide
ccgguugaaaucugccagag

SEQ ID NO: 2582 - RNA, 20 nt, Artificial Sequence
  Description of Artificial Sequence: Synthetic oligonucleotide
cgguugaaaucugccagagc

SEQ ID NO: 2583 - RNA, 20 nt, Artificial Sequence
  Description of Artificial Sequence: Synthetic oligonucleotide
gguugaaaucugccagagca

SEQ ID NO: 2584 - RNA, 20 nt, Artificial Sequence
  Description of Artificial Sequence: Synthetic oligonucleotide
guugaaaucugccagagcag

SEQ ID NO: 2585 - RNA, 20 nt, Artificial Sequence
  Description of Artificial Sequence: Synthetic oligonucleotide
uugaaaucugccagagcagg

SEQ ID NO: 2586 - RNA, 20 nt, Artificial Sequence
  Description of Artificial Sequence: Synthetic oligonucleotide
ugaaaucugccagagcaggu

SEQ ID NO: 2587 - RNA, 20 nt, Artificial Sequence
  Description of Artificial Sequence: Synthetic oligonucleotide
gaaaucugccagagcaggua

SEQ ID NO: 2588 - RNA, 20 nt, Artificial Sequence
  Description of Artificial Sequence: Synthetic oligonucleotide
aaaucugccagagcagguac

SEQ ID NO: 2589 - RNA, 20 nt, Artificial Sequence
  Description of Artificial Sequence: Synthetic oligonucleotide
aaucugccagagcagguacc

SEQ ID NO: 2590 - RNA, 20 nt, Artificial Sequence
  Description of Artificial Sequence: Synthetic oligonucleotide
aucugccagagcagguaccu

SEQ ID NO: 2591 - RNA, 20 nt, Artificial Sequence
  Description of Artificial Sequence: Synthetic oligonucleotide
ucugccagagcagguaccuc

SEQ ID NO: 2592 - RNA, 20 nt, Artificial Sequence
  Description of Artificial Sequence: Synthetic oligonucleotide
cugccagagcagguaccucc

SEQ ID NO: 2593 - RNA, 20 nt, Artificial Sequence
  Description of Artificial Sequence: Synthetic oligonucleotide
ugccagagcagguaccucca

SEQ ID NO: 2594 - RNA, 20 nt, Artificial Sequence
  Description of Artificial Sequence: Synthetic oligonucleotide
gccagagcagguaccuccaa

SEQ ID NO: 2595 - RNA, 20 nt, Artificial Sequence
  Description of Artificial Sequence: Synthetic oligonucleotide
ccagagcagguaccuccaac

SEQ ID NO: 2596 - RNA, 20 nt, Artificial Sequence
  Description of Artificial Sequence: Synthetic oligonucleotide
cagagcagguaccuccaaca

SEQ ID NO: 2597 - RNA, 20 nt, Artificial Sequence
  Description of Artificial Sequence: Synthetic oligonucleotide
agagcagguaccuccaacau

SEQ ID NO: 2598 - RNA, 20 nt, Artificial Sequence
  Description of Artificial Sequence: Synthetic oligonucleotide
gagcagguaccuccaacauc

SEQ ID NO: 2599 - RNA, 20 nt, Artificial Sequence
  Description of Artificial Sequence: Synthetic oligonucleotide
agcagguaccuccaacauca

SEQ ID NO: 2600 - RNA, 20 nt, Artificial Sequence
  Description of Artificial Sequence: Synthetic oligonucleotide
gcagguaccuccaacaucaa

SEQ ID NO: 2601 - RNA, 20 nt, Artificial Sequence
  Description of Artificial Sequence: Synthetic oligonucleotide
cagguaccuccaacaucaag

SEQ ID NO: 2602 - RNA, 20 nt, Artificial Sequence
  Description of Artificial Sequence: Synthetic oligonucleotide
agguaccuccaacaucaagg

SEQ ID NO: 2603 - RNA, 20 nt, Artificial Sequence
  Description of Artificial Sequence: Synthetic oligonucleotide
gguaccuccaacaucaagga

SEQ ID NO: 2604 - RNA, 20 nt, Artificial Sequence
  Description of Artificial Sequence: Synthetic oligonucleotide
guaccuccaacaucaaggaa

SEQ ID NO: 2605 - RNA, 20 nt, Artificial Sequence
  Description of Artificial Sequence: Synthetic oligonucleotide
uaccuccaacaucaaggaag

SEQ ID NO: 2606 - RNA, 20 nt, Artificial Sequence
  Description of Artificial Sequence: Synthetic oligonucleotide
accuccaacaucaaggaaga

SEQ ID NO: 2607 - RNA, 20 nt, Artificial Sequence
  Description of Artificial Sequence: Synthetic oligonucleotide
ccuccaacaucaaggaagau

SEQ ID NO: 2608 - RNA, 20 nt, Artificial Sequence
  Description of Artificial Sequence: Synthetic oligonucleotide
cuccaacaucaaggaagaug

SEQ ID NO: 2609 - RNA, 20 nt, Artificial Sequence
  Description of Artificial Sequence: Synthetic oligonucleotide
uccaacaucaaggaagaugg

SEQ ID NO: 2610 - RNA, 20 nt, Artificial Sequence
  Description of Artificial Sequence: Synthetic oligonucleotide
ccaacaucaaggaagauggc

SEQ ID NO: 2611 - RNA, 20 nt, Artificial Sequence
  Description of Artificial Sequence: Synthetic oligonucleotide
caacaucaaggaagauggca

SEQ ID NO: 2612 - RNA, 20 nt, Artificial Sequence
  Description of Artificial Sequence: Synthetic oligonucleotide
aacaucaaggaagauggcau

SEQ ID NO: 2613 - RNA, 20 nt, Artificial Sequence
  Description of Artificial Sequence: Synthetic oligonucleotide
acaucaaggaagauggcauu

SEQ ID NO: 2614 - RNA, 20 nt, Artificial Sequence
  Description of Artificial Sequence: Synthetic oligonucleotide
caucaaggaagauggcauuu

SEQ ID NO: 2615 - RNA, 20 nt, Artificial Sequence
  Description of Artificial Sequence: Synthetic oligonucleotide
aucaaggaagauggcauuuc

SEQ ID NO: 2616 - RNA, 20 nt, Artificial Sequence
  Description of Artificial Sequence: Synthetic oligonucleotide
ucaaggaagauggcauuucu

SEQ ID NO: 2617 - RNA, 20 nt, Artificial Sequence
  Description of Artificial Sequence: Synthetic oligonucleotide
caaggaagauggcauuucua

SEQ ID NO: 2618 - RNA, 20 nt, Artificial Sequence
  Description of Artificial Sequence: Synthetic oligonucleotide
aaggaagauggcauuucuag

SEQ ID NO: 2619 - RNA, 20 nt, Artificial Sequence
  Description of Artificial Sequence: Synthetic oligonucleotide
aggaagauggcauuucuagu

SEQ ID NO: 2620 - RNA, 20 nt, Artificial Sequence
  Description of Artificial Sequence: Synthetic oligonucleotide
ggaagauggcauuucuaguu

SEQ ID NO: 2621 - RNA, 20 nt, Artificial Sequence
  Description of Artificial Sequence: Synthetic oligonucleotide
gaagauggcauuucuaguuu

SEQ ID NO: 2622 - RNA, 20 nt, Artificial Sequence
  Description of Artificial Sequence: Synthetic oligonucleotide
aagauggcauuucuaguuug

SEQ ID NO: 2623 - RNA, 20 nt, Artificial Sequence
  Description of Artificial Sequence: Synthetic oligonucleotide
agauggcauuucuaguuugg

SEQ ID NO: 2624 - RNA, 20 nt, Artificial Sequence
  Description of Artificial Sequence: Synthetic oligonucleotide
gauggcauuucuaguuugga

SEQ ID NO: 2625 - RNA, 20 nt, Artificial Sequence
  Description of Artificial Sequence: Synthetic oligonucleotide
auggcauuucuaguuuggag

SEQ ID NO: 2626 - RNA, 20 nt, Artificial Sequence
  Description of Artificial Sequence: Synthetic oligonucleotide
uggcauuucuaguuuggaga

SEQ ID NO: 2627 - RNA, 20 nt, Artificial Sequence
  Description of Artificial Sequence: Synthetic oligonucleotide
ggcauuucuaguuuggagau

SEQ ID NO: 2628 - RNA, 20 nt, Artificial Sequence
  Description of Artificial Sequence: Synthetic oligonucleotide
gcauuucuaguuuggagaug

SEQ ID NO: 2629 - RNA, 20 nt, Artificial Sequence
  Description of Artificial Sequence: Synthetic oligonucleotide
cauuucuaguuuggagaugg

SEQ ID NO: 2630 - RNA, 20 nt, Artificial Sequence
  Description of Artificial Sequence: Synthetic oligonucleotide
auuucuaguuuggagauggc

SEQ ID NO: 2631 - RNA, 20 nt, Artificial Sequence
  Description of Artificial Sequence: Synthetic oligonucleotide
uuucuaguuuggagauggca

SEQ ID NO: 2632 - RNA, 20 nt, Artificial Sequence
  Description of Artificial Sequence: Synthetic oligonucleotide
uucuaguuuggagauggcag

SEQ ID NO: 2633 - RNA, 20 nt, Artificial Sequence
  Description of Artificial Sequence: Synthetic oligonucleotide
ucuaguuuggagauggcagu

SEQ ID NO: 2634 - RNA, 20 nt, Artificial Sequence
  Description of Artificial Sequence: Synthetic oligonucleotide
cuaguuuggagauggcaguu

SEQ ID NO: 2635 - RNA, 20 nt, Artificial Sequence
  Description of Artificial Sequence: Synthetic oligonucleotide
uaguuuggagauggcaguuu

SEQ ID NO: 2636 - RNA, 20 nt, Artificial Sequence
  Description of Artificial Sequence: Synthetic oligonucleotide
aguuuggagauggcaguuuc

SEQ ID NO: 2637 - RNA, 20 nt, Artificial Sequence
  Description of Artificial Sequence: Synthetic oligonucleotide
guuuggagauggcaguuucc

SEQ ID NO: 2638 - RNA, 20 nt, Artificial Sequence
  Description of Artificial Sequence: Synthetic oligonucleotide
uuuggagauggcaguuuccu

SEQ ID NO: 2639 - RNA, 20 nt, Artificial Sequence
  Description of Artificial Sequence: Synthetic oligonucleotide
uuggagauggcaguuuccuu

SEQ ID NO: 2640 - RNA, 20 nt, Artificial Sequence
  Description of Artificial Sequence: Synthetic oligonucleotide
uggagauggcaguuuccuua

SEQ ID NO: 2641 - RNA, 20 nt, Artificial Sequence
  Description of Artificial Sequence: Synthetic oligonucleotide
ggagauggcaguuuccuuag

SEQ ID NO: 2642 - RNA, 20 nt, Artificial Sequence
  Description of Artificial Sequence: Synthetic oligonucleotide
gagauggcaguuuccuuagu

SEQ ID NO: 2643 - RNA, 20 nt, Artificial Sequence
  Description of Artificial Sequence: Synthetic oligonucleotide
agauggcaguuuccuuagua

SEQ ID NO: 2644 - RNA, 20 nt, Artificial Sequence
  Description of Artificial Sequence: Synthetic oligonucleotide
gauggcaguuuccuuaguaa

SEQ ID NO: 2645 - RNA, 20 nt, Artificial Sequence
  Description of Artificial Sequence: Synthetic oligonucleotide
auggcaguuuccuuaguaac

SEQ ID NO: 2646 - RNA, 20 nt, Artificial Sequence
  Description of Artificial Sequence: Synthetic oligonucleotide
uggcaguuuccuuaguaacc

SEQ ID NO: 2647 - RNA, 20 nt, Artificial Sequence
  Description of Artificial Sequence: Synthetic oligonucleotide
ggcaguuuccuuaguaacca

SEQ ID NO: 2648 - RNA, 20 nt, Artificial Sequence
  Description of Artificial Sequence: Synthetic oligonucleotide
gcaguuuccuuaguaaccac

SEQ ID NO: 2649 - RNA, 20 nt, Artificial Sequence
  Description of Artificial Sequence: Synthetic oligonucleotide
caguuuccuuaguaaccaca

SEQ ID NO: 2650 - RNA, 20 nt, Artificial Sequence
  Description of Artificial Sequence: Synthetic oligonucleotide
aguuuccuuaguaaccacag

SEQ ID NO: 2651 - RNA, 20 nt, Artificial Sequence
  Description of Artificial Sequence: Synthetic oligonucleotide
guuuccuuaguaaccacagg

SEQ ID NO: 2652 - RNA, 20 nt, Artificial Sequence
  Description of Artificial Sequence: Synthetic oligonucleotide
uuuccuuaguaaccacaggu

SEQ ID NO: 2653 - RNA, 20 nt, Artificial Sequence
  Description of Artificial Sequence: Synthetic oligonucleotide
uuccuuaguaaccacagguu

SEQ ID NO: 2654 - RNA, 20 nt, Artificial Sequence
  Description of Artificial Sequence: Synthetic oligonucleotide
uccuuaguaaccacagguug

SEQ ID NO: 2655 - RNA, 20 nt, Artificial Sequence
  Description of Artificial Sequence: Synthetic oligonucleotide
ccuuaguaaccacagguugu

SEQ ID NO: 2656 - RNA, 20 nt, Artificial Sequence
  Description of Artificial Sequence: Synthetic oligonucleotide
cuuaguaaccacagguugug

SEQ ID NO: 2657 - RNA, 20 nt, Artificial Sequence
  Description of Artificial Sequence: Synthetic oligonucleotide
uuaguaaccacagguugugu

SEQ ID NO: 2658 - RNA, 20 nt, Artificial Sequence
  Description of Artificial Sequence: Synthetic oligonucleotide
uaguaaccacagguuguguc

SEQ ID NO: 2659 - RNA, 20 nt, Artificial Sequence
  Description of Artificial Sequence: Synthetic oligonucleotide
aguaaccacagguuguguca

SEQ ID NO: 2660 - RNA, 20 nt, Artificial Sequence
  Description of Artificial Sequence: Synthetic oligonucleotide
guaaccacagguugugucac

SEQ ID NO: 2661 - RNA, 20 nt, Artificial Sequence
  Description of Artificial Sequence: Synthetic oligonucleotide
uaaccacagguugugucacc

SEQ ID NO: 2662 - RNA, 20 nt, Artificial Sequence
  Description of Artificial Sequence: Synthetic oligonucleotide
aaccacagguugugucacca

SEQ ID NO: 2663 - RNA, 20 nt, Artificial Sequence
  Description of Artificial Sequence: Synthetic oligonucleotide
accacagguugugucaccag

SEQ ID NO: 2664 - RNA, 20 nt, Artificial Sequence
  Description of Artificial Sequence: Synthetic oligonucleotide
ccacagguugugucaccaga

SEQ ID NO: 2665 - RNA, 20 nt, Artificial Sequence
  Description of Artificial Sequence: Synthetic oligonucleotide
cacagguugugucaccagag

SEQ ID NO: 2666 - RNA, 20 nt, Artificial Sequence
  Description of Artificial Sequence: Synthetic oligonucleotide
acagguugugucaccagagu

SEQ ID NO: 2667 - RNA, 20 nt, Artificial Sequence
  Description of Artificial Sequence: Synthetic oligonucleotide
cagguugugucaccagagua

SEQ ID NO: 2668 - RNA, 20 nt, Artificial Sequence
  Description of Artificial Sequence: Synthetic oligonucleotide
agguugugucaccagaguaa

SEQ ID NO: 2669 - RNA, 20 nt, Artificial Sequence
  Description of Artificial Sequence: Synthetic oligonucleotide
gguugugucaccagaguaac

SEQ ID NO: 2670 - RNA, 20 nt, Artificial Sequence
  Description of Artificial Sequence: Synthetic oligonucleotide
guugugucaccagaguaaca

SEQ ID NO: 2671 - RNA, 20 nt, Artificial Sequence
  Description of Artificial Sequence: Synthetic oligonucleotide
uugugucaccagaguaacag

SEQ ID NO: 2672 - RNA, 20 nt, Artificial Sequence
  Description of Artificial Sequence: Synthetic oligonucleotide
ugugucaccagaguaacagu

SEQ ID NO: 2673 - RNA, 20 nt, Artificial Sequence
  Description of Artificial Sequence: Synthetic oligonucleotide
gugucaccagaguaacaguc

SEQ ID NO: 2674 - RNA, 20 nt, Artificial Sequence
  Description of Artificial Sequence: Synthetic oligonucleotide
ugucaccagaguaacagucu

SEQ ID NO: 2675 - RNA, 20 nt, Artificial Sequence
  Description of Artificial Sequence: Synthetic oligonucleotide
gucaccagaguaacagucug

SEQ ID NO: 2676 - RNA, 20 nt, Artificial Sequence
  Description of Artificial Sequence: Synthetic oligonucleotide
ucaccagaguaacagucuga

SEQ ID NO: 2677 - RNA, 20 nt, Artificial Sequence
  Description of Artificial Sequence: Synthetic oligonucleotide
caccagaguaacagucugag

SEQ ID NO: 2678 - RNA, 20 nt, Artificial Sequence
  Description of Artificial Sequence: Synthetic oligonucleotide
accagaguaacagucugagu

SEQ ID NO: 2679 - RNA, 20 nt, Artificial Sequence
  Description of Artificial Sequence: Synthetic oligonucleotide
ccagaguaacagucugagua

SEQ ID NO: 2680 - RNA, 20 nt, Artificial Sequence
  Description of Artificial Sequence: Synthetic oligonucleotide
cagaguaacagucugaguag

SEQ ID NO: 2681 - RNA, 20 nt, Artificial Sequence
  Description of Artificial Sequence: Synthetic oligonucleotide
agaguaacagucugaguagg

SEQ ID NO: 2682 - RNA, 20 nt, Artificial Sequence
  Description of Artificial Sequence: Synthetic oligonucleotide
gaguaacagucugaguagga

SEQ ID NO: 2683 - RNA, 20 nt, Artificial Sequence
  Description of Artificial Sequence: Synthetic oligonucleotide
aguaacagucugaguaggag

SEQ ID NO: 2684 - RNA, 20 nt, Artificial Sequence
  Description of Artificial Sequence: Synthetic oligonucleotide
guaacagucugaguaggagc

SEQ ID NO: 2685 - RNA, 20 nt, Artificial Sequence
  Description of Artificial Sequence: Synthetic oligonucleotide
uaacagucugaguaggagcu

SEQ ID NO: 2686 - RNA, 20 nt, Artificial Sequence
  Description of Artificial Sequence: Synthetic oligonucleotide
aacagucugaguaggagcua

SEQ ID NO: 2687 - RNA, 20 nt, Artificial Sequence
  Description of Artificial Sequence: Synthetic oligonucleotide
acagucugaguaggagcuaa

SEQ ID NO: 2688 - RNA, 20 nt, Artificial Sequence
  Description of Artificial Sequence: Synthetic oligonucleotide
cagucugaguaggagcuaaa

SEQ ID NO: 2689 - RNA, 20 nt, Artificial Sequence
  Description of Artificial Sequence: Synthetic oligonucleotide
agucugaguaggagcuaaaa

SEQ ID NO: 2690 - RNA, 20 nt, Artificial Sequence
  Description of Artificial Sequence: Synthetic oligonucleotide
gucugaguaggagcuaaaau

SEQ ID NO: 2691 - RNA, 20 nt, Artificial Sequence
  Description of Artificial Sequence: Synthetic oligonucleotide
ucugaguaggagcuaaaaua

SEQ ID NO: 2692 - RNA, 20 nt, Artificial Sequence
  Description of Artificial Sequence: Synthetic oligonucleotide
cugaguaggagcuaaaauau

SEQ ID NO: 2693 - RNA, 20 nt, Artificial Sequence
  Description of Artificial Sequence: Synthetic oligonucleotide
ugaguaggagcuaaaauauu

SEQ ID NO: 2694 - RNA, 20 nt, Artificial Sequence
  Description of Artificial Sequence: Synthetic oligonucleotide
gaguaggagcuaaaauauuu

SEQ ID NO: 2695 - RNA, 20 nt, Artificial Sequence
  Description of Artificial Sequence: Synthetic oligonucleotide
aguaggagcuaaaauauuuu

SEQ ID NO: 2696 - RNA, 20 nt, Artificial Sequence
  Description of Artificial Sequence: Synthetic oligonucleotide
guaggagcuaaaauauuuug

SEQ ID NO: 2697 - RNA, 20 nt, Artificial Sequence
  Description of Artificial Sequence: Synthetic oligonucleotide
uaggagcuaaaauauuuugg

SEQ ID NO: 2698 - RNA, 20 nt, Artificial Sequence
  Description of Artificial Sequence: Synthetic oligonucleotide
aggagcuaaaauauuuuggg

SEQ ID NO: 2699 - RNA, 20 nt, Artificial Sequence
  Description of Artificial Sequence: Synthetic oligonucleotide
ggagcuaaaauauuuugggu

SEQ ID NO: 2700 - RNA, 20 nt, Artificial Sequence
  Description of Artificial Sequence: Synthetic oligonucleotide
gagcuaaaauauuuuggguu

SEQ ID NO: 2701 - RNA, 20 nt, Artificial Sequence
  Description of Artificial Sequence: Synthetic oligonucleotide
agcuaaaauauuuuggguuu

SEQ ID NO: 2702 - RNA, 20 nt, Artificial Sequence
  Description of Artificial Sequence: Synthetic oligonucleotide
gcuaaaauauuuuggguuuu

SEQ ID NO: 2703 - RNA, 20 nt, Artificial Sequence
  Description of Artificial Sequence: Synthetic oligonucleotide
cuaaaauauuuuggguuuuu

SEQ ID NO: 2704 - RNA, 20 nt, Artificial Sequence
  Description of Artificial Sequence: Synthetic oligonucleotide
uaaaauauuuuggguuuuug

SEQ ID NO: 2705 - RNA, 20 nt, Artificial Sequence
  Description of Artificial Sequence: Synthetic oligonucleotide
aaaauauuuuggguuuuugc

SEQ ID NO: 2706 - RNA, 20 nt, Artificial Sequence
  Description of Artificial Sequence: Synthetic oligonucleotide
aaauauuuuggguuuuugca

SEQ ID NO: 2707 - RNA, 20 nt, Artificial Sequence
  Description of Artificial Sequence: Synthetic oligonucleotide
aauauuuuggguuuuugcaa

SEQ ID NO: 2708 - RNA, 20 nt, Artificial Sequence
  Description of Artificial Sequence: Synthetic oligonucleotide
auauuuuggguuuuugcaaa

SEQ ID NO: 2709 - RNA, 20 nt, Artificial Sequence
  Description of Artificial Sequence: Synthetic oligonucleotide
uauuuuggguuuuugcaaaa

SEQ ID NO: 2710 - RNA, 20 nt, Artificial Sequence
  Description of Artificial Sequence: Synthetic oligonucleotide
auuuuggguuuuugcaaaaa

SEQ ID NO: 2711 - RNA, 20 nt, Artificial Sequence
  Description of Artificial Sequence: Synthetic oligonucleotide
uuuuggguuuuugcaaaaag

SEQ ID NO: 2712 - RNA, 20 nt, Artificial Sequence
  Description of Artificial Sequence: Synthetic oligonucleotide
uuuggguuuuugcaaaaagg

SEQ ID NO: 2713 - RNA, 20 nt, Artificial Sequence
  Description of Artificial Sequence: Synthetic oligonucleotide
uucgaaaaaacaaaucaaag

SEQ ID NO: 2714 - RNA, 20 nt, Artificial Sequence
  Description of Artificial Sequence: Synthetic oligonucleotide
ucgaaaaaacaaaucaaaga

SEQ ID NO: 2715 - RNA, 20 nt, Artificial Sequence
  Description of Artificial Sequence: Synthetic oligonucleotide
cgaaaaaacaaaucaaagac

SEQ ID NO: 2716 - RNA, 20 nt, Artificial Sequence
  Description of Artificial Sequence: Synthetic oligonucleotide
gaaaaaacaaaucaaagacu

SEQ ID NO: 2717 - RNA, 20 nt, Artificial Sequence
  Description of Artificial Sequence: Synthetic oligonucleotide
aaaaaacaaaucaaagacuu

SEQ ID NO: 2718 - RNA, 20 nt, Artificial Sequence
  Description of Artificial Sequence: Synthetic oligonucleotide
aaaaacaaaucaaagacuua

SEQ ID NO: 2719 - RNA, 20 nt, Artificial Sequence
  Description of Artificial Sequence: Synthetic oligonucleotide
aaaacaaaucaaagacuuac

SEQ ID NO: 2720 - RNA, 20 nt, Artificial Sequence
  Description of Artificial Sequence: Synthetic oligonucleotide
aaacaaaucaaagacuuacc

SEQ ID NO: 2721 - RNA, 20 nt, Artificial Sequence
  Description of Artificial Sequence: Synthetic oligonucleotide
aacaaaucaaagacuuaccu

SEQ ID NO: 2722 - RNA, 20 nt, Artificial Sequence
  Description of Artificial Sequence: Synthetic oligonucleotide
acaaaucaaagacuuaccuu

SEQ ID NO: 2723 - RNA, 20 nt, Artificial Sequence
  Description of Artificial Sequence: Synthetic oligonucleotide
caaaucaaagacuuaccuua

SEQ ID NO: 2724 - RNA, 20 nt, Artificial Sequence
  Description of Artificial Sequence: Synthetic oligonucleotide
aaaucaaagacuuaccuuaa

SEQ ID NO: 2725 - RNA, 20 nt, Artificial Sequence
  Description of Artificial Sequence: Synthetic oligonucleotide
aaucaaagacuuaccuuaag

SEQ ID NO: 2726 - RNA, 20 nt, Artificial Sequence
  Description of Artificial Sequence: Synthetic oligonucleotide
aucaaagacuuaccuuaaga

SEQ ID NO: 2727 - RNA, 20 nt, Artificial Sequence
  Description of Artificial Sequence: Synthetic oligonucleotide
ucaaagacuuaccuuaagau

SEQ ID NO: 2728 - RNA, 20 nt, Artificial Sequence
  Description of Artificial Sequence: Synthetic oligonucleotide
caaagacuuaccuuaagaua

SEQ ID NO: 2729 - RNA, 20 nt, Artificial Sequence
  Description of Artificial Sequence: Synthetic oligonucleotide
aaagacuuaccuuaagauac

SEQ ID NO: 2730 - RNA, 20 nt, Artificial Sequence
  Description of Artificial Sequence: Synthetic oligonucleotide
aagacuuaccuuaagauacc

SEQ ID NO: 2731 - RNA, 20 nt, Artificial Sequence
  Description of Artificial Sequence: Synthetic oligonucleotide
agacuuaccuuaagauacca

SEQ ID NO: 2732 - RNA, 20 nt, Artificial Sequence
  Description of Artificial Sequence: Synthetic oligonucleotide
gacuuaccuuaagauaccau

SEQ ID NO: 2733 - RNA, 20 nt, Artificial Sequence
  Description of Artificial Sequence: Synthetic oligonucleotide
acuuaccuuaagauaccauu

SEQ ID NO: 2734 - RNA, 20 nt, Artificial Sequence
  Description of Artificial Sequence: Synthetic oligonucleotide
cuuaccuuaagauaccauuu

SEQ ID NO: 2735 - RNA, 20 nt, Artificial Sequence
  Description of Artificial Sequence: Synthetic oligonucleotide
uuaccuuaagauaccauuug

SEQ ID NO: 2736 - RNA, 20 nt, Artificial Sequence
  Description of Artificial Sequence: Synthetic oligonucleotide
uaccuuaagauaccauuugu

SEQ ID NO: 2737 - RNA, 20 nt, Artificial Sequence
  Description of Artificial Sequence: Synthetic oligonucleotide
aggcaaaacaaaaaugaagc

SEQ ID NO: 2738 - RNA, 20 nt, Artificial Sequence
  Description of Artificial Sequence: Synthetic oligonucleotide
gcaaaacaaaaaugaagccc

SEQ ID NO: 2739 - RNA, 20 nt, Artificial Sequence
  Description of Artificial Sequence: Synthetic oligonucleotide
aaaacaaaaaugaagcccca

SEQ ID NO: 2740 - RNA, 20 nt, Artificial Sequence
  Description of Artificial Sequence: Synthetic oligonucleotide
aacaaaaaugaagccccaug

SEQ ID NO: 2741 - RNA, 20 nt, Artificial Sequence
  Description of Artificial Sequence: Synthetic oligonucleotide
caaaaaugaagccccauguc

SEQ ID NO: 2742 - RNA, 20 nt, Artificial Sequence
  Description of Artificial Sequence: Synthetic oligonucleotide
aaaaugaagccccaugucuu

SEQ ID NO: 2743 - RNA, 20 nt, Artificial Sequence
  Description of Artificial Sequence: Synthetic oligonucleotide
aaugaagccccaugucuuuu

SEQ ID NO: 2744 - RNA, 20 nt, Artificial Sequence
  Description of Artificial Sequence: Synthetic oligonucleotide
augaagccccaugucuuuuu

SEQ ID NO: 2745 - RNA, 20 nt, Artificial Sequence
  Description of Artificial Sequence: Synthetic oligonucleotide
gaagccccaugucuuuuuau

SEQ ID NO: 2746 - RNA, 20 nt, Artificial Sequence
  Description of Artificial Sequence: Synthetic oligonucleotide
agccccaugucuuuuuauuu

SEQ ID NO: 2747 - RNA, 20 nt, Artificial Sequence
  Description of Artificial Sequence: Synthetic oligonucleotide
ccccaugucuuuuuauuuga

SEQ ID NO: 2748 - RNA, 20 nt, Artificial Sequence
  Description of Artificial Sequence: Synthetic oligonucleotide
ugaagccccaugucuuuuua

SEQ ID NO: 2749 - RNA, 20 nt, Artificial Sequence
  Description of Artificial Sequence: Synthetic oligonucleotide
aagccccaugucuuuuuauu

SEQ ID NO: 2750 - RNA, 20 nt, Artificial Sequence
  Description of Artificial Sequence: Synthetic oligonucleotide
gccccaugucuuuuuauuug

SEQ ID NO: 2751 - RNA, 20 nt, Artificial Sequence
  Description of Artificial Sequence: Synthetic oligonucleotide
cugcauauucaaaggacacc

SEQ ID NO: 2752 - RNA, 20 nt, Artificial Sequence
  Description of Artificial Sequence: Synthetic oligonucleotide
cugcauuguuuuggccucug

SEQ ID NO: 2753 - RNA, 20 nt, Artificial Sequence
  Description of Artificial Sequence: Synthetic oligonucleotide
auaaagccgaaauacacacu

SEQ ID NO: 2754 - RNA, 20 nt, Artificial Sequence
  Description of Artificial Sequence: Synthetic oligonucleotide
gcuguuacgaugcuucccuc

SEQ ID NO: 2755 - RNA, 20 nt, Artificial Sequence
  Description of Artificial Sequence: Synthetic oligonucleotide
cuucccucugucacagauuc

SEQ ID NO: 2756 - RNA, 20 nt, Artificial Sequence
  Description of Artificial Sequence: Synthetic oligonucleotide
cagauaaaccagcuccgucc

SEQ ID NO: 2757 - RNA, 20 nt, Artificial Sequence
  Description of Artificial Sequence: Synthetic oligonucleotide
cuccguccaggcaaacucuc

SEQ ID NO: 2758 - RNA, 20 nt, Artificial Sequence
  Description of Artificial Sequence: Synthetic oligonucleotide
ggcaaacucucucauccuga

SEQ ID NO: 2759 - RNA, 20 nt, Artificial Sequence
  Description of Artificial Sequence: Synthetic oligonucleotide
cucucucauccugacacaaa

SEQ ID NO: 2760 - RNA, 20 nt, Artificial Sequence
  Description of Artificial Sequence: Synthetic oligonucleotide
caaacucucucauccugaca

SEQ ID NO: 2761 - RNA, 20 nt, Artificial Sequence
  Description of Artificial Sequence: Synthetic oligonucleotide
gcucuaauauuaucauuaug

SEQ ID NO: 2762 - RNA, 20 nt, Artificial Sequence
  Description of Artificial Sequence: Synthetic oligonucleotide
auagcaccgugcucuaauau

SEQ ID NO: 2763 - RNA, 20 nt, Artificial Sequence
  Description of Artificial Sequence: Synthetic oligonucleotide
ccgugcucuaauauuaucau

SEQ ID NO: 2764 - RNA, 20 nt, Artificial Sequence
  Description of Artificial Sequence: Synthetic oligonucleotide
uaugauaauuuucuuucuag

SEQ ID NO: 2765 - RNA, 20 nt, Artificial Sequence
  Description of Artificial Sequence: Synthetic oligonucleotide
cuuucuaguaauauaaugau

SEQ ID NO: 2766 - RNA, 20 nt, Artificial Sequence
  Description of Artificial Sequence: Synthetic oligonucleotide
uaauuuucuuucuaguaaua

SEQ ID NO: 2767 - RNA, 20 nt, Artificial Sequence
  Description of Artificial Sequence: Synthetic oligonucleotide
acaacaacagucaaaaguaa

SEQ ID NO: 2768 - RNA, 20 nt, Artificial Sequence
  Description of Artificial Sequence: Synthetic oligonucleotide
aauauaaugaugacaacaac

SEQ ID NO: 2769 - RNA, 20 nt, Artificial Sequence
  Description of Artificial Sequence: Synthetic oligonucleotide
ugaugacaacaacagucaaa

SEQ ID NO: 2770 - RNA, 20 nt, Artificial Sequence
  Description of Artificial Sequence: Synthetic oligonucleotide
uaauuuccaucacccuucag

SEQ ID NO: 2771 - RNA, 20 nt, Artificial Sequence
  Description of Artificial Sequence: Synthetic oligonucleotide
cacccuucagaaccugaucu

SEQ ID NO: 2772 - RNA, 20 nt, Artificial Sequence
  Description of Artificial Sequence: Synthetic oligonucleotide
uccaucacccuucagaaccu

SEQ ID NO: 2773 - RNA, 20 nt, Artificial Sequence
  Description of Artificial Sequence: Synthetic oligonucleotide
accugaucuuuaagaaguua

SEQ ID NO: 2774 - RNA, 19 nt, Artificial Sequence
  Description of Artificial Sequence: Synthetic oligonucleotide
cacccuucagaaccugauc

SEQ ID NO: 2775 - RNA, 20 nt, Artificial Sequence
  Description of Artificial Sequence: Synthetic oligonucleotide
cagaaccugaucuuuaagaa

SEQ ID NO: 2776 - RNA, 19 nt, Artificial Sequence
  Description of Artificial Sequence: Synthetic oligonucleotide
agaguccagaugugcugaa

SEQ ID NO: 2777 - RNA, 20 nt, Artificial Sequence
  Description of Artificial Sequence: Synthetic oligonucleotide
cugaagauaaauacaauuuc

SEQ ID NO: 2778 - RNA, 20 nt, Artificial Sequence
  Description of Artificial Sequence: Synthetic oligonucleotide
ugugcugaagauaaauacaa

SEQ ID NO: 2779 - RNA, 19 nt, Artificial Sequence
  Description of Artificial Sequence: Synthetic oligonucleotide
acaauuucgaaaaaacaaa

SEQ ID NO: 2780 - RNA, 19 nt, Artificial Sequence
  Description of Artificial Sequence: Synthetic oligonucleotide
cugaagauaaauacaauuu

SEQ ID NO: 2781 - RNA, 19 nt, Artificial Sequence
  Description of Artificial Sequence: Synthetic oligonucleotide
uaaauacaauuucgaaaaa

SEQ ID NO: 2782 - RNA, 20 nt, Artificial Sequence
  Description of Artificial Sequence: Synthetic oligonucleotide
acuuaccuuaagauaccauu

SEQ ID NO: 2783 - RNA, 20 nt, Artificial Sequence
  Description of Artificial Sequence: Synthetic oligonucleotide
aaucaaagacuuaccuuaag

SEQ ID NO: 2784 - RNA, 20 nt, Artificial Sequence
  Description of Artificial Sequence: Synthetic oligonucleotide
aagacuuaccuuaagauacc

SEQ ID NO: 2785 - RNA, 20 nt, Artificial Sequence
  Description of Artificial Sequence: Synthetic oligonucleotide
auucucaggaauuugugucu

SEQ ID NO: 2786 - RNA, 19 nt, Artificial Sequence
  Description of Artificial Sequence: Synthetic oligonucleotide
cauguucccaauucucagg

SEQ ID NO: 2787 - RNA, 19 nt, Artificial Sequence
  Description of Artificial Sequence: Synthetic oligonucleotide
cccaauucucaggaauuug

SEQ ID NO: 2788 - RNA, 20 nt, Artificial Sequence
  Description of Artificial Sequence: Synthetic oligonucleotide
cuuucugagaaacuguucag

SEQ ID NO: 2789 - RNA, 20 nt, Artificial Sequence
  Description of Artificial Sequence: Synthetic oligonucleotide
aggaauuugugucuuucuga

SEQ ID NO: 2790 - RNA, 20 nt, Artificial Sequence
  Description of Artificial Sequence: Synthetic oligonucleotide
ugugucuuucugagaaacug

SEQ ID NO: 2791 - RNA, 20 nt, Artificial Sequence
  Description of Artificial Sequence: Synthetic oligonucleotide
cuuuauaucauaaugaaaac

SEQ ID NO: 2792 - RNA, 20 nt, Artificial Sequence
  Description of Artificial Sequence: Synthetic oligonucleotide
cacugauuaaauaucuuuau

SEQ ID NO: 2793 - RNA, 20 nt, Artificial Sequence
  Description of Artificial Sequence: Synthetic oligonucleotide
ucaaggaagauggcauuucu

SEQ ID NO: 2794 - RNA, 20 nt, Artificial Sequence
  Description of Artificial Sequence: Synthetic oligonucleotide
ucaaggaagauggcauuucu

SEQ ID NO: 2795 - RNA, 20 nt, Artificial Sequence
  Description of Artificial Sequence: Synthetic oligonucleotide
ucacucagauaguugaagcc

SEQ ID NO: 2796 - RNA, 20 nt, Artificial Sequence
  Description of Artificial Sequence: Synthetic oligonucleotide
ucacucagauaguugaagcc

SEQ ID NO: 2797 - RNA, 20 nt, Artificial Sequence
  Description of Artificial Sequence: Synthetic oligonucleotide
ucacucagauaguugaagcc

SEQ ID NO: 2798 - RNA, 20 nt, Artificial Sequence
  Description of Artificial Sequence: Synthetic oligonucleotide
ucacucagauaguugaagcc

SEQ ID NO: 2799 - RNA, 20 nt, Artificial Sequence
  Description of Artificial Sequence: Synthetic oligonucleotide
ucacucagauaguugaagcc

SEQ ID NO: 2800 - RNA, 17 nt, Artificial Sequence
  Description of Artificial Sequence: Synthetic oligonucleotide
cgguucugaagguguuc

SEQ ID NO: 2801 - RNA, 20 nt, Artificial Sequence
  Description of Artificial Sequence: Synthetic oligonucleotide
ucaaggaagauggcauuucg

SEQ ID NO: 2802 - RNA, 20 nt, Artificial Sequence
  Description of Artificial Sequence: Synthetic oligonucleotide
ucaaggaagauggcaccccg

SEQ ID NO: 2803 - RNA, 20 nt, Artificial Sequence
  Description of Artificial Sequence: Synthetic oligonucleotide
ucgagaaagauggcauuucu

SEQ ID NO: 2804 - RNA, 20 nt, Artificial Sequence
  Description of Artificial Sequence: Synthetic oligonucleotide
uuaaggaagauggcauuccu

SEQ ID NO: 2805 - RNA, 20 nt, Artificial Sequence
  Description of Artificial Sequence: Synthetic oligonucleotide
uccgguucugaagguguucu

SEQ ID NO: 2806 - RNA, 20 nt, Artificial Sequence
  Description of Artificial Sequence: Synthetic oligonucleotide
uccgguucugaagguguucu

SEQ ID NO: 2807 - RNA, 20 nt, Artificial Sequence
  Description of Artificial Sequence: Synthetic oligonucleotide
uccgguucugaagguguucu

SEQ ID NO: 2808 - RNA, 20 nt, Artificial Sequence
  Description of Artificial Sequence: Synthetic oligonucleotide
uccgguucugaagguguucu

SEQ ID NO: 2809 - RNA, 20 nt, Artificial Sequence
  Description of Artificial Sequence: Synthetic oligonucleotide
uccgguucugaagguguucu

SEQ ID NO: 2810 - RNA, 20 nt, Artificial Sequence
  Description of Artificial Sequence: Synthetic oligonucleotide
uccgguucugaagguguucu

SEQ ID NO: 2811 - RNA, 20 nt, Artificial Sequence
  Description of Artificial Sequence: Synthetic oligonucleotide
uccgguucugaagguguucu

SEQ ID NO: 2812 - RNA, 20 nt, Artificial Sequence
  Description of Artificial Sequence: Synthetic oligonucleotide
uccgguucugaagguguucu

SEQ ID NO: 2813 - RNA, 20 nt, Artificial Sequence
  Description of Artificial Sequence: Synthetic oligonucleotide
uccgguucugaagguguucu

SEQ ID NO: 2814 - RNA, 20 nt, Artificial Sequence
  Description of Artificial Sequence: Synthetic oligonucleotide
uccgguucugaagguguucu

SEQ ID NO: 2815 - RNA, 20 nt, Artificial Sequence
  Description of Artificial Sequence: Synthetic oligonucleotide
uccgguucugaagguguucu

SEQ ID NO: 2816 - RNA, 20 nt, Artificial Sequence
  Description of Artificial Sequence: Synthetic oligonucleotide
uccgguucugaagguguucu

SEQ ID NO: 2817 - RNA, 20 nt, Artificial Sequence
  Description of Artificial Sequence: Synthetic oligonucleotide
uccgguucugaagguguucu

SEQ ID NO: 2818 - RNA, 20 nt, Artificial Sequence
  Description of Artificial Sequence: Synthetic oligonucleotide
uccgguucugaagguguucu

SEQ ID NO: 2819 - RNA, 20 nt, Artificial Sequence
  Description of Artificial Sequence: Synthetic oligonucleotide
uccgguucugaagguguucu

SEQ ID NO: 2820 - RNA, 20 nt, Artificial Sequence
  Description of Artificial Sequence: Synthetic oligonucleotide
uccgguucugaagguguucu

SEQ ID NO: 2821 - RNA, 18 nt, Artificial Sequence
  Description of Artificial Sequence: Synthetic oligonucleotide
cgguucugaagguguucu

SEQ ID NO: 2822 - RNA, 21 nt, Artificial Sequence
  Description of Artificial Sequence: Synthetic oligonucleotide
uuccgguucugaagguguucu

SEQ ID NO: 2823 - RNA, 21 nt, Artificial Sequence
  Description of Artificial Sequence: Synthetic oligonucleotide
uccgguuucugaagguguucu

SEQ ID NO: 2824 - RNA, 21 nt, Artificial Sequence
  Description of Artificial Sequence: Synthetic oligonucleotide
uccgguucugaagguguuucu

SEQ ID NO: 2825 - RNA, 19 nt, Artificial Sequence
  Description of Artificial Sequence: Synthetic oligonucleotide
uccggucugaagguguucu

SEQ ID NO: 2826 - DNA, 20 bp, Artificial Sequence
  Description of Artificial Sequence: Synthetic oligonucleotide
  Description of Combined DNA/RNA Molecule: Synthetic oligonucleotide
tcacucagauaguugaagcc

SEQ ID NO: 2827 - RNA, 20 nt, Artificial Sequence
  Description of Artificial Sequence: Synthetic oligonucleotide
ucacucagauaguugaagcc

SEQ ID NO: 2828 - DNA, 20 bp, Artificial Sequence
  Description of Artificial Sequence: Synthetic oligonucleotide
  Description of Combined DNA/RNA Molecule: Synthetic oligonucleotide
tcacucagauaguugaagcc

SEQ ID NO: 2829 - DNA, 20 bp, Artificial Sequence
  Description of Artificial Sequence: Synthetic oligonucleotide
  Description of Combined DNA/RNA Molecule: Synthetic oligonucleotide
ucacucagauagtugaagcc

SEQ ID NO: 2830 - DNA, 20 bp, Artificial Sequence
  Description of Artificial Sequence: Synthetic oligonucleotide
  Description of Combined DNA/RNA Molecule: Synthetic oligonucleotide
ucacucagauagttgaagcc

SEQ ID NO: 2831 - DNA, 20 bp, Artificial Sequence
  Description of Artificial Sequence: Synthetic oligonucleotide
  Description of Combined DNA/RNA Molecule: Synthetic oligonucleotide
ucacucagauagttgaagcc

SEQ ID NO: 2832 - DNA, 20 bp, Artificial Sequence
  Description of Artificial Sequence: Synthetic oligonucleotide
  Description of Combined DNA/RNA Molecule: Synthetic oligonucleotide
tcacucagauaguugaagcc

SEQ ID NO: 2833 - RNA, 20 nt, Artificial Sequence
  Description of Artificial Sequence: Synthetic oligonucleotide
ucacucagauaguugaagcc

SEQ ID NO: 2834 - DNA, 20 bp, Artificial Sequence
  Description of Artificial Sequence: Synthetic oligonucleotide
  Description of Combined DNA/RNA Molecule: Synthetic oligonucleotide
tcacucagauaguugaagcc

SEQ ID NO: 2835 - RNA, 20 nt, Artificial Sequence
  Description of Artificial Sequence: Synthetic oligonucleotide
ucacucagauaguugaagcc

SEQ ID NO: 2836 - RNA, 20 nt, Artificial Sequence
  Description of Artificial Sequence: Synthetic oligonucleotide
ucacucagauaguugaagcc

SEQ ID NO: 2837 - RNA, 20 nt, Artificial Sequence
  Description of Artificial Sequence: Synthetic oligonucleotide
ucacucagauaguugaagcc

SEQ ID NO: 2838 - RNA, 20 nt, Artificial Sequence
  Description of Artificial Sequence: Synthetic oligonucleotide
ucacucagauaguugaagcc

SEQ ID NO: 2839 - RNA, 20 nt, Artificial Sequence
  Description of Artificial Sequence: Synthetic oligonucleotide
ucacucagauaguugaagcc

SEQ ID NO: 2840 - RNA, 20 nt, Artificial Sequence
  Description of Artificial Sequence: Synthetic oligonucleotide
ucacucagauaguugaagcc

SEQ ID NO: 2841 - RNA, 20 nt, Artificial Sequence
  Description of Artificial Sequence: Synthetic oligonucleotide
ucacucagauaguugaagcc

SEQ ID NO: 2842 - RNA, 20 nt, Artificial Sequence
  Description of Artificial Sequence: Synthetic oligonucleotide
ucacucagauaguugaagcc

SEQ ID NO: 2843 - RNA, 20 nt, Artificial Sequence
  Description of Artificial Sequence: Synthetic oligonucleotide
ucacucagauaguugaagcc

SEQ ID NO: 2844 - RNA, 20 nt, Artificial Sequence
  Description of Artificial Sequence: Synthetic oligonucleotide
ucacucagauaguugaagcc

SEQ ID NO: 2845 - RNA, 20 nt, Artificial Sequence
  Description of Artificial Sequence: Synthetic oligonucleotide
ucacucagauaguugaagcc

SEQ ID NO: 2846 - RNA, 20 nt, Artificial Sequence
  Description of Artificial Sequence: Synthetic oligonucleotide
cuccgguucugaagguguuc

SEQ ID NO: 2847 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2848 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2849 - RNA, 20 nt, Artificial Sequence
  Description of Artificial Sequence: Synthetic oligonucleotide
cuccgguucugaagguguuc

SEQ ID NO: 2850 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2851 - RNA, 20 nt, Artificial Sequence
  Description of Artificial Sequence: Synthetic oligonucleotide
cuccgguucugaagguguuc

SEQ ID NO: 2852 - RNA, 20 nt, Artificial Sequence
  Description of Artificial Sequence: Synthetic oligonucleotide
ucacucagauaguugaagcc

SEQ ID NO: 2853 - RNA, 20 nt, Artificial Sequence
  Description of Artificial Sequence: Synthetic oligonucleotide
cuccgguucugaagguguuc

SEQ ID NO: 2854 - RNA, 20 nt, Artificial Sequence
  Description of Artificial Sequence: Synthetic oligonucleotide
ucacucagauaguugaagcc

SEQ ID NO: 2855 - RNA, 20 nt, Artificial Sequence
  Description of Artificial Sequence: Synthetic oligonucleotide
ucacucagauaguugaagcc

SEQ ID NO: 2856 - RNA, 20 nt, Artificial Sequence
  Description of Artificial Sequence: Synthetic oligonucleotide
ucacucagauaguugaagcc

SEQ ID NO: 2857 - RNA, 20 nt, Artificial Sequence
  Description of Artificial Sequence: Synthetic oligonucleotide
ucacucagauaguugaagcc

SEQ ID NO: 2858 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2859 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2860 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2861 - RNA, 20 nt, Artificial Sequence
  Description of Artificial Sequence: Synthetic oligonucleotide
ucacucagauaguugaagcc

SEQ ID NO: 2862 - RNA, 20 nt, Artificial Sequence
  Description of Artificial Sequence: Synthetic oligonucleotide
ucacucagauaguugaagcc

SEQ ID NO: 2863 - RNA, 20 nt, Artificial Sequence
  Description of Artificial Sequence: Synthetic oligonucleotide
ucacucagauaguugaagcc

SEQ ID NO: 2864 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2865 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2866 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2867 - RNA, 20 nt, Artificial Sequence
  Description of Artificial Sequence: Synthetic oligonucleotide
ucacucagauaguugaagcc

SEQ ID NO: 2868 - RNA, 20 nt, Artificial Sequence
  Description of Artificial Sequence: Synthetic oligonucleotide
ucacucagauaguugaagcc

SEQ ID NO: 2869 - RNA, 20 nt, Artificial Sequence
  Description of Artificial Sequence: Synthetic oligonucleotide
ucacucagauaguugaagcc

SEQ ID NO: 2870 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2871 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2872 - RNA, 20 nt, Artificial Sequence
  Description of Artificial Sequence: Synthetic oligonucleotide
ucacucagauaguugaagcc

SEQ ID NO: 2873 - RNA, 20 nt, Artificial Sequence
  Description of Artificial Sequence: Synthetic oligonucleotide
ucacucagauaguugaagcc

SEQ ID NO: 2874 - RNA, 20 nt, Artificial Sequence
  Description of Artificial Sequence: Synthetic oligonucleotide
ucacucagauaguugaagcc

SEQ ID NO: 2875 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2876 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2877 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 2878 - RNA, 20 nt, Artificial Sequence
  Description of Artificial Sequence: Synthetic oligonucleotide
cuccgguucugaagguguuc

SEQ ID NO: 2879 - RNA, 20 nt, Artificial Sequence
  Description of Artificial Sequence: Synthetic oligonucleotide
cuccgguucugaagguguuc

SEQ ID NO: 2880 - RNA, 20 nt, Artificial Sequence
  Description of Artificial Sequence: Synthetic oligonucleotide
cuccgguucugaagguguuc

SEQ ID NO: 2881 - RNA, 20 nt, Artificial Sequence
  Description of Artificial Sequence: Synthetic oligonucleotide
cuccgguucugaagguguuc

SEQ ID NO: 2882 - RNA, 20 nt, Artificial Sequence
  Description of Artificial Sequence: Synthetic oligonucleotide
cuccgguucugaagguguuc

SEQ ID NO: 2883 - RNA, 20 nt, Artificial Sequence
  Description of Artificial Sequence: Synthetic oligonucleotide
cuccgguucugaagguguuc

SEQ ID NO: 2884 - RNA, 20 nt, Artificial Sequence
  Description of Artificial Sequence: Synthetic oligonucleotide
cuccgguucugaagguguuc

SEQ ID NO: 2885 - RNA, 20 nt, Artificial Sequence
  Description of Artificial Sequence: Synthetic oligonucleotide
cuccgguucugaagguguuc

SEQ ID NO: 2886 - RNA, 20 nt, Artificial Sequence
  Description of Artificial Sequence: Synthetic oligonucleotide
cuccgguucugaagguguuc

SEQ ID NO: 2887 - RNA, 20 nt, Artificial Sequence
  Description of Artificial Sequence: Synthetic oligonucleotide
cuccgguucugaagguguuc

SEQ ID NO: 2888 - RNA, 20 nt, Artificial Sequence
  Description of Artificial Sequence: Synthetic oligonucleotide
cuccgguucugaagguguuc

SEQ ID NO: 2889 - RNA, 20 nt, Artificial Sequence
  Description of Artificial Sequence: Synthetic oligonucleotide
cuccgguucugaagguguuc

SEQ ID NO: 2890 - RNA, 20 nt, Artificial Sequence
  Description of Artificial Sequence: Synthetic oligonucleotide
cuccgguucugaagguguuc

SEQ ID NO: 2891 - RNA, 20 nt, Artificial Sequence
  Description of Artificial Sequence: Synthetic oligonucleotide
cuccgguucugaagguguuc

SEQ ID NO: 2892 - RNA, 20 nt, Artificial Sequence
  Description of Artificial Sequence: Synthetic oligonucleotide
cuccgguucugaagguguuc

SEQ ID NO: 2893 - RNA, 20 nt, Artificial Sequence
  Description of Artificial Sequence: Synthetic oligonucleotide
cuccgguucugaagguguuc

SEQ ID NO: 2894 - RNA, 20 nt, Artificial Sequence
  Description of Artificial Sequence: Synthetic oligonucleotide
cuccgguucugaagguguuc

SEQ ID NO: 2895 - RNA, 20 nt, Artificial Sequence
  Description of Artificial Sequence: Synthetic oligonucleotide
cuccgguucugaagguguuc

SEQ ID NO: 2896 - RNA, 20 nt, Artificial Sequence
  Description of Artificial Sequence: Synthetic oligonucleotide
cuccgguucugaagguguuc

SEQ ID NO: 2897 - RNA, 20 nt, Artificial Sequence
  Description of Artificial Sequence: Synthetic oligonucleotide
cuuaagauaccauuuguauu

SEQ ID NO: 2898 - RNA, 20 nt, Artificial Sequence
  Description of Artificial Sequence: Synthetic oligonucleotide
uuaagauaccauuuguauuu

SEQ ID NO: 2899 - RNA, 20 nt, Artificial Sequence
  Description of Artificial Sequence: Synthetic oligonucleotide
uaagauaccauuuguauuua

SEQ ID NO: 2900 - RNA, 20 nt, Artificial Sequence
  Description of Artificial Sequence: Synthetic oligonucleotide
aagauaccauuuguauuuag

SEQ ID NO: 2901 - RNA, 20 nt, Artificial Sequence
  Description of Artificial Sequence: Synthetic oligonucleotide
agauaccauuuguauuuagc

SEQ ID NO: 2902 - RNA, 20 nt, Artificial Sequence
  Description of Artificial Sequence: Synthetic oligonucleotide
gauaccauuuguauuuagca

SEQ ID NO: 2903 - RNA, 20 nt, Artificial Sequence
  Description of Artificial Sequence: Synthetic oligonucleotide
auaccauuuguauuuagcau

SEQ ID NO: 2904 - RNA, 20 nt, Artificial Sequence
  Description of Artificial Sequence: Synthetic oligonucleotide
uaccauuuguauuuagcaug

SEQ ID NO: 2905 - RNA, 20 nt, Artificial Sequence
  Description of Artificial Sequence: Synthetic oligonucleotide
accauuuguauuuagcaugu

SEQ ID NO: 2906 - RNA, 20 nt, Artificial Sequence
  Description of Artificial Sequence: Synthetic oligonucleotide
ccauuuguauuuagcauguu

SEQ ID NO: 2907 - RNA, 20 nt, Artificial Sequence
  Description of Artificial Sequence: Synthetic oligonucleotide
cauuuguauuuagcauguuc

SEQ ID NO: 2908 - RNA, 20 nt, Artificial Sequence
  Description of Artificial Sequence: Synthetic oligonucleotide
auuuguauuuagcauguucc

SEQ ID NO: 2909 - RNA, 20 nt, Artificial Sequence
  Description of Artificial Sequence: Synthetic oligonucleotide
uuuguauuuagcauguuccc

SEQ ID NO: 2910 - RNA, 20 nt, Artificial Sequence
  Description of Artificial Sequence: Synthetic oligonucleotide
uuguauuuagcauguuccca

SEQ ID NO: 2911 - RNA, 20 nt, Artificial Sequence
  Description of Artificial Sequence: Synthetic oligonucleotide
uguauuuagcauguucccaa

SEQ ID NO: 2912 - RNA, 20 nt, Artificial Sequence
  Description of Artificial Sequence: Synthetic oligonucleotide
guauuuagcauguucccaau

SEQ ID NO: 2913 - RNA, 20 nt, Artificial Sequence
  Description of Artificial Sequence: Synthetic oligonucleotide
uauuuagcauguucccaauu

SEQ ID NO: 2914 - RNA, 20 nt, Artificial Sequence
  Description of Artificial Sequence: Synthetic oligonucleotide
uuuagcauguucccaauucu

SEQ ID NO: 2915 - RNA, 20 nt, Artificial Sequence
  Description of Artificial Sequence: Synthetic oligonucleotide
uuagcauguucccaauucuc

SEQ ID NO: 2916 - RNA, 20 nt, Artificial Sequence
  Description of Artificial Sequence: Synthetic oligonucleotide
uagcauguucccaauucuca

SEQ ID NO: 2917 - RNA, 20 nt, Artificial Sequence
  Description of Artificial Sequence: Synthetic oligonucleotide
agcauguucccaauucucag

SEQ ID NO: 2918 - RNA, 20 nt, Artificial Sequence
  Description of Artificial Sequence: Synthetic oligonucleotide
gcauguucccaauucucagg

SEQ ID NO: 2919 - RNA, 20 nt, Artificial Sequence
  Description of Artificial Sequence: Synthetic oligonucleotide
cauguucccaauucucagga

SEQ ID NO: 2920 - RNA, 20 nt, Artificial Sequence
  Description of Artificial Sequence: Synthetic oligonucleotide
auguucccaauucucaggaa

SEQ ID NO: 2921 - RNA, 20 nt, Artificial Sequence
  Description of Artificial Sequence: Synthetic oligonucleotide
uguucccaauucucaggaau

SEQ ID NO: 2922 - RNA, 20 nt, Artificial Sequence
  Description of Artificial Sequence: Synthetic oligonucleotide
guucccaauucucaggaauu

SEQ ID NO: 2923 - RNA, 20 nt, Artificial Sequence
  Description of Artificial Sequence: Synthetic oligonucleotide
uucccaauucucaggaauuu

SEQ ID NO: 2924 - RNA, 20 nt, Artificial Sequence
  Description of Artificial Sequence: Synthetic oligonucleotide
ucccaauucucaggaauuug

SEQ ID NO: 2925 - RNA, 20 nt, Artificial Sequence
  Description of Artificial Sequence: Synthetic oligonucleotide
cccaauucucaggaauuugu

SEQ ID NO: 2926 - RNA, 20 nt, Artificial Sequence
  Description of Artificial Sequence: Synthetic oligonucleotide
ccaauucucaggaauuugug

SEQ ID NO: 2927 - RNA, 20 nt, Artificial Sequence
  Description of Artificial Sequence: Synthetic oligonucleotide
caauucucaggaauuugugu

SEQ ID NO: 2928 - RNA, 20 nt, Artificial Sequence
  Description of Artificial Sequence: Synthetic oligonucleotide
aauucucaggaauuuguguc

SEQ ID NO: 2929 - RNA, 20 nt, Artificial Sequence
  Description of Artificial Sequence: Synthetic oligonucleotide
auucucaggaauuugugucu

SEQ ID NO: 2930 - RNA, 20 nt, Artificial Sequence
  Description of Artificial Sequence: Synthetic oligonucleotide
uucucaggaauuugugucuu

SEQ ID NO: 2931 - RNA, 20 nt, Artificial Sequence
  Description of Artificial Sequence: Synthetic oligonucleotide
ucucaggaauuugugucuuu

SEQ ID NO: 2932 - RNA, 20 nt, Artificial Sequence
  Description of Artificial Sequence: Synthetic oligonucleotide
cucaggaauuugugucuuuc

SEQ ID NO: 2933 - RNA, 20 nt, Artificial Sequence
  Description of Artificial Sequence: Synthetic oligonucleotide
ucaggaauuugugucuuucu

SEQ ID NO: 2934 - RNA, 20 nt, Artificial Sequence
  Description of Artificial Sequence: Synthetic oligonucleotide
caggaauuugugucuuucug

SEQ ID NO: 2935 - RNA, 20 nt, Artificial Sequence
  Description of Artificial Sequence: Synthetic oligonucleotide
aggaauuugugucuuucuga

SEQ ID NO: 2936 - RNA, 20 nt, Artificial Sequence
  Description of Artificial Sequence: Synthetic oligonucleotide
ggaauuugugucuuucugag

SEQ ID NO: 2937 - RNA, 20 nt, Artificial Sequence
  Description of Artificial Sequence: Synthetic oligonucleotide
gaauuugugucuuucugaga

SEQ ID NO: 2938 - RNA, 20 nt, Artificial Sequence
  Description of Artificial Sequence: Synthetic oligonucleotide
aauuugugucuuucugagaa

SEQ ID NO: 2939 - RNA, 20 nt, Artificial Sequence
  Description of Artificial Sequence: Synthetic oligonucleotide
auuugugucuuucugagaaa

SEQ ID NO: 2940 - RNA, 20 nt, Artificial Sequence
  Description of Artificial Sequence: Synthetic oligonucleotide
uuugugucuuucugagaaac

SEQ ID NO: 2941 - RNA, 20 nt, Artificial Sequence
  Description of Artificial Sequence: Synthetic oligonucleotide
uugugucuuucugagaaacu

SEQ ID NO: 2942 - RNA, 20 nt, Artificial Sequence
  Description of Artificial Sequence: Synthetic oligonucleotide
ugugucuuucugagaaacug

SEQ ID NO: 2943 - RNA, 20 nt, Artificial Sequence
  Description of Artificial Sequence: Synthetic oligonucleotide
gugucuuucugagaaacugu

SEQ ID NO: 2944 - RNA, 20 nt, Artificial Sequence
  Description of Artificial Sequence: Synthetic oligonucleotide
ugucuuucugagaaacuguu

SEQ ID NO: 2945 - RNA, 20 nt, Artificial Sequence
  Description of Artificial Sequence: Synthetic oligonucleotide
gucuuucugagaaacuguuc

SEQ ID NO: 2946 - RNA, 20 nt, Artificial Sequence
  Description of Artificial Sequence: Synthetic oligonucleotide
ucuuucugagaaacuguuca

SEQ ID NO: 2947 - RNA, 20 nt, Artificial Sequence
  Description of Artificial Sequence: Synthetic oligonucleotide
cuuucugagaaacuguucag

SEQ ID NO: 2948 - RNA, 20 nt, Artificial Sequence
  Description of Artificial Sequence: Synthetic oligonucleotide
uuucugagaaacuguucagc

SEQ ID NO: 2949 - RNA, 20 nt, Artificial Sequence
  Description of Artificial Sequence: Synthetic oligonucleotide
uucugagaaacuguucagcu

SEQ ID NO: 2950 - RNA, 20 nt, Artificial Sequence
  Description of Artificial Sequence: Synthetic oligonucleotide
ucugagaaacuguucagcuu

SEQ ID NO: 2951 - RNA, 20 nt, Artificial Sequence
  Description of Artificial Sequence: Synthetic oligonucleotide
cugagaaacuguucagcuuc

SEQ ID NO: 2952 - RNA, 20 nt, Artificial Sequence
  Description of Artificial Sequence: Synthetic oligonucleotide
ugagaaacuguucagcuucu

SEQ ID NO: 2953 - RNA, 20 nt, Artificial Sequence
  Description of Artificial Sequence: Synthetic oligonucleotide
gagaaacuguucagcuucug

SEQ ID NO: 2954 - RNA, 20 nt, Artificial Sequence
  Description of Artificial Sequence: Synthetic oligonucleotide
agaaacuguucagcuucugu

SEQ ID NO: 2955 - RNA, 20 nt, Artificial Sequence
  Description of Artificial Sequence: Synthetic oligonucleotide
gaaacuguucagcuucuguu

SEQ ID NO: 2956 - RNA, 20 nt, Artificial Sequence
  Description of Artificial Sequence: Synthetic oligonucleotide
aaacuguucagcuucuguua

SEQ ID NO: 2957 - RNA, 20 nt, Artificial Sequence
  Description of Artificial Sequence: Synthetic oligonucleotide
aacuguucagcuucuguuag

SEQ ID NO: 2958 - RNA, 20 nt, Artificial Sequence
  Description of Artificial Sequence: Synthetic oligonucleotide
acuguucagcuucuguuagc

SEQ ID NO: 2959 - RNA, 20 nt, Artificial Sequence
  Description of Artificial Sequence: Synthetic oligonucleotide
cuguucagcuucuguuagcc

SEQ ID NO: 2960 - RNA, 20 nt, Artificial Sequence
  Description of Artificial Sequence: Synthetic oligonucleotide
uguucagcuucuguuagcca

SEQ ID NO: 2961 - RNA, 20 nt, Artificial Sequence
  Description of Artificial Sequence: Synthetic oligonucleotide
guucagcuucuguuagccac

SEQ ID NO: 2962 - RNA, 20 nt, Artificial Sequence
  Description of Artificial Sequence: Synthetic oligonucleotide
uucagcuucuguuagccacu

SEQ ID NO: 2963 - RNA, 20 nt, Artificial Sequence
  Description of Artificial Sequence: Synthetic oligonucleotide
ucagcuucuguuagccacug

SEQ ID NO: 2964 - RNA, 20 nt, Artificial Sequence
  Description of Artificial Sequence: Synthetic oligonucleotide
cagcuucuguuagccacuga

SEQ ID NO: 2965 - RNA, 20 nt, Artificial Sequence
  Description of Artificial Sequence: Synthetic oligonucleotide
agcuucuguuagccacugau

SEQ ID NO: 2966 - RNA, 20 nt, Artificial Sequence
  Description of Artificial Sequence: Synthetic oligonucleotide
gcuucuguuagccacugauu

SEQ ID NO: 2967 - RNA, 20 nt, Artificial Sequence
  Description of Artificial Sequence: Synthetic oligonucleotide
cuucuguuagccacugauua

SEQ ID NO: 2968 - RNA, 20 nt, Artificial Sequence
  Description of Artificial Sequence: Synthetic oligonucleotide
uucuguuagccacugauuaa

SEQ ID NO: 2969 - RNA, 20 nt, Artificial Sequence
  Description of Artificial Sequence: Synthetic oligonucleotide
ucuguuagccacugauuaaa

SEQ ID NO: 2970 - RNA, 20 nt, Artificial Sequence
  Description of Artificial Sequence: Synthetic oligonucleotide
cuguuagccacugauuaaau

SEQ ID NO: 2971 - RNA, 20 nt, Artificial Sequence
  Description of Artificial Sequence: Synthetic oligonucleotide
uguuagccacugauuaaaua

SEQ ID NO: 2972 - RNA, 20 nt, Artificial Sequence
  Description of Artificial Sequence: Synthetic oligonucleotide
guuagccacugauuaaauau

SEQ ID NO: 2973 - RNA, 20 nt, Artificial Sequence
  Description of Artificial Sequence: Synthetic oligonucleotide
uuagccacugauuaaauauc

SEQ ID NO: 2974 - RNA, 20 nt, Artificial Sequence
  Description of Artificial Sequence: Synthetic oligonucleotide
uagccacugauuaaauaucu

SEQ ID NO: 2975 - RNA, 20 nt, Artificial Sequence
  Description of Artificial Sequence: Synthetic oligonucleotide
agccacugauuaaauaucuu

SEQ ID NO: 2976 - RNA, 20 nt, Artificial Sequence
  Description of Artificial Sequence: Synthetic oligonucleotide
gccacugauuaaauaucuuu

SEQ ID NO: 2977 - RNA, 20 nt, Artificial Sequence
  Description of Artificial Sequence: Synthetic oligonucleotide
ccacugauuaaauaucuuua

SEQ ID NO: 2978 - RNA, 20 nt, Artificial Sequence
  Description of Artificial Sequence: Synthetic oligonucleotide
cacugauuaaauaucuuuau

SEQ ID NO: 2979 - RNA, 20 nt, Artificial Sequence
  Description of Artificial Sequence: Synthetic oligonucleotide
acugauuaaauaucuuuaua

SEQ ID NO: 2980 - RNA, 20 nt, Artificial Sequence
  Description of Artificial Sequence: Synthetic oligonucleotide
cugauuaaauaucuuuauau

SEQ ID NO: 2981 - RNA, 20 nt, Artificial Sequence
  Description of Artificial Sequence: Synthetic oligonucleotide
ugauuaaauaucuuuauauc

SEQ ID NO: 2982 - RNA, 20 nt, Artificial Sequence
  Description of Artificial Sequence: Synthetic oligonucleotide
gauuaaauaucuuuauauca

SEQ ID NO: 2983 - RNA, 20 nt, Artificial Sequence
  Description of Artificial Sequence: Synthetic oligonucleotide
auuaaauaucuuuauaucau

SEQ ID NO: 2984 - RNA, 20 nt, Artificial Sequence
  Description of Artificial Sequence: Synthetic oligonucleotide
uuaaauaucuuuauaucaua

SEQ ID NO: 2985 - RNA, 20 nt, Artificial Sequence
  Description of Artificial Sequence: Synthetic oligonucleotide
uaaauaucuuuauaucauaa

SEQ ID NO: 2986 - RNA, 20 nt, Artificial Sequence
  Description of Artificial Sequence: Synthetic oligonucleotide
aaauaucuuuauaucauaau

SEQ ID NO: 2987 - RNA, 20 nt, Artificial Sequence
  Description of Artificial Sequence: Synthetic oligonucleotide
aauaucuuuauaucauaaug

SEQ ID NO: 2988 - RNA, 20 nt, Artificial Sequence
  Description of Artificial Sequence: Synthetic oligonucleotide
auaucuuuauaucauaauga

SEQ ID NO: 2989 - RNA, 20 nt, Artificial Sequence
  Description of Artificial Sequence: Synthetic oligonucleotide
uaucuuuauaucauaaugaa

SEQ ID NO: 2990 - RNA, 20 nt, Artificial Sequence
  Description of Artificial Sequence: Synthetic oligonucleotide
aucuuuauaucauaaugaaa

SEQ ID NO: 2991 - RNA, 20 nt, Artificial Sequence
  Description of Artificial Sequence: Synthetic oligonucleotide
ucuuuauaucauaaugaaaa

SEQ ID NO: 2992 - RNA, 20 nt, Artificial Sequence
  Description of Artificial Sequence: Synthetic oligonucleotide
cuuuauaucauaaugaaaac

SEQ ID NO: 2993 - RNA, 20 nt, Artificial Sequence
  Description of Artificial Sequence: Synthetic oligonucleotide
cugaauuauuucuuccccag

SEQ ID NO: 2994 - RNA, 20 nt, Artificial Sequence
  Description of Artificial Sequence: Synthetic oligonucleotide
ugaauuauuucuuccccagu

SEQ ID NO: 2995 - RNA, 20 nt, Artificial Sequence
  Description of Artificial Sequence: Synthetic oligonucleotide
gaauuauuucuuccccaguu

SEQ ID NO: 2996 - RNA, 20 nt, Artificial Sequence
  Description of Artificial Sequence: Synthetic oligonucleotide
aauuauuucuuccccaguug

SEQ ID NO: 2997 - RNA, 20 nt, Artificial Sequence
  Description of Artificial Sequence: Synthetic oligonucleotide
auuauuucuuccccaguugc

SEQ ID NO: 2998 - RNA, 20 nt, Artificial Sequence
  Description of Artificial Sequence: Synthetic oligonucleotide
uuauuucuuccccaguugca

SEQ ID NO: 2999 - RNA, 20 nt, Artificial Sequence
  Description of Artificial Sequence: Synthetic oligonucleotide
uauuucuuccccaguugcau

SEQ ID NO: 3000 - RNA, 20 nt, Artificial Sequence
  Description of Artificial Sequence: Synthetic oligonucleotide
auuucuuccccaguugcauu

SEQ ID NO: 3001 - RNA, 20 nt, Artificial Sequence
  Description of Artificial Sequence: Synthetic oligonucleotide
uuucuuccccaguugcauuc

SEQ ID NO: 3002 - RNA, 20 nt, Artificial Sequence
  Description of Artificial Sequence: Synthetic oligonucleotide
uucuuccccaguugcauuca

SEQ ID NO: 3003 - RNA, 20 nt, Artificial Sequence
  Description of Artificial Sequence: Synthetic oligonucleotide
ucuuccccaguugcauucaa

SEQ ID NO: 3004 - RNA, 20 nt, Artificial Sequence
  Description of Artificial Sequence: Synthetic oligonucleotide
cuuccccaguugcauucaau

SEQ ID NO: 3005 - RNA, 20 nt, Artificial Sequence
  Description of Artificial Sequence: Synthetic oligonucleotide
uuccccaguugcauucaaug

SEQ ID NO: 3006 - RNA, 20 nt, Artificial Sequence
  Description of Artificial Sequence: Synthetic oligonucleotide
uccccaguugcauucaaugu

SEQ ID NO: 3007 - RNA, 20 nt, Artificial Sequence
  Description of Artificial Sequence: Synthetic oligonucleotide
ccccaguugcauucaauguu

SEQ ID NO: 3008 - RNA, 20 nt, Artificial Sequence
  Description of Artificial Sequence: Synthetic oligonucleotide
cccaguugcauucaauguuc

SEQ ID NO: 3009 - RNA, 20 nt, Artificial Sequence
  Description of Artificial Sequence: Synthetic oligonucleotide
ccaguugcauucaauguucu

SEQ ID NO: 3010 - RNA, 20 nt, Artificial Sequence
  Description of Artificial Sequence: Synthetic oligonucleotide
caguugcauucaauguucug

SEQ ID NO: 3011 - RNA, 20 nt, Artificial Sequence
  Description of Artificial Sequence: Synthetic oligonucleotide
aguugcauucaauguucuga

SEQ ID NO: 3012 - RNA, 20 nt, Artificial Sequence
  Description of Artificial Sequence: Synthetic oligonucleotide
guugcauucaauguucugac

SEQ ID NO: 3013 - RNA, 20 nt, Artificial Sequence
  Description of Artificial Sequence: Synthetic oligonucleotide
uugcauucaauguucugaca

SEQ ID NO: 3014 - RNA, 20 nt, Artificial Sequence
  Description of Artificial Sequence: Synthetic oligonucleotide
ugcauucaauguucugacaa

SEQ ID NO: 3015 - RNA, 20 nt, Artificial Sequence
  Description of Artificial Sequence: Synthetic oligonucleotide
gcauucaauguucugacaac

SEQ ID NO: 3016 - RNA, 20 nt, Artificial Sequence
  Description of Artificial Sequence: Synthetic oligonucleotide
cauucaauguucugacaaca

SEQ ID NO: 3017 - RNA, 20 nt, Artificial Sequence
  Description of Artificial Sequence: Synthetic oligonucleotide
auucaauguucugacaacag

SEQ ID NO: 3018 - RNA, 20 nt, Artificial Sequence
  Description of Artificial Sequence: Synthetic oligonucleotide
uucaauguucugacaacagu

SEQ ID NO: 3019 - RNA, 20 nt, Artificial Sequence
  Description of Artificial Sequence: Synthetic oligonucleotide
ucaauguucugacaacaguu

SEQ ID NO: 3020 - RNA, 20 nt, Artificial Sequence
  Description of Artificial Sequence: Synthetic oligonucleotide
caauguucugacaacaguuu

SEQ ID NO: 3021 - RNA, 20 nt, Artificial Sequence
  Description of Artificial Sequence: Synthetic oligonucleotide
aauguucugacaacaguuug

SEQ ID NO: 3022 - RNA, 20 nt, Artificial Sequence
  Description of Artificial Sequence: Synthetic oligonucleotide
auguucugacaacaguuugc

SEQ ID NO: 3023 - RNA, 20 nt, Artificial Sequence
  Description of Artificial Sequence: Synthetic oligonucleotide
uguucugacaacaguuugcc

SEQ ID NO: 3024 - RNA, 20 nt, Artificial Sequence
  Description of Artificial Sequence: Synthetic oligonucleotide
guucugacaacaguuugccg

SEQ ID NO: 3025 - RNA, 20 nt, Artificial Sequence
  Description of Artificial Sequence: Synthetic oligonucleotide
uucugacaacaguuugccgc

SEQ ID NO: 3026 - RNA, 20 nt, Artificial Sequence
  Description of Artificial Sequence: Synthetic oligonucleotide
ucugacaacaguuugccgcu

SEQ ID NO: 3027 - RNA, 20 nt, Artificial Sequence
  Description of Artificial Sequence: Synthetic oligonucleotide
cugacaacaguuugccgcug

SEQ ID NO: 3028 - RNA, 20 nt, Artificial Sequence
  Description of Artificial Sequence: Synthetic oligonucleotide
ugacaacaguuugccgcugc

SEQ ID NO: 3029 - RNA, 20 nt, Artificial Sequence
  Description of Artificial Sequence: Synthetic oligonucleotide
gacaacaguuugccgcugcc

SEQ ID NO: 3030 - RNA, 20 nt, Artificial Sequence
  Description of Artificial Sequence: Synthetic oligonucleotide
acaacaguuugccgcugccc

SEQ ID NO: 3031 - RNA, 20 nt, Artificial Sequence
  Description of Artificial Sequence: Synthetic oligonucleotide
caacaguuugccgcugccca

SEQ ID NO: 3032 - RNA, 20 nt, Artificial Sequence
  Description of Artificial Sequence: Synthetic oligonucleotide
aacaguuugccgcugcccaa

SEQ ID NO: 3033 - RNA, 20 nt, Artificial Sequence
  Description of Artificial Sequence: Synthetic oligonucleotide
acaguuugccgcugcccaau

SEQ ID NO: 3034 - RNA, 20 nt, Artificial Sequence
  Description of Artificial Sequence: Synthetic oligonucleotide
caguuugccgcugcccaaug

SEQ ID NO: 3035 - RNA, 20 nt, Artificial Sequence
  Description of Artificial Sequence: Synthetic oligonucleotide
aguuugccgcugcccaaugc

SEQ ID NO: 3036 - RNA, 20 nt, Artificial Sequence
  Description of Artificial Sequence: Synthetic oligonucleotide
guuugccgcugcccaaugcc

SEQ ID NO: 3037 - RNA, 20 nt, Artificial Sequence
  Description of Artificial Sequence: Synthetic oligonucleotide
uuugccgcugcccaaugcca

SEQ ID NO: 3038 - RNA, 20 nt, Artificial Sequence
  Description of Artificial Sequence: Synthetic oligonucleotide
uugccgcugcccaaugccau

SEQ ID NO: 3039 - RNA, 20 nt, Artificial Sequence
  Description of Artificial Sequence: Synthetic oligonucleotide
ugccgcugcccaaugccauc

SEQ ID NO: 3040 - RNA, 20 nt, Artificial Sequence
  Description of Artificial Sequence: Synthetic oligonucleotide
gccgcugcccaaugccaucc

SEQ ID NO: 3041 - RNA, 20 nt, Artificial Sequence
  Description of Artificial Sequence: Synthetic oligonucleotide
ccgcugcccaaugccauccu

SEQ ID NO: 3042 - RNA, 20 nt, Artificial Sequence
  Description of Artificial Sequence: Synthetic oligonucleotide
auuuugggcagcgguaauga

SEQ ID NO: 3043 - RNA, 20 nt, Artificial Sequence
  Description of Artificial Sequence: Synthetic oligonucleotide
uuuugggcagcgguaaugag

SEQ ID NO: 3044 - RNA, 20 nt, Artificial Sequence
  Description of Artificial Sequence: Synthetic oligonucleotide
uuugggcagcgguaaugagu

SEQ ID NO: 3045 - RNA, 20 nt, Artificial Sequence
  Description of Artificial Sequence: Synthetic oligonucleotide
uugggcagcgguaaugaguu

SEQ ID NO: 3046 - RNA, 20 nt, Artificial Sequence
  Description of Artificial Sequence: Synthetic oligonucleotide
ugggcagcgguaaugaguuc

SEQ ID NO: 3047 - RNA, 20 nt, Artificial Sequence
  Description of Artificial Sequence: Synthetic oligonucleotide
gggcagcgguaaugaguucu

SEQ ID NO: 3048 - RNA, 20 nt, Artificial Sequence
  Description of Artificial Sequence: Synthetic oligonucleotide
ggcagcgguaaugaguucuu

SEQ ID NO: 3049 - RNA, 20 nt, Artificial Sequence
  Description of Artificial Sequence: Synthetic oligonucleotide
gcagcgguaaugaguucuuc

SEQ ID NO: 3050 - RNA, 20 nt, Artificial Sequence
  Description of Artificial Sequence: Synthetic oligonucleotide
cagcgguaaugaguucuucc

SEQ ID NO: 3051 - RNA, 20 nt, Artificial Sequence
  Description of Artificial Sequence: Synthetic oligonucleotide
agcgguaaugaguucuucca

SEQ ID NO: 3052 - RNA, 20 nt, Artificial Sequence
  Description of Artificial Sequence: Synthetic oligonucleotide
gcgguaaugaguucuuccaa

SEQ ID NO: 3053 - RNA, 20 nt, Artificial Sequence
  Description of Artificial Sequence: Synthetic oligonucleotide
cgguaaugaguucuuccaac

SEQ ID NO: 3054 - RNA, 20 nt, Artificial Sequence
  Description of Artificial Sequence: Synthetic oligonucleotide
gguaaugaguucuuccaacu

SEQ ID NO: 3055 - RNA, 20 nt, Artificial Sequence
  Description of Artificial Sequence: Synthetic oligonucleotide
guaaugaguucuuccaacug

SEQ ID NO: 3056 - RNA, 20 nt, Artificial Sequence
  Description of Artificial Sequence: Synthetic oligonucleotide
uaaugaguucuuccaacugg

SEQ ID NO: 3057 - RNA, 20 nt, Artificial Sequence
  Description of Artificial Sequence: Synthetic oligonucleotide
aaugaguucuuccaacuggg

SEQ ID NO: 3058 - RNA, 20 nt, Artificial Sequence
  Description of Artificial Sequence: Synthetic oligonucleotide
augaguucuuccaacugggg

SEQ ID NO: 3059 - RNA, 20 nt, Artificial Sequence
  Description of Artificial Sequence: Synthetic oligonucleotide
ugaguucuuccaacugggga

SEQ ID NO: 3060 - RNA, 20 nt, Artificial Sequence
  Description of Artificial Sequence: Synthetic oligonucleotide
gaguucuuccaacuggggac

SEQ ID NO: 3061 - RNA, 20 nt, Artificial Sequence
  Description of Artificial Sequence: Synthetic oligonucleotide
aguucuuccaacuggggacg

SEQ ID NO: 3062 - RNA, 20 nt, Artificial Sequence
  Description of Artificial Sequence: Synthetic oligonucleotide
guucuuccaacuggggacgc

SEQ ID NO: 3063 - RNA, 20 nt, Artificial Sequence
  Description of Artificial Sequence: Synthetic oligonucleotide
uucuuccaacuggggacgcc

SEQ ID NO: 3064 - RNA, 20 nt, Artificial Sequence
  Description of Artificial Sequence: Synthetic oligonucleotide
ucuuccaacuggggacgccu

SEQ ID NO: 3065 - RNA, 20 nt, Artificial Sequence
  Description of Artificial Sequence: Synthetic oligonucleotide
cuuccaacuggggacgccuc

SEQ ID NO: 3066 - RNA, 20 nt, Artificial Sequence
  Description of Artificial Sequence: Synthetic oligonucleotide
uuccaacuggggacgccucu

SEQ ID NO: 3067 - RNA, 20 nt, Artificial Sequence
  Description of Artificial Sequence: Synthetic oligonucleotide
uccaacuggggacgccucug

SEQ ID NO: 3068 - RNA, 20 nt, Artificial Sequence
  Description of Artificial Sequence: Synthetic oligonucleotide
ccaacuggggacgccucugu

SEQ ID NO: 3069 - RNA, 20 nt, Artificial Sequence
  Description of Artificial Sequence: Synthetic oligonucleotide
caacuggggacgccucuguu

SEQ ID NO: 3070 - RNA, 20 nt, Artificial Sequence
  Description of Artificial Sequence: Synthetic oligonucleotide
aacuggggacgccucuguuc

SEQ ID NO: 3071 - RNA, 20 nt, Artificial Sequence
  Description of Artificial Sequence: Synthetic oligonucleotide
acuggggacgccucuguucc

SEQ ID NO: 3072 - RNA, 20 nt, Artificial Sequence
  Description of Artificial Sequence: Synthetic oligonucleotide
cuggggacgccucuguucca

SEQ ID NO: 3073 - RNA, 20 nt, Artificial Sequence
  Description of Artificial Sequence: Synthetic oligonucleotide
uggggacgccucuguuccaa

SEQ ID NO: 3074 - RNA, 20 nt, Artificial Sequence
  Description of Artificial Sequence: Synthetic oligonucleotide
ggggacgccucuguuccaaa

SEQ ID NO: 3075 - RNA, 20 nt, Artificial Sequence
  Description of Artificial Sequence: Synthetic oligonucleotide
gggacgccucuguuccaaau

SEQ ID NO: 3076 - RNA, 20 nt, Artificial Sequence
  Description of Artificial Sequence: Synthetic oligonucleotide
ggacgccucuguuccaaauc

SEQ ID NO: 3077 - RNA, 20 nt, Artificial Sequence
  Description of Artificial Sequence: Synthetic oligonucleotide
gacgccucuguuccaaaucc

SEQ ID NO: 3078 - RNA, 20 nt, Artificial Sequence
  Description of Artificial Sequence: Synthetic oligonucleotide
acgccucuguuccaaauccu

SEQ ID NO: 3079 - RNA, 20 nt, Artificial Sequence
  Description of Artificial Sequence: Synthetic oligonucleotide
cgccucuguuccaaauccug

SEQ ID NO: 3080 - RNA, 20 nt, Artificial Sequence
  Description of Artificial Sequence: Synthetic oligonucleotide
gccucuguuccaaauccugc

SEQ ID NO: 3081 - RNA, 20 nt, Artificial Sequence
  Description of Artificial Sequence: Synthetic oligonucleotide
ccucuguuccaaauccugca

SEQ ID NO: 3082 - RNA, 20 nt, Artificial Sequence
  Description of Artificial Sequence: Synthetic oligonucleotide
cucuguuccaaauccugcau

SEQ ID NO: 3083 - RNA, 20 nt, Artificial Sequence
  Description of Artificial Sequence: Synthetic oligonucleotide
ucuguuccaaauccugcauu

SEQ ID NO: 3084 - RNA, 20 nt, Artificial Sequence
  Description of Artificial Sequence: Synthetic oligonucleotide
cuguuccaaauccugcauug

SEQ ID NO: 3085 - RNA, 20 nt, Artificial Sequence
  Description of Artificial Sequence: Synthetic oligonucleotide
uguuccaaauccugcauugu

SEQ ID NO: 3086 - RNA, 20 nt, Artificial Sequence
  Description of Artificial Sequence: Synthetic oligonucleotide
guuccaaauccugcauuguu

SEQ ID NO: 3087 - RNA, 20 nt, Artificial Sequence
  Description of Artificial Sequence: Synthetic oligonucleotide
uuccaaauccugcauuguug

SEQ ID NO: 3088 - RNA, 20 nt, Artificial Sequence
  Description of Artificial Sequence: Synthetic oligonucleotide
uccaaauccugcauuguugc

SEQ ID NO: 3089 - RNA, 20 nt, Artificial Sequence
  Description of Artificial Sequence: Synthetic oligonucleotide
ucacucagauaguugaagcc

SEQ ID NO: 3090 - RNA, 20 nt, Artificial Sequence
  Description of Artificial Sequence: Synthetic oligonucleotide
ucacucagauaguugaagcc

SEQ ID NO: 3091 - RNA, 20 nt, Artificial Sequence
  Description of Artificial Sequence: Synthetic oligonucleotide
ucacucagauaguugaagcc

SEQ ID NO: 3092 - RNA, 20 nt, Artificial Sequence
  Description of Artificial Sequence: Synthetic oligonucleotide
ucacucagauaguugaagcc

SEQ ID NO: 3093 - RNA, 20 nt, Artificial Sequence
  Description of Artificial Sequence: Synthetic oligonucleotide
ucacucagauaguugaagcc

SEQ ID NO: 3094 - RNA, 20 nt, Artificial Sequence
  Description of Artificial Sequence: Synthetic oligonucleotide
ucacucagauaguugaagcc

SEQ ID NO: 3095 - RNA, 20 nt, Artificial Sequence
  Description of Artificial Sequence: Synthetic oligonucleotide
ucacucagauaguugaagcc

SEQ ID NO: 3096 - RNA, 20 nt, Artificial Sequence
  Description of Artificial Sequence: Synthetic oligonucleotide
ucacucagauaguugaagcc

SEQ ID NO: 3097 - RNA, 20 nt, Artificial Sequence
  Description of Artificial Sequence: Synthetic oligonucleotide
ucacucagauaguugaagcc

SEQ ID NO: 3098 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3099 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3100 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3101 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3102 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3103 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3104 - RNA, 20 nt, Artificial Sequence
  Description of Artificial Sequence: Synthetic oligonucleotide
ucaaggaagauggcauuucu

SEQ ID NO: 3105 - RNA, 20 nt, Artificial Sequence
  Description of Artificial Sequence: Synthetic oligonucleotide
ucaaggaagauggcauuucu

SEQ ID NO: 3106 - RNA, 20 nt, Artificial Sequence
  Description of Artificial Sequence: Synthetic oligonucleotide
ucaaggaagauggcauuucu

SEQ ID NO: 3107 - RNA, 20 nt, Artificial Sequence
  Description of Artificial Sequence: Synthetic oligonucleotide
ucaaggaagauggcauuucu

SEQ ID NO: 3108 - RNA, 20 nt, Artificial Sequence
  Description of Artificial Sequence: Synthetic oligonucleotide
ucaaggaagauggcauuucu

SEQ ID NO: 3109 - RNA, 20 nt, Artificial Sequence
  Description of Artificial Sequence: Synthetic oligonucleotide
ucaaggaagauggcauuucu

SEQ ID NO: 3110 - RNA, 20 nt, Artificial Sequence
  Description of Artificial Sequence: Synthetic oligonucleotide
ucaaggaagauggcauuucu

SEQ ID NO: 3111 - RNA, 20 nt, Artificial Sequence
  Description of Artificial Sequence: Synthetic oligonucleotide
ucaaggaagauggcauuucu

SEQ ID NO: 3112 - RNA, 20 nt, Artificial Sequence
  Description of Artificial Sequence: Synthetic oligonucleotide
ucaaggaagauggcauuucu

SEQ ID NO: 3113 - RNA, 20 nt, Artificial Sequence
  Description of Artificial Sequence: Synthetic oligonucleotide
ucaaggaagauggcauuucu

SEQ ID NO: 3114 - RNA, 20 nt, Artificial Sequence
  Description of Artificial Sequence: Synthetic oligonucleotide
ucaaggaagauggcauuucu

SEQ ID NO: 3115 - RNA, 20 nt, Artificial Sequence
  Description of Artificial Sequence: Synthetic oligonucleotide
ucaaggaagauggcauuucu

SEQ ID NO: 3116 - RNA, 20 nt, Artificial Sequence
  Description of Artificial Sequence: Synthetic oligonucleotide
ucaaggaagauggcauuucu

SEQ ID NO: 3117 - RNA, 20 nt, Artificial Sequence
  Description of Artificial Sequence: Synthetic oligonucleotide
ucacucagauaguugaagcc

SEQ ID NO: 3118 - RNA, 20 nt, Artificial Sequence
  Description of Artificial Sequence: Synthetic oligonucleotide
ucacucagauaguugaagcc

SEQ ID NO: 3119 - RNA, 20 nt, Artificial Sequence
  Description of Artificial Sequence: Synthetic oligonucleotide
ucaaggaagauggcauuucg

SEQ ID NO: 3120 - RNA, 20 nt, Artificial Sequence
  Description of Artificial Sequence: Synthetic oligonucleotide
gcaaggaagauggcauuucu

SEQ ID NO: 3121 - RNA, 20 nt, Artificial Sequence
  Description of Artificial Sequence: Synthetic oligonucleotide
ucaaggaagauggcauuucu

SEQ ID NO: 3122 - RNA, 20 nt, Artificial Sequence
  Description of Artificial Sequence: Synthetic oligonucleotide
ucaaggaagauggcauuucu

SEQ ID NO: 3123 - RNA, 12 nt, Artificial Sequence
  Description of Artificial Sequence: Synthetic oligonucleotide
ucaaggaagaug

SEQ ID NO: 3124 - RNA, 15 nt, Artificial Sequence
  Description of Artificial Sequence: Synthetic oligonucleotide
ucaaggaagauggca

SEQ ID NO: 3125 - RNA, 16 nt, Artificial Sequence
  Description of Artificial Sequence: Synthetic oligonucleotide
ucaaggaagauggcau

SEQ ID NO: 3126 - RNA, 17 nt, Artificial Sequence
  Description of Artificial Sequence: Synthetic oligonucleotide
ucaaggaagauggcauu

SEQ ID NO: 3127 - RNA, 20 nt, Artificial Sequence
  Description of Artificial Sequence: Synthetic oligonucleotide
ucacucagauaguugaagcc

SEQ ID NO: 3128 - RNA, 20 nt, Artificial Sequence
  Description of Artificial Sequence: Synthetic oligonucleotide
ucacucagauaguugaagcc

SEQ ID NO: 3129 - RNA, 20 nt, Artificial Sequence
  Description of Artificial Sequence: Synthetic oligonucleotide
ucacucagauaguugaagcc

SEQ ID NO: 3130 - RNA, 20 nt, Artificial Sequence
  Description of Artificial Sequence: Synthetic oligonucleotide
ucacucagauaguugaagcc

SEQ ID NO: 3131 - RNA, 20 nt, Artificial Sequence
  Description of Artificial Sequence: Synthetic oligonucleotide
aucauuuuuucucauaccuu

SEQ ID NO: 3132 - RNA, 20 nt, Artificial Sequence
  Description of Artificial Sequence: Synthetic oligonucleotide
uaucauuuuuucucauaccu

SEQ ID NO: 3133 - RNA, 20 nt, Artificial Sequence
  Description of Artificial Sequence: Synthetic oligonucleotide
uuaucauuuuuucucauacc

SEQ ID NO: 3134 - RNA, 20 nt, Artificial Sequence
  Description of Artificial Sequence: Synthetic oligonucleotide
uuuaucauuuuuucucauac

SEQ ID NO: 3135 - RNA, 20 nt, Artificial Sequence
  Description of Artificial Sequence: Synthetic oligonucleotide
uuuuaucauuuuuucucaua

SEQ ID NO: 3136 - RNA, 20 nt, Artificial Sequence
  Description of Artificial Sequence: Synthetic oligonucleotide
cuuuuaucauuuuuucucau

SEQ ID NO: 3137 - RNA, 20 nt, Artificial Sequence
  Description of Artificial Sequence: Synthetic oligonucleotide
acuuuuaucauuuuuucuca

SEQ ID NO: 3138 - RNA, 20 nt, Artificial Sequence
  Description of Artificial Sequence: Synthetic oligonucleotide
aacuuuuaucauuuuuucuc

SEQ ID NO: 3139 - RNA, 20 nt, Artificial Sequence
  Description of Artificial Sequence: Synthetic oligonucleotide
caacuuuuaucauuuuuucu

SEQ ID NO: 3140 - RNA, 20 nt, Artificial Sequence
  Description of Artificial Sequence: Synthetic oligonucleotide
ccaacuuuuaucauuuuuuc

SEQ ID NO: 3141 - RNA, 20 nt, Artificial Sequence
  Description of Artificial Sequence: Synthetic oligonucleotide
gccaacuuuuaucauuuuuu

SEQ ID NO: 3142 - RNA, 20 nt, Artificial Sequence
  Description of Artificial Sequence: Synthetic oligonucleotide
ugccaacuuuuaucauuuuu

SEQ ID NO: 3143 - RNA, 20 nt, Artificial Sequence
  Description of Artificial Sequence: Synthetic oligonucleotide
cugccaacuuuuaucauuuu

SEQ ID NO: 3144 - RNA, 20 nt, Artificial Sequence
  Description of Artificial Sequence: Synthetic oligonucleotide
ucugccaacuuuuaucauuu

SEQ ID NO: 3145 - RNA, 20 nt, Artificial Sequence
  Description of Artificial Sequence: Synthetic oligonucleotide
uucugccaacuuuuaucauu

SEQ ID NO: 3146 - RNA, 20 nt, Artificial Sequence
  Description of Artificial Sequence: Synthetic oligonucleotide
cuucugccaacuuuuaucau

SEQ ID NO: 3147 - RNA, 20 nt, Artificial Sequence
  Description of Artificial Sequence: Synthetic oligonucleotide
cuccgguucugaagguguuc

SEQ ID NO: 3148 - RNA, 20 nt, Artificial Sequence
  Description of Artificial Sequence: Synthetic oligonucleotide
ucaaggaagauggcauuucu

SEQ ID NO: 3149 - RNA, 20 nt, Artificial Sequence
  Description of Artificial Sequence: Synthetic oligonucleotide
ucaaggaagauggcauuucu

SEQ ID NO: 3150 - RNA, 20 nt, Artificial Sequence
  Description of Artificial Sequence: Synthetic oligonucleotide
ucaaggaagauggcauuucu

SEQ ID NO: 3151 - RNA, 20 nt, Artificial Sequence
  Description of Artificial Sequence: Synthetic oligonucleotide
ucaaggaagauggcauuucu

SEQ ID NO: 3152 - DNA, 60 bp, Mus sp.
gtggttactaaggaaactgtcatctccaaactagaaatgccatcttctttgctgttggag

SEQ ID NO: 3153 - DNA, 60 bp, Homo sapiens
gtggttactaaggaaactgccatctccaaactagaaatgccatcttccttgatgttggag

SEQ ID NO: 3154 - RNA, 20 nt, Artificial Sequence
  Description of Artificial Sequence: Synthetic oligonucleotide
ucaaggaagauggcauuucu

SEQ ID NO: 3155 - RNA, 20 nt, Artificial Sequence
  Description of Artificial Sequence: Synthetic oligonucleotide
gcaaagaagauggcauuucu

SEQ ID NO: 3156 - RNA, 20 nt, Artificial Sequence
  Description of Artificial Sequence: Synthetic oligonucleotide
ucaaggaagauggcauuucu

SEQ ID NO: 3157 - RNA, 20 nt, Artificial Sequence
  Description of Artificial Sequence: Synthetic oligonucleotide
gcaaagaagauggcauuucu

SEQ ID NO: 3158 - DNA, 30 bp, Artificial Sequence; identical to SEQ ID NO: 1032
  Description of Artificial Sequence: Synthetic oligonucleotide

SEQ ID NO: 3159 - DNA, 30 bp, Artificial Sequence; identical to SEQ ID NO: 1032
  Description of Artificial Sequence: Synthetic oligonucleotide

SEQ ID NO: 3160 - DNA, 20 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (5)..(6): t or u
  modified_base (9)..(9): t or u
  modified_base (15)..(15): t or u
  modified_base (18)..(19): t or u
gnacnncancccacngannc

SEQ ID NO: 3161 - DNA, 20 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (4)..(5): t or u
  modified_base (7)..(8): t or u
  modified_base (10)..(10): t or u
  modified_base (13)..(14): t or u
  modified_base (17)..(17): t or u
gngnncnngnacnncanccc

SEQ ID NO: 3162 - DNA, 20 bp, Artificial Sequence
  Description of Artificial Sequence: Synthetic oligonucleotide
  Description of Combined DNA/RNA Molecule: Synthetic oligonucleotide
  modified_base (1)..(2): t or u
  modified_base (4)..(4): t or u
  modified_base (10)..(10): t or u
  modified_base (12)..(13): t or u
  modified_base (15)..(16): t or u
  modified_base (18)..(18): t or u
nncngaaggngnncnngnac

SEQ ID NO: 3163 - DNA, 20 bp, Artificial Sequence
  Description of Artificial Sequence: Synthetic oligonucleotide
  Description of Combined DNA/RNA Molecule: Synthetic oligonucleotide
  modified_base (2)..(2): t or u
  modified_base (7)..(8): t or u
  modified_base (10)..(10): t or u
  modified_base (16)..(16): t or u
  modified_base (18)..(19): t or u
cnccggnncngaaggngnnc

SEQ ID NO: 3164 - DNA, 25 bp, Artificial Sequence
  Description of Artificial Sequence: Synthetic oligonucleotide
gttgcctccggttctgaaggtgttc

SEQ ID NO: 3165 - DNA, 25 bp, Artificial Sequence
  Description of Artificial Sequence: Synthetic oligonucleotide
gttgcctccggttctgaaggtgttc

SEQ ID NO: 3166 - DNA, 20 bp, Artificial Sequence
  Description of Artificial Sequence: Synthetic oligonucleotide
ctccggttctgaaggtgttc

SEQ ID NO: 3167 - DNA, 28 bp, Artificial Sequence
  Description of Artificial Sequence: Synthetic oligonucleotide
tgcctccggttctgaaggtgttcttgta

SEQ ID NO: 3168 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3169 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3170 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3171 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3172 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3173 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3174 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3175 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3176 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3177 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3178 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3179 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3180 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3181 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3182 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3183 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3184 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3185 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3186 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3187 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3188 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3189 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3190 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3191 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3192 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3193 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3194 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3195 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3196 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3197 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3198 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3199 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3200 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3201 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3202 - RNA, 22 nt, Artificial Sequence
  Description of Artificial Sequence: Synthetic oligonucleotide
cugagucauaaccagccuggca

SEQ ID NO: 3203 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3204 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3205 - DNA, 20 bp, Artificial Sequence
  Description of Artificial Sequence: Synthetic oligonucleotide
cctcactcacccactcgcca

SEQ ID NO: 3206 - DNA, 20 bp, Artificial Sequence
  Description of Artificial Sequence: Synthetic oligonucleotide
cctcactcacccactcgcca

SEQ ID NO: 3207 - DNA, 20 bp, Artificial Sequence
  Description of Artificial Sequence: Synthetic oligonucleotide
cctcactcacccactcgcca

SEQ ID NO: 3208 - DNA, 20 bp, Artificial Sequence
  Description of Artificial Sequence: Synthetic oligonucleotide
cctcactcacccactcgcca

SEQ ID NO: 3209 - DNA, 20 bp, Artificial Sequence
  Description of Artificial Sequence: Synthetic oligonucleotide
cctcactcacccactcgcca

SEQ ID NO: 3210 - DNA, 20 bp, Artificial Sequence
  Description of Artificial Sequence: Synthetic oligonucleotide
cctcactcacccactcgcca

SEQ ID NO: 3211 - DNA, 20 bp, Artificial Sequence
  Description of Artificial Sequence: Synthetic oligonucleotide
cctcactcacccactcgcca

SEQ ID NO: 3212 - DNA, 20 bp, Artificial Sequence
  Description of Artificial Sequence: Synthetic oligonucleotide
tgccgcctcctcactcaccc

SEQ ID NO: 3213 - DNA, 20 bp, Artificial Sequence
  Description of Artificial Sequence: Synthetic oligonucleotide
tgccgcctcctcactcaccc

SEQ ID NO: 3214 - DNA, 20 bp, Artificial Sequence
  Description of Artificial Sequence: Synthetic oligonucleotide
tgccgcctcctcactcaccc

SEQ ID NO: 3215 - DNA, 20 bp, Artificial Sequence
  Description of Artificial Sequence: Synthetic oligonucleotide
gcgcgactcctgagttccag

SEQ ID NO: 3216 - DNA, 20 bp, Artificial Sequence
  Description of Artificial Sequence: Synthetic oligonucleotide
gcgcgactcctgagttccag

SEQ ID NO: 3217 - DNA, 20 bp, Artificial Sequence
  Description of Artificial Sequence: Synthetic oligonucleotide
gcgcgactcctgagttccag

SEQ ID NO: 3218 - DNA, 20 bp, Artificial Sequence
  Description of Artificial Sequence: Synthetic oligonucleotide
cctcactcacccactcgcca

SEQ ID NO: 3219 - DNA, 20 bp, Artificial Sequence
  Description of Artificial Sequence: Synthetic oligonucleotide
cctcactcacccactcgcca

SEQ ID NO: 3220 - DNA, 20 bp, Artificial Sequence
  Description of Artificial Sequence: Synthetic oligonucleotide
cctcactcacccactcgcca

SEQ ID NO: 3221 - DNA, 20 bp, Artificial Sequence
  Description of Artificial Sequence: Synthetic oligonucleotide
cctcactcacccactcgcca

SEQ ID NO: 3222 - DNA, 20 bp, Artificial Sequence
  Description of Artificial Sequence: Synthetic oligonucleotide
cctcactcacccactcgcca

SEQ ID NO: 3223 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3224 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3225 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3226 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3227 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3228 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3229 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3230 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3231 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3232 - DNA, 20 bp, Artificial Sequence
  Description of Artificial Sequence: Synthetic oligonucleotide
  modified_base (1)..(15): a, c, t, g, unknown or other
  modified_base (18)..(20): a, c, t, g, unknown or other
nnnnnnnnnnnnnnncgnnn

SEQ ID NO: 3233 - DNA, 24 bp, Artificial Sequence
  Description of Artificial Sequence: Synthetic oligonucleotide
tcgtcgttttgtcgttttgtcgtt

SEQ ID NO: 3234 - DNA, 24 bp, Artificial Sequence
  Description of Artificial Sequence: Synthetic oligonucleotide
tcgtcgttttgtcgttttgtcgtt

SEQ ID NO: 3235 - DNA, 20 bp, Artificial Sequence
  Description of Artificial Sequence: Synthetic oligonucleotide
gggtcagctgccaatgctag

SEQ ID NO: 3236 - DNA, 20 bp, Artificial Sequence
  Description of Artificial Sequence: Synthetic oligonucleotide
gggtcagctgccaatgctag

SEQ ID NO: 3237 - DNA, 20 bp, Artificial Sequence
  Description of Artificial Sequence: Synthetic oligonucleotide
gggtcagctgccaatgctag

SEQ ID NO: 3238 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3239 - DNA, 20 bp, Artificial Sequence
  Description of Artificial Sequence: Synthetic oligonucleotide
tgccaggctggttatgactc

SEQ ID NO: 3240 - DNA, 20 bp, Artificial Sequence
  Description of Artificial Sequence: Synthetic oligonucleotide
gggtcagctgccaatgctag

SEQ ID NO: 3241 - DNA, 20 bp, Artificial Sequence
  Description of Artificial Sequence: Synthetic oligonucleotide
gggtcagctgccaatgctag

SEQ ID NO: 3242 - DNA, 20 bp, Artificial Sequence
  Description of Artificial Sequence: Synthetic oligonucleotide
gggtcagctgccaatgctag

SEQ ID NO: 3243 - DNA, 20 bp, Artificial Sequence
  Description of Artificial Sequence: Synthetic oligonucleotide
gggtcagctgccaatgctag

SEQ ID NO: 3244 - DNA, 20 bp, Artificial Sequence
  Description of Artificial Sequence: Synthetic oligonucleotide
gggtcagctgccaatgctag

SEQ ID NO: 3245 - DNA, 20 bp, Artificial Sequence
  Description of Artificial Sequence: Synthetic oligonucleotide
gggtcagctgccaatgctag

SEQ ID NO: 3246 - DNA, 20 bp, Artificial Sequence
  Description of Artificial Sequence: Synthetic oligonucleotide
gggtcagctgccaatgctag

SEQ ID NO: 3247 - DNA, 20 bp, Artificial Sequence
  Description of Artificial Sequence: Synthetic oligonucleotide
gggtcagctgccaatgctag

SEQ ID NO: 3248 - DNA, 20 bp, Artificial Sequence
  Description of Artificial Sequence: Synthetic oligonucleotide
gggtcagctgccaatgctag

SEQ ID NO: 3249 - DNA, 20 bp, Artificial Sequence
  Description of Artificial Sequence: Synthetic oligonucleotide
gggtcagctgccaatgctag

SEQ ID NO: 3250 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3251 - DNA, 20 bp, Artificial Sequence
  Description of Artificial Sequence: Synthetic oligonucleotide
gggtcagctgccaatgctag

SEQ ID NO: 3252 - protein, 13 aa, Artificial Sequence
  Description of Artificial Sequence: Synthetic peptide
RRQPPRSISSHPC

SEQ ID NO: 3253 - protein, 12 aa, Artificial Sequence
  Description of Artificial Sequence: Synthetic peptide
RRQPPRSISSHP

SEQ ID NO: 3254 - protein, 9 aa, Artificial Sequence
  Description of Artificial Sequence: Synthetic peptide
  MOD_RES (8)..(8): 6-aminohexanoic acid
  MOD_RES (9)..(9): Beta-alanine
ASSLNIAXA

SEQ ID NO: 3255 - protein, 14 aa, Artificial Sequence
  Description of Artificial Sequence: Synthetic peptide
  MOD_RES (2)..(2): 6-aminohexanoic acid
  MOD_RES (5)..(5): Beta-alanine
  MOD_RES (8)..(8): 6-aminohexanoic acid
  MOD_RES (11)..(11): Beta-alanine
  MOD_RES (13)..(13): 6-aminohexanoic acid
  MOD_RES (14)..(14): Beta-alanine
RXRRARRXRRARXA

SEQ ID NO: 3256 - protein, 14 aa, Artificial Sequence
  Description of Artificial Sequence: Synthetic peptide
  MOD_RES (2)..(2): 6-aminohexanoic acid
  MOD_RES (5)..(5): 6-aminohexanoic acid
  MOD_RES (8)..(8): 6-aminohexanoic acid
  MOD_RES (11)..(11): 6-aminohexanoic acid
  MOD_RES (13)..(13): 6-aminohexanoic acid
  MOD_RES (14)..(14): Beta-alanine
RXRRXRRXRRXRXA

SEQ ID NO: 3257 - protein, 23 aa, Artificial Sequence
  Description of Artificial Sequence: Synthetic peptide
  MOD_RES (8)..(8): 6-aminohexanoic acid
  MOD_RES (9)..(9): Beta-alanine
  MOD_RES (11)..(11): 6-aminohexanoic acid
  MOD_RES (14)..(14): Beta-alanine
  MOD_RES (17)..(17): 6-aminohexanoic acid
  MOD_RES (20)..(20): Beta-alanine
  MOD_RES (22)..(22): 6-aminohexanoic acid
  MOD_RES (23)..(23): Beta-alanine
ASSLNIAXARXRRARRXRRARXA

SEQ ID NO: 3258 - protein, 23 aa, Artificial Sequence
  Description of Artificial Sequence: Synthetic peptide
  MOD_RES (2)..(2): 6-aminohexanoic acid
  MOD_RES (5)..(5): Beta-alanine
  MOD_RES (8)..(8): 6-aminohexanoic acid
  MOD_RES (11)..(11): Beta-alanine
  MOD_RES (13)..(13): 6-aminohexanoic acid
  MOD_RES (14)..(14): Beta-alanine
  MOD_RES (22)..(22): 6-aminohexanoic acid
  MOD_RES (23)..(23): Beta-alanine
RXRRARRXRRARXAASSLNIAXA

SEQ ID NO: 3259 - protein, 8 aa, Artificial Sequence
  Description of Artificial Sequence: Synthetic peptide
CHAIYPRH

SEQ ID NO: 3260 - protein, 13 aa, Artificial Sequence
  Description of Artificial Sequence: Synthetic peptide
CTHRPPMWSPVWP

SEQ ID NO: 3261 - DNA, 20 bp, Artificial Sequence
  Description of Artificial Sequence: Synthetic oligonucleotide
gggtcagctgccaatgctag

SEQ ID NO: 3262 - DNA, 20 bp, Artificial Sequence
  Description of Artificial Sequence: Synthetic oligonucleotide
gggtcagctgccaatgctag

SEQ ID NO: 3263 - DNA, 20 bp, Artificial Sequence
  Description of Artificial Sequence: Synthetic oligonucleotide
gggtcagctgccaatgctag

SEQ ID NO: 3264 - DNA, 20 bp, Artificial Sequence
  Description of Artificial Sequence: Synthetic oligonucleotide
gggtcagctgccaatgctag

SEQ ID NO: 3265 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3266 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3267 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3268 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3269 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3270 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3271 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3272 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3273 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3274 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3275 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3276 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3277 - DNA, 20 bp, Artificial Sequence
  Description of Artificial Sequence: Synthetic oligonucleotide
  Description of Combined DNA/RNA Molecule: Synthetic oligonucleotide
ugccaggctggttatgacuc

SEQ ID NO: 3278 - DNA, 21 bp, Artificial Sequence
  Description of Artificial Sequence: Synthetic oligonucleotide
  Description of Combined DNA/RNA Molecule: Synthetic oligonucleotide
ugccaggctggttatgacucu

SEQ ID NO: 3279 - DNA, 54 bp, Artificial Sequence
  Description of Artificial Sequence: Synthetic primer
  modified_base (24)..(31): a, c, t, g, unknown or other
cagtggtatcaacgcagagtacgnnnnnnnnctgagaatctgacattattcagg

SEQ ID NO: 3280 - DNA, 21 bp, Artificial Sequence
  Description of Artificial Sequence: Synthetic primer
gaagctctctcccagcttgat

---

The invention claimed is:

1. A method for preparing an oligonucleotide, wherein the oligonucleotide comprises one or more phosphoramidate internucleotidic linkages, comprising providing a phosphoramidite compound having the structure of:

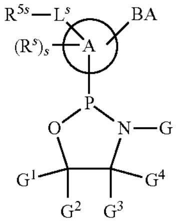

or a salt thereof, wherein a base is contacted with an oligonucleotide having an internucleotidic linkage having the structure of formula III (the "formula III oligonucleotide"):

III

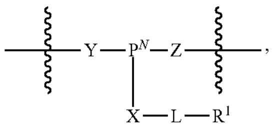

wherein the contact is performed substantially absent of water and the contact is after the length of the oligonucleotide to be prepared is achieved before deprotection and cleavage of the formula III oligonucleotide; and wherein:

$P^N$ is P(=N-L-$R^5$),

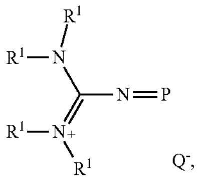

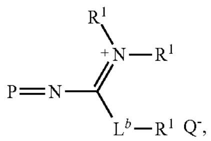

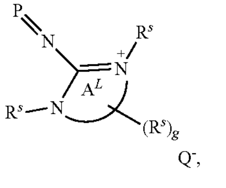

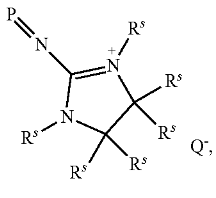

or

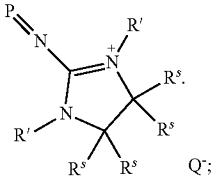

$R^{5s}$ is independently R' or —OR';

each BA is independently an optionally substituted group selected from $C_{3-30}$ cycloaliphatic, $C_{6-30}$ aryl, $C_{5-30}$ heteroaryl having 1-10 heteroatoms, $C_{3-30}$ heterocyclyl having 1-10 heteroatoms, a natural nucleobase moiety, and a modified nucleobase moiety;

each $R^s$ is independently —H, halogen, —CN, —$N_3$, —NO, —$NO_2$, -L-R', -L-Si(R)$_3$, -L-OR', -L-SR', -L-N(R')$_2$, —O-L-R', —O-L-Si(R)$_3$, —O-L-OR', —O-L-SR', or —O-L-N(R')$_2$;

each s is independently 0-20;

each L' is independently —C($R^{5s}$)$_2$—, or L;

$Q^-$ is an anion;

$L^b$ is L or —N($R^1$)—;

g is 0-18;

each of X, Y and Z is independently —O—, —S—, —N(-L-$R^5$)—, or L;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C(R')$_2$—, —Cy—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more CH or carbon atoms are optionally and independently replaced with $Cy^L$;

each —Cy— is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each $Cy^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each Ring A is independently an optionally substituted 3-20 membered monocyclic, bicyclic or polycyclic ring having 0-10 heteroatoms independently selected from oxygen, nitrogen, sulfur, phosphorus and silicon;

Ring $A^L$ is an optionally substituted 3-20 monocyclic, bicyclic or polycyclic ring having 0-10 heteroatoms in addition to the two depicted nitrogen atoms;

each of $G^1$, $G^2$, $G^3$, $G^4$, and $G^5$is independently $R^1$;

each of $R^1$ and $R^5$ is independently —H, -L-R', halogen, —CN, —$NO_2$, -L-Si(R')$_3$, —OR', —SR', or —N(R')$_2$;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms;

—X-L-$R^1$ is

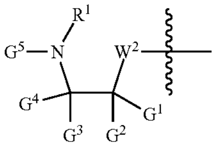

wherein $W^2$ is —O—,

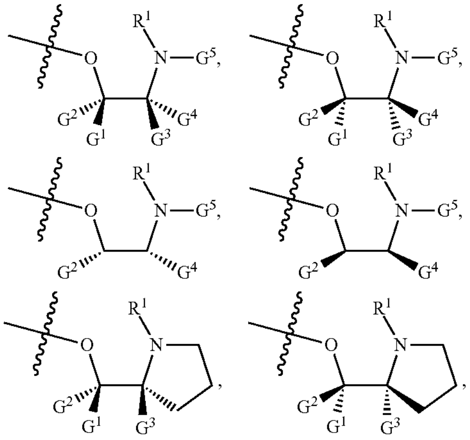

-continued

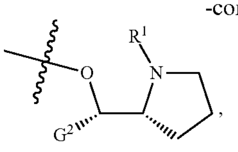

or

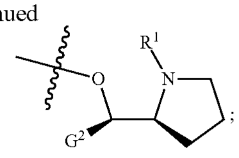

and wherein $G^2$ comprises an electron-withdrawing group.

2. The method of claim 1, wherein $G^5$ and one of $G^3$ and $G^4$ are taken together to form an optionally substituted 3-8 membered saturated ring having 0-3 heteroatoms in addition to the nitrogen of —$NG^5$-.

3. The method of claim 1, wherein $P^N$ is P(=N—L—$R^5$), wherein L is —$S(O)_2$—and $R^5$ is an optionally substituted group selected from phenyl and $C_{1-30}$ aliphatic.

4. The method of claim 1, wherein $G^2$ is -L'—$S(O)_2$R', wherein L' is optionally substituted —$CH_2$—.

5. The method of claim 4, wherein R' is optionally substituted $C_{1-6}$ aliphatic.

6. The method of claim 4, wherein R' is t-butyl.

7. The method of claim 4, wherein R' is optionally substituted phenyl.

8. The method of claim 4, wherein R' is phenyl.

9. The method of claim 1, comprising one or more cycles, each of which independently comprises or consisting of:

1) Deblocking;

2) Coupling;

3) Optionally a first capping;

4) Modifying; and

5) Optionally a second capping.

10. The method of claim 1, wherein the base is an amine base having the structure of $NR_3$.

11. The method of claim 10, wherein the base is N,N-diethylamine.

* * * * *